United States Patent 9,254,311 (MODIFIED POLYNUCLEOTIDES FOR THE PRODUCTION OF PROTEINS) - sequence listing, part 28

SEQ ID NO: 59952 - DNA, 1254 bp, Artificial Sequence
  Description of Artificial Sequence: Synthetic coding sequence
atggcaagctctaaactgagagagccggtggatgaagtcttcgacctcgatctcgcggtgccagaaacggccaggctcgactcatctctccataaagcgcgagctcaattgttggccaagggcagacgccatcgcccttcccggtctcgcctccgagactcagcgtctagtgccgaggatggcgaaggctctgatgggccagggggtaaagtaactgatggctgtggctcacctctccaccggctccggtcccccctgcactccggacctgggagtcctgctggcggtagcttctgtctggatcctcctggcctgcgcagatccctggacgaggatgagcctccgccaagcccgctcacccgctaccggcctctccacaatgctgcctcacacgagggactggcagcggcaagttgtagcccccctaggtcggccccttcatccgactcttcgcccagctttgtgcgcagacacccgcgagctgagccccattctgaggacgattcccgggacgctagccctccggagcctgcatcacctaccattgggctggataagaaaacccggagaaaatttctggatctcggggtgacgctgagaagagccagtactggcaagtctcgcaaagaaaagggctctaaccgtcttagtatggggagccgcgaatccgtcgaggggtctggtcgatctggcggtagtccgttcctgccgttcagttggttcacagactctgggaaaggctcagccagctccggtagcactacctccccgacctgctcacccaaacacgaaggcttcagccccaagaagtctgcctcacaggaaagtacactgagtgatgacagtacgcctcctagcagtagtcccaagattccttcgggtccctggcaggaagctaaatgctcatacccgtatcatacgctgtctcagtcatcagatgaatttctcgacgagcccctcccaccagtgcatcattggacctcgcagcaagtcgggcagtggctgcagagcctgaacctggaacagtacgccgctgagtttgccgctagacaagtggacggaccccagctcctccagctcgatggctcgaagctcaaatctcttggacttagcaactcccatgacagggccctagtaaagagaaagctaaaagaaatggcagcagcggctgagaaggagcgcaaagcacaggagaaagccgctcggcaaagggaaaagctgcggagaagagagcaagaggcgaagaaatcctag

SEQ ID NO: 59953 - DNA, 1338 bp, Artificial Sequence
  Description of Artificial Sequence: Synthetic coding sequence
atggcaagttccaagctgagagagcctgtggacgaggtgttcgacctggacttggctgtgccggaaactgctcggctggacagtagcctccataaagcaagagcacagctgctggccaaaggccgtaggcaccggccatcacgctcaaggctgcgcgattcagcgagcagcgctgaagatggagagggctccgatggtcctggcggaaaggttacagacggctgcggaagccctctccacaggctacgaagtccgctacactcaggccctggatcacctgcgggagggagcttctgcctggacccaccgggactgcgtagatctctcgacgaggatgaaccacctccatcccctctcaccaggtaccggccactccacaacgcagcaagccatgagggactggcagccgcttcatgctctccccctaggagtgcaccctcaagcgacagctcccccagctttgtcaggcgccatcccagagcagagccgcattcggaggatgactcgagggatgcgtctccccctgagccagcctctcccacaattggactggataaaaaaaccagacgcaagtttttagacctcggcgtcacactcaggcgggctagtacaggtaaaagcaggaaagagaaaggaagcaaccgcctgtcaatgggaagccgtgagtccgtagaagggtctggtagaagcggtggctcaccatttcttccatttagttggttcaccgactccggtaagggttctgctagctcagggtctactacctctccaacctgtagccctaagcatgaggggttttctccaaagaagtcagccagccaagctcaactactagcgcatgcacaggaggccctgagcaactcttggtgtctggtgcaggactttgggtccacacagatcggaatggagtccactcttagtgatgattctacgccaccaagcagctcccctaaaatacccagcgggccatggcaggaggccaaatgctcttatccatatcatactcttagccagagcagtgatgaatttcttgacgagcctttaccacctgtgcatcactggactagccagcaagtgggtcaatggctccaatccctgaatcttgagcaatatgccgctgaatttgctgctcggcaggttgatggacctcagctgcttcagttggacggctcaaagcttaaatcactgggtctcagcaactcccatgatagagccttagttaagcgtaaactgaaggagatggccgcagccgctgagaaagaaaggaaagcgcaggagaaagccgcaagacagcgcgagaagctccgacgtcgggagcaggaggccaaaaagtcgtag

SEQ ID NO: 59954 - DNA, 42 bp, Artificial Sequence
  Description of Artificial Sequence: Synthetic coding sequence
atggcaagctctaagcttagggaaccagtggacgaggtgtag

SEQ ID NO: 59955 - DNA, 978 bp, Artificial Sequence
  Description of Artificial Sequence: Synthetic coding sequence
atgtccgacctgcaggcagctgaaggccctgggtcttggtcccccaccgctcggccaggttctgcaggcggagtcggggattgtcagggggtggaagggtctcaagcagcagcgtccgaaaacgaggaccttgagaacaaggacacaagcctcctagcctctgccaccgacccagagccttgtagctcaccacatcggccacaaatggtgtcgcctgtgagcaaagatgcaaccgaggacctccgaaaggccaccggaccattggaggctcaggcactggtcaaacaagaccttctgcccgctgatcaggctcaagtgctcaacgaaatggctaaatatcaagtgccacagagatcaggagatattgtgatgattcagtctgagcataccggtgcaattgacgtgttgagcgctgatttagaaagcgccgatctgttgggggatcaccgaaaggtgagtccccctcttatggctcccccttgtatttggacatttgcaaaggttaaagagtttaagtccaagctggggaaggaaaagaatagcagattggtggtgaagagaggcgaggtggtgacgattcgtgtgcccacacacccagaaggcaaacgcgtatgctgggaatttgctaccgatgattacgatattggattcggcgtgtacttcgattggactccggttacctctaccgacattacagtgcaggtgagcgatagctctgacgacgaggatgaggaggaggaagaagaagaggagattgaggagcctgtacctgccggagacgtcgagaggggttcccgatcctcactgcggggacgatacggcgaggtgatgccagtgtaccgacgggattcccatagagatgttcaggcaggttctcacgactacccaggtgaggggatctatctgttgaagttcgataactcttattctctgctgcggaacaagaccctgtatttccatatctactacacatcctag

SEQ ID NO: 59956 - DNA, 666 bp, Artificial Sequence
  Description of Artificial Sequence: Synthetic coding sequence
atggagacttggtctgtagaacaggtctgctcgtggctcgtcgaaaagaacctcggagaactcgtgcatcgctttcaggaagaggaggtatcaggagctgctttgctagccttaaatgatagaatggttcagcaactcgttaagaaaatcggacaccaggccgttcttatggatctgatcaagaaatacaagcagaacactcaggggctcaagtctcccgagaatccgaaaaaggccgcactggtaatgcaaaccgaggcagcgagggattacagggacgaagagtcctctagccctgcccgacacggggaacagatgccgtccttttatcccgcagaaaacttggataacggactaatcgaccagagagtgctcaagcagaggcgcaacgttaagcaaattctcgcacgcagcaaagccctccagtggactaaatcctacgtgctgccagagttcccatacgatgtcaagtgcatgcttgctgagcagaaatgtcctgaccattcaatgcgaattagaatcattgagttcttgcaggccgacatgacgaagtatcttgaaggatccctctatcctagcacgcagcagtataatgacgtggtgaacgctctgctacaggctcaccccttcctggacgaagacggatgcggcttcgctggcgtgtag

SEQ ID NO: 59957 - DNA, 1563 bp, Artificial Sequence
  Description of Artificial Sequence: Synthetic coding sequence
atggagacatggtctgtggagcaggtgtgcagctggttagtggagaagaaccttggagaactggttcacagattccaggaggaagaagtgtccggtgcagccctcctcgcattaaacgacagaatggtgcaacaattggtaaaaaaaatcggacatcaggcagttctcatggacctgattaagaaatataaacagaatacgcaggggctgaaaagcccagagaacccaaaaaaggctgccctggtcatgcagactgaggctgcccgtgactacagggacgaggaatcatcctctcctgcccgacacggagaacagatgccctctttttatcccgcagaaaacttggataacggcctgattgatcagagggtgctgaagcagcggagaaacgtcaagcagattctggctcggagcaaggcattacaatggactaaaagctacgtgctcccagagtttccgtatgacgtgaagtgcatgctggctgagcaaaagtgtcccgatcacagtatgcggatcagaatcatagagtttctacaggccgatatgaccaaatatttggaggggtcactatatccatccacacagcagtacaacgatgtggtcaacgccctgttacaggcccatcccttcctggatgaggacgggtgcggcttctttctgtggaaaagggcactgaaggatcggtttaaatacgtgagaaggcccatcgaggatgatgaacaggtgatacgaaataaatgtaagttcggtcaccgcaggggacaaacacgaaaatccctggccgatatccgcttcgacgaaataaaactggtgcaaatcaaggaagaagcagtgtgtttcgacagcgagctggacgagcacatcaagtggttccagcaggagtatgttaagaccgaaaaagattggagggagattgacaagagaatgtctcagacactggagatccgtaggaagatgattggaagccgaactcccctgaaagatatcttgaaactattcccttttctgaaatgtccttatcagatgttcagagagttccagttgttgacccgtaccgacatctacaaaaagactagacatatcttggagagctactcagagaacatactgactagtttcagcgtggtcgacaatccgatcaacatcgtgctgcaggaaaagatgaaacactataccgacgaagacatgctgaagtacatgaagatgactgccacctgtctcctgcttccagacgtgttcggagacgacccgtctttattcgtgattatgaatgagcaggtgcaagtatctacacctgtcctagaagtgaaaaatccgtttaacatggaggtgtgcgaatttagtctgtatcttgaacgcgagaggctcacaaaagtggacgactgcgtaaccgctctggccgctctggtggctgctttccacgtctttaggatagagtgccctcgtagattgtcccagacatttaacttcctggagactctgatattcgatatgcactctccatattttccttccctgaaggagaaggaaaacgaggtgggttttcagcatccactaacctag

SEQ ID NO: 59958 - DNA, 1563 bp, Artificial Sequence
  Description of Artificial Sequence: Synthetic coding sequence
atggagacttggtctgtggagcaggtgtgctcctggctggtagagaaaaacttaggggagttggtccaccgcttccaggaggaggaagtttcaggggcagccctgctggctttaaacgatagaatggtgcaacagctcgtcaagaaaatagggcatcaggctgtgctcatggacctcattaagaaatacaaacagaacacccagggactgaaaagcccagaaaatcctaagaaggctgcactggtgatgcagacagaagctgccagagactatagggatgaagaaagtagtagtcccgctagacacggggagcaaatgccctcattttatccggctgagaatttggataatggactgattgaccagagagtactgaagcagaggcggaatgttaagcagatcttagccaggtcaaaagccttgcagtggactaagagctatgtgcttccagagtttccctatgatgtgaaatgtatgctggccgaacaaaagtgtcccgatcacagtatgagaatcagaatcattgagttccttcaagcggatatgaccaaatatctcgagggctccctctatccctccacccagcagtacaatgacgtggtgaatgccctgttgcaggcccacccgttccttgatgaggacggctgtggctttttcctgtggaagagagctctgaaagatcggttcaagtatgtgagacggccaatagaggatgatgaacaagttatcagaaataagtgcaagttcggacaccgacgaggccagacaaggaaatctctcgcggatatacggtttgacgaaataaagctcgttcagatcaaggaggaggcagtgtgttttgacagcgagctagatgagcacataaagtggttccaacaggaatacgtgaaaaccgaaaaagactggagggaaatcgacaaaaggatgagtcagacactagagattcgtcgtaagatgataggatcccggaccccattaaaggacatactgaagctttttccctttctgaaatgtccttatcagatgttcagggagtttcagctccttactaggactgacatttataagaaaacaaggcacatcctggaatcgtactcagaaaatatccttacaagtttctctgtcgtcgataacccgatcaacatcgtgcttcaggaaaaaatgaagcattacactgacgaggatatgctgaaatacatgaaaatgactgctacctgtctattactccccgacgtttttggagacgatcctagtttgttcgtcatcatgaatgaacaggttcaggtttcaactccagttctggaagttaagaaccccttcaacatggaggtctgcgagtttagcctgtatctagagcgggaacgccttacaaaggtggacgactgcgtgactgccttggcggctctggttgcggctttccacgtatttcgcatcgaatgccctcgtagactaagccaaactttcaatttcctggaaacactcatcttcgatatgcatagcccctattttcccagtttgaaagagaaggaaaatgaggtggggttccagcatccccttacatag

SEQ ID NO: 59959 - DNA, 1563 bp, Artificial Sequence
  Description of Artificial Sequence: Synthetic coding sequence
atggagacctggagtgtcgaacaggtgtgttcctggctggtggagaagaatctaggagagctggtgcaccgctttcaagaggaggaggtgtccggcgcagccctgttggcgttgaacgaccgcatggtccaacagctcgttaagaagataggccatcaggctgtactaatggacttaattaagaagtacaagcagaatactcaaggcctgaaatctccagagaatcctaagaaagccgctctggtgatgcaaactgaagctgctcgagactatagagacgaggagtcctccagccctgccaggcacggcgagcagatgccaagcttttatccagctgagaatctggataatgggctgattgaccaacgggtccttaagcagagacggaacgtgaaacagatcctcgctaggagcaaagctctgcagtggactaagtcatatgttctccctgaattcccttacgatgtcaagtgtatgctggccgagcagaaatgccccgatcattctatgcgaattagaatcatcgagttcctgcaggcagatatgaccaagtatctggagggtagcctgtatccttccacgcagcagtacaacgatgtggtcaacgcactcctgcaggcacacccgtttcttgacgaggatggctgtggattcttcttgtggaaaagagccctgaaagatcggtttaaatacgtcaggcgccctatcgaagacgatgaacaggtgattcgcaataagtgcaagtttggtcaccgaagaggccagacccgaaagtcactagcagatatacgattcgacgagatcaagttggtgcagattaaagaggaggccgtctgcttcgattctgaattggatgagcatattaagtggtttcagcaagagtacgtgaagacagaaaaggattggcgggaaattgataaaaggatgagccagactctggagattcggaggaagatgataggctctaggaccccgttgaaggatatccttaagctcttccccttcttgaagtgcccttaccagatgttccgggagtttcaacttttaaccaggacagacatctataagaaaaccaggcacattctggagagctactccgaaaacatactgactagcttcagcgtggttgataacccgatcaacatcgtgctacaagagaaaatgaagcactacacagacgaagacatgctgaaatatatgaagatgaccgccacatgcctgctgcttcctgacgtattcggagatgatccctccctcttcgtaatcatgaatgagcaggtccaagtttctactcccgtgctcgaggttaaaaatccattcaacatggaagtatgcgagtttagtttgtacttggaaagggaacgacttaccaaagtggacgattgtgtcaccgccctcgcagctctcgtggccgctttccacgtcttccggatcgaatgtccaaggaggctgtcccaaacctttaactttcttgaaacactaatcttcgatatgcattcaccatactttccatccttgaaggagaaagagaacgaggtgggatttcagcaccctctcacttag

SEQ ID NO: 59960 - DNA, 522 bp, Artificial Sequence
  Description of Artificial Sequence: Synthetic coding sequence
atggagacctggtcagtggaacaggtgtgctcctggttggtcgagaaaaacctgggggaactggttcatagattccaagaggaggaggtgtccggcgctgccctcctggccttgaacgataggatggttcaacagctggttaaaaaaataggccaccaggccgtgctcatggaccttataaagaagtataaacagaatacacagggccttaagtcacccgagaatcctaaaaaagccgctctcgtcatgcagacggaggcggctagggattatagagatgaagaatccagctcacctgccagacatggcgaacagatgccctcattttaccccgcagaaaacctggacaacggactgatcgatcaacgggtgctcaaacagcggaggaacgttaagcaaatcctggctcgatcaaaggctcttcagtggaccaagagctacgtgcttccagaattcccctacgacgttaaatgtatgttagccgaacagaagtgtcctgatcactccatgcggatcagatag

SEQ ID NO: 59961 - DNA, 2085 bp, Artificial Sequence
  Description of Artificial Sequence: Synthetic coding sequence
atgatgttccgcgatcaggtcggcatcctcgccggatggtttaagggatggaacgagtgtgagcagactgtagcgctgctgtcgcttctgaagagggtaactagaactcaggcaaggtttttacagctatgtcttgagcactcactcgctgactgtaacgacattcacctcctggagagcgaagcaaattccgcggctattgtgtcacagtggcagcaggaatccaaggagaaggtcgtgtcactcctgctcagccacctgcccttgctacagcctggtaacaccgaagctaaatcagagtatatgaggttattgcagaaggtgcttgcttactctattgagtccaatgcctttatcgaggagagtcgccaactgctgtcctatgcccttatacatcccgctaccaccttggaggataggaatgcccttgcactgtggctcagtcaccttgaggaaagattagcctcagggtttaggtctaggccggagccatcttatcattcaaggcagggttccgacgaatggggcggtccagcagagctgggaccgggagaagccggaccgggatggcaagataaaccccctagagagaacggccacgtgccattccacccttcttctagcgtacctcccgctatcaatagtattggaagcaatgccaatacaggtctgccgtgtcaaatacaccccagtcctttgaaaaggtctatgtcccttatcccaacctctccccaggtgcctggagaatggccctccccagaagagcttggggcacgcgctgcatttaccacccctgaccacgctcctctcagcccacagtctagtgtcgcatcttcaggatccgagcaaactgaggagcagggttctagtcgaaacacgtttcaggaagatggcagtggcatgaaagacgtgcccagctggctcaaatcactacggctccacaagtacgccgctttgtttagccagatgagctatgaggaaatgatgaccctcactgagcagcacctggaatcgcaaaacgtgaccaaaggggctaggcataagatagccctgagcatacagaagctgcgtgagagacaaagtgtcttaaaatcattggaaaaagacgtgctggaaggcggaaatctgaggaacgccctgcaggagcttcaacagatcatcataacacccatcaaggcttacagcgtgctacaggccacggttgcggcagccaccactaccccgacagcaaaggatggagcacccggagagcctcctcttccgggagcagaaccccctctggctcaccccggtactgataaggggactgaagccaaggatccccctgctgtagagaactatccgccacctcctgcacccgcacccacagacgggagcgaacctgcacctgcgccagtggccgatggagacattccctcccagttcaccagagtgatggggaaagtgtgtactcagctcttagtctcacgacctgatgaagagaacatcacgagctaccttcaactaattgagaagtgtcttacccatgaggctttcaccgagacccagaaaaagaggctgctgagctggaagcagcaagtgctcaagctgctaagaacttttcccaggaaagccgcattggagatgcaaaactatcgacagcagaaggggtgggcgtttgggtctaacagcctccccattgccggaagtgtgggaatgggagtggctaggcgtactcaacgacagttccctatgccaccacgcgcattacctccaggtaggatgggactgcttagcccgtcagggatcgggggtgtctcccctaggcacgcgttgacctcaccctcgctggggggtcagggtagacagaacctttggttcgctaacccaggcggaagcaattcaatgccctcccagagcagatcaagtgtgcagagaacccactcactccctgtgcatagctcaccccaggccatcttaatgttcccccctgattgtcccgtgccaggaccagacctcgagattaatcccacactggagtcattgtgtttatccatgactgagcatgcactgggagacgggactgataagacatccaccatttag

SEQ ID NO: 59962 - DNA, 1992 bp, Artificial Sequence
  Description of Artificial Sequence: Synthetic coding sequence
atgatgtttagagaccaagtggggatccttgctggctggttcaaggggtggaacgagtgcgaacagactgtggctctcctgtccctattgaagcgcgtgacccgaacacaggccagatttttgcagttgtgtctggagcactctctcgccgattgtaatgatatccaccttcttgagtctgaggctaattccgccgcaatagtaagccagtggcagcaagagagcaaggagaaagtggttagcctactcctgtcccatctgccgcttcttcaaccaggaaatactgaggcgaaatccgagtacatgcgcctcctgcaaaaggtgctggcatactccattgagtccaatgccttcatcgaggagagtaggcagcttctttcctatgctctgatccaccctgcaacaactctggaagacaggaatgcactggctctgtggctatctcatctcgaggaaaggctagcctctggctttcgctcccgacccgagccatcataccactctcgccaaggttccgatgagtggggcggacccgctgagctgggacccggagaggcgggaccaggctggcaggacaagccacctagggaaaacggccatgtccctttccacccaagttcatctgtgccacctgccatcaactccattggatcaaatgccaacactgggctcccctgtcagatccatccttctccactgaaacggtcgatgagccttatcccaactagccctcaggtgccaggagaatggccttctccagaagaacttggtgcgagagctgcgtttaccacgcccgaccacgctcccctgagtccgcaatcctctgtggcctctagcggttccgagcagaccgaggagcaggggtcaagccgtaacacattccaagaagatggttctggaatgaaagatgtaccaagttggctcaaatcactgcgcctgcacaagtatgccgctcttttctcccaaatgtcctatgaggagatgatgaccctaacagaacaacatctagagagccagaatgtcaccaaaggggcacgccacaagatcgctttgtccatccagaagcttagggaaagacagagtgtactgaagtctcttgaaaaggatgtcctggaggggggaaatttgaggaacgccttgcaggagctgcagcagattatcataacccccatcaaggcctacagcgtgctccaagccacagtggccgcagccacaactactccaaccgcaaaggacggtgccccaggcgaaccacctctgcctggggcagaaccccctttggcccatcctggcaccgacaaaggcacagaagcaaaagacccacctgctgttgaaaattatccccctccgccagcccctgcgccaaccgatgggtcagagcctgcacctgcacccgtcgccgacggagacatcccatctcagttcacgagggtcatgggcaaagtgtgcacccagctcttggtgagtaggcccgatgaggaaaatattacaagctatttgcagttgatagagaagtgcctaacacatgaggcgttcactgagacccagaaaaaacgcctgttgagctggaaacaacaggttctgaaactgctgcgtacgttcccacggaaggccgcactggaaatgcagaattaccgacagcagaaagggtgggcattcggctcaaactcccttccaattgcgggaagtgtgggaatgggggtagccagaagaactcaacgacagttcccaatgccacccagggctcttccacctggacggatgggccttcttagtccatctggcatagggggagtctcaccgaggcacgccctgacacctcaaccttggcggccaggacctacagaaccggtggtatgccagccatggcggcagcagcagcatgcccaaagtgagccacagctctgcgccgcacacccattagctccgggtccacttgtaacccctggccatagccacgtgcccagtagattgcccggatcttgggcctag

SEQ ID NO: 59963 - DNA, 522 bp, Artificial Sequence
  Description of Artificial Sequence: Synthetic coding sequence
atgtgcacaaatatagtgtatgaatggttaaaggcgctgcagttgccccaatatgccgagtctttcgtggacaacggatacgacgatctagaggtctgtaagcagataggcgaccccgacctcgacgcaattggtgtgctcgctccagcacataggcgaagaatcctcgaggctgtaagacgattacgcgagcaggatgccaatgctgctgggttatattttaccctggagccgcaacccgctccccctggcccaccggcagacgccgttcccactggtaggaggggagagccctgcggaggtcccgctcagggcacaaggggagattccagagggcacaccacagcccctcggagccgagaactcgtctcctaccccaagctcaagctcaaaatcatgattcgagataagttggttcgtgatgggattcatttgtcaaagccaccttacagcagaaaggtccccatggcaggtattttagaatacctcatgaactggcccaagtcgagccagagtagatag

SEQ ID NO: 59964 - DNA, 1341 bp, Artificial Sequence
  Description of Artificial Sequence: Synthetic coding sequence
atggctgtcaatcctctcttgacccccacgggccagcagaccattccccttatcccatctccgtttggacccccaacggtggatcgcgacgtgctccctagcaccgtggcgccaactgatcctagacagttttgtgttccgagtcaatttggctcttctgtccttccgaataccaatatggcaaatgtgctctccagtcgcatatatcccggatggggcattctgccccctgaatctataaaggctgttgccaggaggaatgaaatgatccagaggcatcatacagcccgtaccgagatggaaatgtacgctatctatcagcagaggcgcatggaaaagatcaacccgaaggggctggcaggactgggcatccccttcctttacggcagcagcgtgcctgcggcacctgcagcctaccatggccgatcgatgttacctgcaggcgacctgcatttccaccgatcaactctcaggaacctgcagggtaatccaatgttagccgctacggcccctcactttgaagaatcctggggccaaagatgtcgccgattacgcaaaaacacagggaatcagaaagcattggactctgacgctgaatcgagcaaatcccaggcagaggagaagattctgggccagacacatgcagtgccctacgaggaggaccactacgctaaggatcctgatatcgaagcccctagtaatcagaaatcatctgagaccaacgagaagcctactacggccctggctaacacttgcggcgaactggagccaacacatagaaaaccttggggaagccataccaccactcttaaggccaaggcctgggatgacggcaaagaagaagcctctgagcaaatctttgccacctgcgacgagaaaaacggggtttgtcccccagtgcccagaccatctctgccaggaacacacgcattagtgaccatagggggaaatctctcccttgacgaggatatccagaagtggactgtggacgatgtgcatagctttattagaagtttacccggatgttcagactacgcacaagtcttcaaagaccacgctattgatggtgaaacactgcccctgctaaccgaggagcacctgaggggtaccatgggtctgaaactaggacccgctcttaagatacagtctcaagtgtcacagcacgtgggatccatgttctacaagaaaaccctgagtttccccattcggcaagcatttgatcagcctgccgacacttctccccttctggacccaaattcctggtccgacacaatgaacatcttttgcccacaagacaccattatcccaaagggcatagagagaggatccatgaggaattag

SEQ ID NO: 59965 - DNA, 1341 bp, Artificial Sequence
  Description of Artificial Sequence: Synthetic coding sequence
atggcagtgaaccctttgttaacacccacaggccagcaaacaattccactgattccgagtccattcggcccacccaccgtggacagggacgtcttgccaagcacagtagcccctaccgatccacgtcagttttgtgtcccttcacagtttggatcttcggtgctccccaacacaaatatggcaaacgtgctctcctcccgtatatacccaggttgggggattctgcctcctgaaagcataaaggccgtcgcgagaaggaacgagatgatccaacgtcaccacactgcaaggacagaaatggaaatgtatgccatctatcagcagcggaggatggaaaagatcaaccctaagggactggccggtctgggtatcccattcttgtacggatccagcgtgcctgccgctcccgcagcttaccacggtcggagtatgctgcccgcaggtgacctgcactttcaccggtcaaccctacgcaacttgcagggcaaccctatgctcgccgcaactgcacctcacttcgaggagagctggggccagcggtgccgccgattgagaaagaacacaggcaaccagaaagcactggattccgacgccgagtcttcgaagagccaggcagaagaaaagatactgggccagacccacgccgtcccttatgaggaggaccattacgccaaagatcctgacatcgaagccccatctaaccaaaaatcctcggagaccaatgaaaagcctaccactgctctagcaaatacgtgcggggagctggaacctacacatcggaaaccctggggttcccacaccacgaccttaaaggcaaaggcttgggacgacggaaaggaggaagcctccgaacagatcttcgccacctgtgacgaaaaaaatggtgtgtgccctcccgtgcccagacccagtctccccggaacccacgcactcgtgaccattggaggcaatctgtccttggacgaggacatccagaaatggacagtcgacgatgtccattcatttatcagaagcctgccaggctgttctgattacgcgcaggtctttaaggatcatgcgattgacggcgagactttgcctctactcactgaagagcacctgagaggaactatgggccttaagctcggtcccgcattaaagatacaaagtcaggtgagccagcacgtgggcagcatgttctacaagaaaacgctgagcttcccaatccggcaggccttcgaccagccggcagataccagcccactcttggatccaaacagttggagtgatacgatgaatatattctgccctcaggataccataattccaaaaggtatcgaaaggggatcaatgcgtaattag

SEQ ID NO: 59966 - DNA, 2781 bp, Artificial Sequence
  Description of Artificial Sequence: Synthetic coding sequence
atgaagaagaccaggtcaacaaccctgcgaagagcctggcctagtagtgatttttccgacagagccagcgaccggatgagatcaaggagcgaaaaagactatagacttcataagcggtttcccgctgctttcgcccctcaggctagccggggttacatgacatccggcgatgtgtctcctataagcatgtcacctatttcacagagccagtttatcccattaggcgaaatcctgtgcctggcgatctcagctatgaattctgcaagaaagccagttacacaggaggctttaatggagcacttgactacatgctttccaggcgtacccactccatcccaggaaatcttgcgccatacactcaacacgcttgtcagggagcgtaagatctaccctactccggacggttatttcatagtgacaccccaaacttacttcattacccccagtttaattcgcacaaacagcaaatggtaccacctggacgaaaggataccggacagaagccaatgcacatctccccagccaggaacaataaccccgagcgctagtggttgtgtgcgtgagcgcactctccctaggaaccactgcgattcttgccactgttgtagggaggacgtacatagcactcacgcaccaactctgcagcgaaagtccgcaaaggactgtaaagacccttattgtcccccttccctatgccaggtgccccctaccgagaagtccaaaagcaccgtcaacttctcatacaagaccgagacacttagcaagcctaaggactcagagaagcaaagcaaaaagttcggcctcaagctgttcaggttaagcttcaagaaggataaaacaaagcagctggccaatttttccgcccagttccctccagaagagtggcccctccgtgacgaggatacgcctgcaaccattcccagggaggtcgaaatggagataattaggcggattaaccccgacctcactgtggagaatgtgatgcgccataccgcccttatgaaaaagctggaagaggagaaggcccaaaggagcaaggccggaagctccgcacatcactccggaaggtctaaaaagtcccgaacgcatcgcaagagccatggtaaaagccgtagccattcaaagaccagggtcagcaaaggagaccccagcgacgggtctcacctcgatataccagcggagcgtgaatatgacttctgcgacccactgacacgggtgcctcgcgaaggctgctttatcatcgagcacaaaggggataattttataatgcactcaaataccaatgtgcttgaatcccatttccccatgactccggagtgggatgtgtccggggagttagctaagcgcaggacagagatgcctttcccggaaccaagtcgtggctcttcacattctaaagtgcaccggagccattcccatacacaggatcggaggtcaaggaatgaacggagcaacaaggctaaggaaaggtcccgcagtatggataacagcaagggccctttaggggcatctagtctcggaacaccggaggacttagcagaggggtgcagtcaggatgaccagacaccctcacagtcatatatcgacgacagcactttgcgcccagctcagacggtgagtttgcaaagagcccatatctccagtacttcctacaaagaagtctgcatccctgaaatagtgagcggctctaaggaaccatcgtcagcatgttctttgctcgaacccggaaagccccctgagagtctaccttcatacggcgaactgaacagctgtccaacaaaaactgccacagacgactatttccagtgtaacacttcatctgagacagtgctgacagctcctagcccactagggaaaaataaagaagaccatgataccttgacattggcggaaggtgtcaaaaaattatccccgagtgatcgacaggttcctcactctagtagggaacctgtcggccacaaggaagagtctccgaaaggtccgggtggaggccctgctgcatccggcggagtggccgaaggtatcgccaatggtcgcctggtgcagcatcacggggcagagccttcaagtctagataagagaaaggagattttttccaaagatacattgttcaaacccttgcattccaccctcagcgtgaattcctatcataagtcctccctgtcactgcttaagagtcatcctaagacccccgcagataccctcccgggtcggtgtgagaagctcgagccatccctcggcactagcgccgctcaggccatgccagcatctcagaggcagcaggaatccgggggaaatcaggaggcgtctttcgactactacaatgtgtccgatgacgatgattccgaggaaggggctaacaaaaacaccgaggaagaaaaaaaccgcgaagatgtgggtacgatgcagtggctgctggagcgagaaaaagagcgcgacttgcaaaggaagttcgagaaaaatctcactctgctggctccgaaggagacagatagctcgtccaaccagcgggctacccacagcgcccgtctcgattcgatggactcaagcagtatcacagtggactctggattcaatagtccaaggaccagagagtcactggcctctaacaccagcagtatcgtggagtccaatcgcagacaaaaccctgcgctctcccccgcacacggcggtgcgggaccagcgttcaactttcgtgcttcggccgagccccctaccaatgaggcggagaaactccagaaaccttctaattgtcttcaggcgagcgtgacaagcgtgtag

SEQ ID NO: 59967 - DNA, 2592 bp, Artificial Sequence
  Description of Artificial Sequence: Synthetic coding sequence
atgaaaaagactcggagcacgaccctacgcagagcctggcccagctctgatttctcagacagagcgagcgaccgaatgcggtcacggagtgagaaggactatcgacttcacaagcggttccctgccgcttttgcccctcaggcaagtagaggctacatgacgtccggcgacgtgagccccataagcatgtccccgataagccagagtcaattcatacctctgggagaaatcttgtgcttggccatttctgcaatgaattccgcaaggaagcctgtgacccaggaggccttgatggagcacctcacaacatgttttcccggagtaccaaccccttctcaagaaatactcaggcacacactgaataccctggtgcgtgagagaaaaatctaccctacaccagacggatacttcatcgtaaccccccaaacctacttcatcaccccaagtctcattaggactaacagcaaatggtatcacttggatgaaagaattcctgacagaagccagtgcacctcaccgcagcctggaactatcacacccagcgcttctgggtgtgttagagagaggacattgcctcgaaatcactgcgatagttgtcactgctgtcgcgaggatgttcacagtacacacgctcctactctgcaaagaaagtctgccaaggactgtaaggatccctactgtcccccatctctctgtcaagtgcctcccactgaaaaatccaagagcaccgtaaacttcagttataaaacggaaacactgtcaaagcctaaggactctgaaaagcagtccaaaaagtttggactgaagctctttcgcctgagtttcaagaaggataagactaagcagctggctaacttctctgctcagtttccacctgaggagtggcctctgagagacgaagacactcccgctactattcccagggaggtcgaaatggagatcatccggagaattaatccggatctgacagtggaaaacgtgatgagacacaccgccctcatgaagaagttggaggaagagaaagcgcagcgcagcaaggccggatcttccgcccaccacagcggaagatctaaaaaaagccggacacatagaaaatctcacggtaagtcccgctcacacagcaaaacccgggtttccaagggggaccctagtgacggatctcaccttgatattccagccgagagagagtatgatttctgcgacccgctgactagagtgcctcgcgagggctgcttcattatagagcataagggggacaacttcatcatgcatagcaatactaacgtgctcgagagccatttccctatgactccagagtgggacgtcagcggggagttagccaaacggagaaccgaaatgccattcccggagccctctcgcggaagctcccacagcaaagtgcaccgctctcactcacatactcaggaccgtcggtctagaaacgaaaggagcaataaggctaaagaacggtcgcgctccatggataattccaaggggccactgggtgcatcttctctgggtacccccgaggacctggccgaaggatgttctcaagacgaccagacccccagccaatcttacattgatgattccaccttaaggcccgcacagaccgtctctttgcaaagggcacacatcagctcgacctcctataaggaggtgtgcataccagagatagtttctggctccaaggaacccagcagcgcatgctctctgctcgaacctgggaagcccccagagagtctgcctagctacggggaattaaactcctgtcctaccaagactgctaccgacgattattttcagtgcaacactagtagtgaaacagtgctgaccgcgccttcacccctgggcaagaacaaggaggaccacgacaccctcactcttgcagaaggggtaaagaaattatccccatctgatcgccaggttccacattcgagtcgagaaccagtggggcataaagaggagtcccccaaggggccaggcggtggacctgccgcatccggaggcgtggctgagggcatagctaatgggaggctggtgcagcaccacggggcagagccatcctccttggacaagcgtaaggagatattctctaaggatacgcttttcaagcctttgcactcgactttgagtgttaactcatatcacaagtccagtctatccctgctgaagtctcaccctaagacccctgccgataccctgccgggaaggtgcgaaaagttagagccaagcttgggaacttctgcagcccaggcgatgcccgcatctcagcggcagcaggagtccggaggcaaccaggaagctagcttcgactattataatgtcagtgatgacgatgattcggaggaaggggcaaataagaacacagaggaggagaaaaacagagaagatgtcggaacaatgcagtggctgctggagcgagaaaaagaacgcgacctacagaggaaattcgaaaagaacctgacgcttctcgcacccaaggagacggattccagctcaaatcagcgggcaacacattccgccagattagactccatggattcatctagcattactgtagattccggcttcaatagcccccgaaactag

SEQ ID NO: 59968 - DNA, 4155 bp, Artificial Sequence
  Description of Artificial Sequence: Synthetic coding sequence
atgagccagcttcagttgtggctgcagtttgaagctttgaacaagggtatggctccaggaagcccgcagacccgagctgcacagtcctcttgcagtattgctgcactccaagtcctccagaagtcagacgccgtactacggggaccggaggatagtagttacttcgaggacttttccaacattagcattttctcttcttcagtggattcgctttccgatatcgttgacacgcctgactttctgccagctgactccctaaaccaggtgtcaacaatctgggacgacaaccccgcaccaagtacacatgacaaggtgtcagcaccgggagccccttctcaacctcgccctacctcagtggcttctcctgcaagagacccgcacggccctgtgaggctgcgaggcccaaccagctgcgacctgtcccggctcgccagagctgacatcctcctaccttttcagcttttccagttgtcccggcctttcgcaggatttgaggatttcctcccttcccattctaccccactcttagttagctatcaggaacagtctgtgcaaagccagcctgaagaggaggatgaagccgaggaagaggaggccgaggagctgggtcatacagagacctacgcggactacgtgccgagcaaaagtaaaataggcaaacagcatccggatagagtggtggaaacgagcacattgagctccgttcccccaccagacatcacctacaccttggcgctcccttccgactcgggtgcactgtccgcactgcaattggaagccatcacatacgcatgccaacagcatgaagtattgcttcccagcggtcaacgtgcagggttcttaatcggggacggtgcaggcgttggcaagggcagaactgtcgcaggagtgattctggaaaaccacctgaggggcagaaagaaggccttatggttctccgtttccaatgacctcaaatacgacgctgaaagggatcttagggatatcgaggcaacgggtattgctgtccatgcgttgtccaaagtcggagccgtgctgggaaaggttggagggaaagtggggacggtgccgtgcaaaattaaatatggcgatacaactaccagcgagggtgttctcttcgcgacatacagtgccctgatcggggagtcccaggctgggggacagcaccggacacgacttcggcagattctcgattggtgtggtgaggcatttgaaggcgtcatcgtgttcgatgaatgccacaaagctaaaaatgctggttccacaaagatgggcaaagccgtgctggatttgcaaaacaagttacctttagctagggtagtgtatgccagtgcaaccggggcttccgaacccaggaacatgatctacatgtcccggctcggcatctggggagagggaactccttttaggaattttgaggagttcctgcacgccattgagaagcgtggagtcggagctatggagattgtagccatggacatgaaggtgagtggtatgtacatcgcccgtcagctgagtttttctggagtgacctttcggatcgaagaaattcctctggcccctgctttcgaatgcgtttacaatagggccgctctgctctgggctgaagcattgaatgtattccaacaggctgccgactggatagggttggaatctcgtaagtcgctgtgggggcaattctggtctgcccatcagaggttcttcaagtacctgtgtattgccgctaaggtcaggcgcttggttgagctggcaagagaagaacttgcacgggataagtgtgtggtgattgggttgcagagcactggagaagctagaacaagagaggttctgggcgaaaacgacggtcacctcaattgttttgtttccgccgctgaaggagtcttcctgagcttgatccaaaaacacttcccaagcacaaaacggaaaagggataggggggctggctctaaacgcaaacccggagtaatccgcatttcggacgattctagtactgagtccgatcctggactggacagcgactttaattcctccccagagtcattagtggacgatgacgtggttatcgtggacgccgtcgggctcccatctgacgatcgaggtccattatgtctgctgcagagagaccctcatggccctggcgtgctggagcgggtagagaggctcaaacaggacctgctggataaagtgcggagactgggcagagaactgcccgtgaataccctggacgagctgatcgatcagctagggggaccacaacgggttgcagagatgaccgggagaaaagggagggtcgtgtctcgtcccgacgggaccgttgcatttgagagcagagccgagcaaggcttgtcgatcgatcacgtgaatctacgtgagaagcagcgtttcatgtccggagagaagttggttgcgatcatttccgaagcatccagcagtggcgtaagcctgcaggcggaccggcgtgtccagaaccagcggaggcgcgttcatatgaccctggagctcccatggtctgctgaccgggcaatacaacagtttggccgaacgcataggtccaatcaggtttcggccccagaatacgtgtttttaatctcggagctggccggtgagagaaggttcgcatcgattgtggccaagcggctcgaaagcctcggagcactcacccacggggatcgtagggcaactgaatcacgcgatctgagtaagtataacttcgagaataaatatggcacacgggcactccattgtgtgctaacgacgattctgtcccagaccgaaaacaaggtgccggttccccagggctaccccggaggtgttcctactttttttcgcgatatgaaacagggcctcctctctgtcgggattggcggacgggaaagccggaatggctgtttagacgttgagaaagactgttccattactaagttccttaatcgcattctggggctagaggtacataagcaaaatgcattattccagtacttcagcgataccttcgatcaccttattgagatggataagagagaaggtaagtatgacatgggtatcttaggagagcaccggtgccgcggagtcgtatgggtggacctcgccccaggaatcgaggagatctatgaggaatcccagcaagtgttcctggccccaggtcatcctcaggacggacaagtggtcttctacaaaatttctgtggaccgcggtctcaaatgggaagacgcctttgcgaagagcttggctctaacgggtccttacgacggcttctatttatcatacaaagtccgcggaaacaagccctcttgtctcctagccgagcagaaccgcggtcagttctttaccgtctacaagcccaacatcggtcgtcaatcacaactggaagccctagatagtctcagaaggaagtttcacagggttaccgccgaggaagcaaaggagccatgggaatcaggatatgctctatccctgacccattgtagtcacagcgcttggaacaggcactgcaggctcgcacaagaaggcaaggattgccttcagggtcttaggttacggcatcactatatgctctgcggtgccctgttgcgagtgtggggtaggatcgccgctgtcatggctgacgtttccagttcctcctacctgcagattgtgagactgaagacgaaggaccggaagaagcaggtaggtataaagattcccgagggatgcgtacgcagagtcctccaggagctgcggctgatggacgctgatgttaaaagacgacaggccccagcgctcggctgtccggctccaccggcaccacgccctctcgcactaccatgcggcccaggcgaggtgctggatctcacttactctccaccagccgaggcatttccacctccccctcacttttccttccccgcacctctgagtcttgacgccggacccggtgtggtccctctcggaacgccagatgcccaggcggatcccgcagcgctggcccaccaagggtgcgatattaatttcaaggaagtcctcgaggatatgctaaggtccctgcacgcaggacctccaagcgagggcgcactaggcgagggggcaggtgctggcggagcggctggaggaggaccagagcgccagtctgttatccaatttagtccgccttttcctggcgcacaggcgccactgtag

SEQ ID NO: 59969 - DNA, 4101 bp, Artificial Sequence
  Description of Artificial Sequence: Synthetic coding sequence
atgctagccgtgggtccagccatggatcgcgattacccacagcatgagccaccacccgcaggaagcctactgtattcccctccaccgctccaaagtgcgatgctgcactgtccttattggaatacattttccctcccaccctacccagcctttagcagcgattccaggccttttatgtcaagtgctagtttcctagggtcccaaccttgcccagatactagctacgctcctgtagccacagcttcctccctgcccccaaagacatgcgactttgcccaagattctagttacttcgaggacttcagcaatatttctatcttctcttctagcgtggatagcctgagtgatatcgtagatacacctgattttctgccagcggactctctcaaccaggtgagtacaatttgggatgacaatccagctccctcaacacacgataaactctttcagttatccaggccattcgcagggtttgaggatttccttcccagccactctacaccccttctcgtctcctaccaagaacaaagtgtacagtcccaacctgaagaggaggacgaggcagaagaagaagaggccgaagaactgggccatacagagacatacgctgattatgttccaagcaagtcaaaaattgggaaacaacaccctgaccgggtggtcgagacttccactctgagtagtgtcccaccacctgacattacatatactctcgctctgccttctgacagtggtgccctgtccgcgctgcagctggaagccattacctacgcatgccagcagcacgaagtgctcctcccctcaggacagcgagccggatttttgattggagacggcgcaggggtcggtaaaggcaggactgtggccggagtgattctggagaatcatcttagagggaggaaaaaagctctgtggttcagtgtttccaatgacctgaaatacgacgccgagagagacttgagagatattgaagcaaccgggatcgcagtgcacgctctaagtaagataaagtacggggacaccactactagcgagggagtcctctttgctacctatagcgccctgattggtgagagtcaggcaggagggcagcacaggactaggcttagacagatccttgactggtgtggcgaggcctttgaaggggtcattgtgttcgacgaatgtcataaggccaaaaacgccggatcgacaaagatgggtaaggcagtgttagacctacagaacaagttgcctcttgcccgtgtagtctacgcctccgctacaggagcctcagaacctagaaacatgatctacatgtcacgcctcggcatctggggagaggggaccccatttcggaacttcgaggagtttttgcacgctattgagaaaagaggcgtcggcgcaatggagattgtggctatggacatgaaggtgtctggaatgtatatcgctcggcagctatctttctccggtgtgactttccgaattgaggagatcccacttgcacccgcattcgaatgcgtatataaccgcgcagcgctattgtgggcagaagctctgaatgttttccaacaagccgcagactggattggcctggagtccagaaaaagcctctggggccaattctggtctgctcaccagcgtttctttaagtatctttgcattgccgctaaggtcagaagactggtcgagctggccagggaggaactggccagggataagtgcgtcgtgatcggcttacagtcgactggggaggcacgcacccgcgaggtgctcggtgaaaacgatggtcaccttaattgctttgtcagcgcagctgagggcgtgttcctctcgctcatccaaaagcactttccgagcactaagaggaagcgtgaccgcggagcaggctctaagcggaagcgcagaccgagagggaggggagcaaaggcaccacggctggcctgtgaaacggctggggtcatacgcatctcagatgattcatctactgagtctgatcccggtctcgattcggattttaatagctctcctgagtcactcgttgacgatgatgtcgtcattgtggacgccgtagggctgcccagtgacgatcgaggacccctgtgtcttctgcaaagagatccacacggcccaggtgtgttagaaagggttgagcggctcaagcaagacctattggataaggtgcgccgtctgggacgcgagctacccgtcaataccttggatgagctaatcgatcagctgggcggaccacagcgtgtcgcggaaatgaccgggagaaaaggtcgtgtggtgtccagaccggatgggactgtggcttttgaaagccgcgctgagcagggcctgagtattgatcacgttaatttgagagagaagcaaaggtttatgtcaggagaaaagctggtggcgataatcagtgaggcctccagttcaggagtctcactacaggctgacaggcgtgtgcagaatcagaggcgtagggttcacatgacactcgaactcccctggagcgccgaccgagccatccaacagtttggtagaactcatcggagcaaccaggtgtcggcccctgagtatgtttttcttatctccgagctggccggtgagcggcgattcgccagtatcgtggcaaagaggttagagtctctcggtgcactgacccatggcgatcgccgagcaaccgaatcgcgcgacctaagtaaatataactttgagaacaaatacgggacacgcgcactccattgcgtcctgacaacgattctgagtcagaccgagaataaggtgccagtgccccagggctacccaggtggcgtccccacattcttccgtgatatgaagcagggtctgcttagcgtcggaattgggggtagggagagtcgcaatggttgtctcgacgtggaaaaggattgtagcattaccaaattcctgaaccgcattcttggcctggaagttcacaagcagaatgctctgttccagtacttctccgacacttttgaccaccttatcgagatggacaaaagggaggggaagtatgatatgggcattctggatctggctcctggtattgaagagatctacgaggaaagccagcaagtcttcctcgcccctgggcaccctcaggatggacaagttgtgttctacaagatttccgtcgataggggcctcaagtgggaggacgcctttgccaagtctctggctctgaccggcccatacgacggcttctatttgagctacaaggtccgcggaaataaaccaagttgtttacttgcggaacagaatagagggcagttctttacagtgtacaaacctaacattggacggcagtctcaattggaggctctggactctttgcgtcggaaatttcatcgcgtgaccgccgaagaggctaaggagccatgggaaagtggttacgccctctcactgacgcattgctcccattcggcatggaatcgtcattgcagattagctcaggaggggaaagactgcctccagggcctgcgcctcagacatcactacatgctatgcggggcattactcagagtgtgggggaggattgctgccgtgatggctgacgtgtcaagttctagctatctgcaaatcgttcgcctcaagaccaaagaccggaagaaacaggtggggatcaaaatccccgaagggtgcgtccggcgagtcctgcaggagctcaggctaatggatgctgatgtgaaaagacggcaggcccctgccctagggtgtccggctccacccgctccacgacccctcgctctgccatgcggccctggagaggttctcgacttaacatactctcctcccgctgaagcctttcccccacccccacacttcagttttcctgccccactgtctctagacgctggtcccggagtcgtgcctctcggtacgccagatgcccaggcggaccctgccgctcttgcacaccagggctgtgacattaacttcaaggaggttctggaggatatgctgagaagcctgcacgccggacctccttctgagggcgcattgggagaaggcgctggcgcaggaggcgctgcgggaggaggccctgagagacaatccgttatacagttcagcccaccatttccgggagcacaagctcccctatag

SEQ ID NO: 59970 - DNA, 3930 bp, Artificial Sequence
  Description of Artificial Sequence: Synthetic coding sequence
atgagagagcccctgcctgggtccgccagttgggggacccccggaccaccgtccgctggcactatgtctcaactccagttgtggctgcagtttgaggctctgaacaaggatagtagctatttcgaggatttttctaacatcagcatattttcctcatcagttgacagtctgagtgacatcgtagacacgcccgacttcctgcctgcggattctttaaatcaggtgagcacaatatgggacgacaatccggcaccctctacgcatgacaaattgtttcagctgtcccgcccattcgccggtttcgaggattttctaccctcccactccacccctctgctagtcagctatcaggagcagtccgtccagagccagcccgaggaggaagacgaggctgaggaggaagaggctgaggaactaggccatactgagacatatgctgactacgtgcctagtaagtcaaagatcgggaagcagcatccagatcgagtagtcgagacgtccactctcagttccgttcctccacccgatatcacgtataccttagccctgccttccgactctggtgcgctcagtgctttgcaactcgaagctattacctatgcttgccagcagcatgaagtactgctcccatctggccagagggccggttttctgataggcgacggtgccggtgtgggaaagggacgcactgtggcaggggtgatcctggagaatcaccttagaggacgtaaaaaggctttatggtttagtgtgagcaacgacctgaagtacgatgccgagagggatctgagagatattgaggctaccggcatagccgtgcatgcgctgagcaagatcaaatacggagacaccacaacctccgagggagtgctttttgctacatatagcgctttaataggggagagtcaggcaggaggtcaacatcgcacaagactcaggcagatactcgactggtgcggagaagcctttgagggtgtgatcgtgttcgatgaatgtcacaaagcaaagaatgctggctctacgaagatgggtaaagcggtgctggacctgcagaacaagttgccactggctagagtggtgtacgccagcgcaacgggcgcatcagaaccaagaaacatgatatacatgagcaggctagggatttggggcgagggaaccccatttcgcaactttgaagaattccttcacgcaatcgagaaacgtggcgtaggggcaatggagattgtcgccatggacatgaaagtgtccgggatgtacatcgctaggcagctgagcttctctggcgtgaccttcaggatcgaagaaatacccctggcacccgcatttgaatgcgtgtataacagagcagctctcctctgggcggaagcgctgaatgtattccagcaggccgcagattggatcggcctggagagtcgcaagagcctgtggggccagttttggtccgcgcaccaacggttctttaaatacctgtgcatagctgccaaggttcgtcggctggtcgaactcgctcgggaggagcttgcaagggacaaatgtgtggtgatcggcctccaatctacaggggaggcgcgaacgagagaagtgctcggtgagaacgatggtcacctgaactgcttcgtgagtgccgcagaaggcgtttttctgtctttgatccagaagcatttccccagcaccaaacgaaagcgtgaccgaggcgcaggttccaagagaaagcgtagacctcgaggacggggtgctaaagcccctaggctcgcatgcgaaacggctggtgttattcgaatatccgacgactcaagcactgaaagtgatcctgggctggatagtgactttaactccagccccgagtctcttgtcgacgacgacgttgttatcgttgacgcagtgggactgccctctgacgaccggggacccctctgtttactgcagcgcgacccacacggcccaggcgtgctcgagagggtcgagcgcctgaaacaggacctcctggacaaagtgcggcgtctggggcgagagcttccagtgaacaccctggatgaactcatcgaccagcttggcggtccccagagagtagcagaaatgacaggacgtaagggccgagtagtgtccaggccagacgggactgtggcctttgagtcgagggcagaacagggactgagcattgatcacgtgaatctacgggagaagcagcgttttatgtcgggagagaagttagttgccatcatcagcgaagcctcgtccagcggagtgagcctgcaggctgatcgtcgcgttcagaaccaacggagacgagttcacatgactctggaattaccatggagcgcagatagggccatccagcagttcggtcgcacgcaccggagtaaccaggtgagtgccccagaatatgtgtttctgatcagcgagttagccggtgagcgccgttttgcttctattgtcgctaagagactggagtctctgggggctttgacccatggcgacaggagggccacagaatcaagagacctgtctaaatataatttcgagaataaatacggcactcgagcactccactgcgtcttgaccacaatcttgtctcaaacggagaacaaggtgcccgttccacagggctaccccggtggggtcccgacattcttccgagacatgaaacaaggactgctcagcgtgggcatcgggggacgggagtctcggaatgggtgtctggacgttgaaaaagactgcagtattacgaagtttctgaatcgcattctggggttagaggtgcacaaacaaaacgccctgtttcagtactttagcgacaccttcgatcacttaatagagatggataagcgggaaggcaagtatgatatggggattctggatttggccccagggattgaagaaatctacgaagaaagccagcaggtcttcctggctcccggacaccctcaggatggacaggtcgtgttttataagattagtgttgataggggattaaagtgggaggatgccttcgcgaagtcactcgcactaaccggtccctacgacgggttttacttgagttataaggtgaggggcaataagcccagttgcctcctggccgagcagaatcgcggacagttctttacagtgtataaacccaatattggcaggcaatcgcaattggaagccctagattcccttaggcgcaagttccatagagtgacggcagaagaggctaaagagccatgggaaagcgggtatgccctgtccctgactcactgctcccatagtgcatggaataggcactgtagactagcacaggagggcaaggactgcctgcaaggcctccgattacgacatcattatatgctatgcggcgctcttctgcgcgtgtggggcaggatcgctgccgttatggcagatgtgagcagttcgtcctatttgcagatcgtaaggttaaagaccaaagaccgaaaaaaacaggtgggaataaagatcccagaagggtgtgtcagaagggtgttacaggaactccgtttgatggacgctgatgtgaagcggcgtcaggctcccgcattgggctgtccagccccacccgctcctcgacccctagctctcccttgcggcccaggggaggtcctagacctgacctatagcccacccgctgaggcatttcctcctccccctcatttctcttttcccgcacccctctccttagatgccggtcccggagtcgtcccgctaggtactccggacgcgcaagcggaccctgcggctctggcccaccaaggctgtgacatcaacttcaaagaagttctcgaagacatgctgagatcgctgcatgctggaccccctagcgaaggcgcactgggggaaggcgcaggcgctggcggtgccgcaggtggcggaccggaaagacagtctgtgatccaattttcaccgccatttcccggagctcaagcccctctctag

SEQ ID NO: 59971 - DNA, 453 bp, Artificial Sequence
  Description of Artificial Sequence: Synthetic coding sequence
atgtccggatggatcgcgacgtctaagactcgcatgcaagacttctggagccttctaacattttcttctgacctggtggacgtcaaggactccggagactaccccctcaccgcacctggccttagctggaagaaattccagggatcattctgcgaattcgtgggtactctcgtatgccggtgccaatatatcttattgcatgatgactttcctatggataacttaatctctttacttaccggctttagcgactcccaggtctgtgccttttgtcacacatcaactctggctgctatgaaattgatgacctcactcgtcagagttgctcttcagctctcactccacgaggatatcaatcaaagacagtacgaagccgagcgaaacaaaggccctggccagagagccccagagcgcctggaatcgctgctggagaagcataaggagctgcattag

SEQ ID NO: 59972 - DNA, 453 bp, Artificial Sequence
  Description of Artificial Sequence: Synthetic coding sequence
atgagcggatggattgccacaagcaagacgaggatgcaggacttctggtctctcctgacattcagctcagacctggtggacgtgaaagactccggggattatcctctcactgctcctggcctgtcgtggaagaagtttcagggctcgttttgcgaatttgtgggcaccctggtgtgcaggtgtcagtatattctcctgcacgacgattttcctatggataaccttatctccctcttaacgggtttctccgatagtcaagtatgtgccttttgtcacacgagcactttggctgcgatgaagcttatgacctcccttgtgcgggtcgctcttcagttgagtttgcacgaggatatcaaccagcgacagtatgaagccgagagaaacaagggccctggacaaagagcccctgaacgcctggaaagtctgctggaaaaacacaaagagctgcattag

SEQ ID NO: 59973 - DNA, 891 bp, Artificial Sequence
  Description of Artificial Sequence: Synthetic coding sequence
atgctttcccccaaagacatattgagaaaggacctgaaacttgttcatggctacccgatgacctgcgcttttgccagtaactgggagaaaattgaacagttccattctcgcccagatgacatcgtaattgctacgtacccaaagagcggaaccacatgggtctcagaaatcattgatatgatacttaatgacggcgacattgagaaatgtaaacgtggctttataactgagaaggtgcccatgctcgaaatgacacttccaggtctcagaacctctggaatcgaacagctggagaagaacccctccccaaggattgtcaaaacccacctacctaccgatctactgccgaaatctttctgggaaaacaactgtaaaatgatttacctggcaaggaacgcgaaagacgttagcgtcagctactaccactttgatcttatgaacaacttgcagccatttcctggcacgtgggaagagtatcttgaaaagtttctgaccggcaaagtcgcctacggaagttggtttactcacgtcaagaactggtggaagaaaaaggaagagcatcctatcctgttcctgtactatgaggatatgaaagaaaaccccaaggaagagattaagaagatcattcgattcttagaaaagaaccttaacgatgaaattcttgataggataattcatcatacgtctttcgaggtgatgaaggataatcccctcgttaattatactcatctccctactaccgtgatggaccacagcaagagtccctttatgcgcaagggcactgcaggggattggaagaactacttcaccgtagcacaaaatgagaaattcgacgcaatttatgaaaccgaaatgtcgaagaccgccctgcagtttcgcacagaaatctag

SEQ ID NO: 59974 - DNA, 468 bp, Artificial Sequence
  Description of Artificial Sequence: Synthetic coding sequence
atgctcagtccgaaggacatactgcggaaagacttgaaactggtgcatggatatcctatgacgtgtgccttcgcgtctaactgggaaaagatcgaacagtttcattcacgccctgacgacatcgtaatcgcgacatatcctaaatctggcactacatgggtgagtgaaatcattgacatgatcttgaatgacggagatatcgaaaagtgcaagagagggttcatcaccgaaaaagttcccatgctggagatgacacttccagggcttagaacttctgggatcgagcagctggaaaagaaccccagcccgagaattgtgaagacgcatttgccaacagatcttctgccgaagagcttttgggagaacaactgtaagatgatctacctggccagaaacgccaaggacgtgtcggtgtcatattaccatttcgacttgatgaataacctgcagccatttcccggtacatag

SEQ ID NO: 59975 - DNA, 639 bp, Artificial Sequence
  Description of Artificial Sequence: Synthetic coding sequence
atggaccctgttgtcttgtcctacatggatagtttgttgagacagagcgatgtgagtctcttggatcccccatcttggctgaatgatcacattattggattcgcttttgagtacttcgccaacagccagtttcatgactgttccgatcatgtcagctttatctcgcctgaggttacacagtttatcaagtgcacttccaaccccgcagagattgccatgttcctggaaccgcttgatcttcccaacaaacgagtggtgtttttagccataaacgacaacagcaaccaggccgcaggcggtactcactggagtctgttggtgtatctccaggataagaatagctttttccactacgactctcattcaaggagtaactctgtgcacgccaaacaagtggctgagaagttagaagcttttctgggtcggaagggggacaaacttgcatttgtcgaagaaaaagcacctgcccaacagaattcgtacgactgcggcatgtacgtgatctgcaatactgaagctctgtgccagaatttctttcggcagcagactgagtcgctgctccagctcctcacacctgcctatattacaaagaaacggggtgaatggaaagacttgattaccacattggctaagaagtag

SEQ ID NO: 59976 - DNA, 639 bp, Artificial Sequence
  Description of Artificial Sequence: Synthetic coding sequence
atggacccagtggttctctcctacatggactcattgttacggcagtccgatgtgtcactcctggatccaccaagctggctcaatgatcatatcatcggctttgccttcgagtatttcgctaactcccagttccatgattgttctgatcacgtgtctttcattagcccagaggtcacccagttcatcaagtgcactagcaaccccgcagagatcgctatgtttctggagcccctggatttacccaacaagagagtggtctttctagctattaatgacaattcaaaccaggctgccggtggcacacattggagtctcctggtgtacctgcaggacaaaaactccttttttcattatgatagccatagtcggagcaacagcgttcacgcaaaacaagtcgccgaaaaactcgaagctttcctcgggagaaagggcgataagttggcgttcgtagaagagaaggccccagcacagcagaatagctacgattgcggaatgtatgtgatatgtaacacagaagccctctgccagaactttttcagacagcagaccgagtcacttttacagctcctgactcctgcttacatcaccaagaagagaggggaatggaaggatttaattactacattagcaaagaaatag

SEQ ID NO: 59977 - DNA, 639 bp, Artificial Sequence
  Description of Artificial Sequence: Synthetic coding sequence
atggacccggtggtgctcagttacatggacagcctactgaggcagtccgatgtgtccttgctggatcccccaagctggttgaatgaccatataatcggttttgcgtttgagtatttcgccaattcccaatttcacgactgtagcgaccacgtgtcattcatcagtcctgaggtgacgcaatttatcaagtgtacaagcaatcctgccgagatagctatgttcctggagccgcttgacctgcccaacaagcgagtcgtgttcctcgccatcaatgacaactcgaatcaggctgctgggggaacccactggtccctgctcgtgtatttgcaagacaagaattccttctttcattacgacagtcatagtcgctcaaacagcgttcatgctaagcaggtcgctgaaaagttggaagcttttcttggaagaaagggcgataaattggccttcgtggaggagaaggctccggctcagcaaaactcttatgactgtgggatgtatgtgatttgtaacacagaggccctgtgccagaactttttcaggcagcagaccgagagtttattgcaactgttaacaccggcttacataactaagaagagaggcgagtggaaggatcttattacaacattagcaaagaagtag

SEQ ID NO: 59978 - DNA, 639 bp, Artificial Sequence
  Description of Artificial Sequence: Synthetic coding sequence
atggacccagtggtattgagttatatggatagcctactcagacagtcagatgtctcccttctggacccacccagttggctcaacgaccacatcatcggcttcgcctttgaatatttcgccaactctcaattccacgactgcagcgatcacgtgtcctttatcagtccagaggttacccagttcattaagtgtaccagtaatccagcagagatagcaatgttcctggagcccttggatctacctaacaagcgtgtagtatttctggccatcaacgacaactccaaccaggccgctggaggtactcactggtccctcctcgtttatctgcaggataagaactccttcttccactacgactcccactctaggagcaactccgtccacgccaagcaggttgctgagaagctggaagcattcctgggaagaaaaggggataagctcgcatttgtggaggagaaggcgccagcccagcaaaactcatacgactgcgggatgtatgttatatgtaacaccgaggccctatgccagaatttctttcggcagcagacagagagcctgttgcagttgctgacacccgcttacattactaagaagcggggagaatggaaggacctgatcactacactagccaaaaaatag

SEQ ID NO: 59979 - DNA, 1668 bp, Artificial Sequence
  Description of Artificial Sequence: Synthetic coding sequence
atggcagataggggcggagttggcgaagcagccgcagtaggtgctagccccgcttccgtacccggactcaatccaactctaggatggcgtgaacggctgcgggcaggtctagctggcaccggtgcttccctttggttcgtggctggactgggactgctgtacgccctccggattcccctgcgtttgtgtgagaatctagccgcagtgactgtcttcctgaattcactgacccctaagttctacgtggcacttaccgggactagtagtctgataagtggcctgatcttcattttcgagtggtggtatttccacaaacatggaacatccttcattgaacaagtgagcgtgagccatctgcagcctttgatggggggaacggagagcagcatcagtgagccaggttcacctagtaggaatcgggagaatgaaaccagccgacagaacctcagcgagtgcaaagtctggagaaacccactgaacctattcagaggcgcagaataccgaagatatacctgggttactggcaaggaacccctgacctattatgacatgaacctttccgctcaagaccaccagacattcttcacatgcgacaccgattttctgcgcccatctgatactgtgatgcagaaggcatggagagagcgcaatccgcctgcaaggatcaaagccgcttatcaggccctcgaactaaataacgactgcgcaaccgcctacgtgctgctggccgaggaggaggctactaccattgtggacgccgagcggttgttcaagcaggccctcaaggcaggcgaaaccatataccgccagtctcagcagtgtcaacatcagtccccccagcatgaggctcagctgaggcgagataccaacgtgctggtttatatcaagaggcgcctggctatgtgcgccagaaagctagggagaataagggaagctgtaaagattatgagggatctgatgaaggagttcccacccttgaccatgctcaatatacacgagaacctgttggagtctctgctggagttacaggcatatcctgacgtgcaggctgttctggccaagtacgatgacataagtctgccgaagtcggcagctatctgttacactgcagctctgctgaaaacacgtacagtttccgagaagttttctccggagacagcaagcaggagaggcctgtctaccgctgagatcaacgctgtggaagccattcatagggcagttgagtttaacccacacgtgcctaagtatctactggagatgaagtcactgatcctgccacccgaacatatcttgaaaagaggcgattccgaggcaattgcttacgccttctttcacttacaacactggaagcgaatcgaaggggctctcaacttgttacaatgtacttgggaagggacctttcgcatgatcccctaccctttggagaaggggcatctgttttatccgtacccttcttgcaccgaaacagctgatagagaattacttcccacgtttcatcatgtctctgtgtatcccaagaaggaactgcccctgtttattcatttcacagcgggattttgttcctcgaccgctatgattgccattctcactcaccaattcccggaaatcatgggaatctttgcgaaggccgtctccatgatatccagaacttgcgtggattatctatag

SEQ ID NO: 59980 - DNA, 1728 bp, Artificial Sequence
  Description of Artificial Sequence: Synthetic coding sequence
atggccgatagagggggagtgggcgaggccgctgctgtcggcgcaagcccagcctctgtgcctggtctgaaccctaccctggggtggcgggaacgtctgagagctggactggccggaacaggcgcttctctgtggtttgtcgccggattggggcttctgtacgcgctccgtattccgctgcggttatgcgagaatctcgcagcagtgacagtgtttctgaactcactcacaccaaagttttacgtggccctgaccggcacatcttctttgataagtggcttaatattcatttttgagtggtggtactttcacaagcacgggacgtcctttatcgaacaggtgtctgtgtctcatctgcagcccctgatgggaggaacggagtcatctatctccgaacccggatctccatctagaaacagggagaacgagaccagccgtcagaacttatcagaatgtaaagtgtggcgaaaccccctgaacttgttcaggggtgccgaatatcggaggtacacgtgggtaacgggaaaagagcccttaacctactatgacatgaatttgtccgcgcaggaccaccaaactttttttacctgcgataccgactttctcaggccgtcagatactgtgatgcagaaggcctggcgggagagaaatcctccagccaggatcaaagccgcttaccaggccttggagctgaataatgattgcgctaccgcctacgtgctactggcggaagaggaagccaccaccattgttgacgctgaaaggttattcaagcaggccctgaaagccggtgaaaccatatatcgacagtcccaacagtgtcaacatcagtctccacagcatgaggcacagcttcgcagggatactaatgtgctagtttacattaagcgtcgactcgctatgtgtgctcgcaaacttggtcgtattagggaggccgtcaaaattatgagagacctgatgaaagaattccctccattgacaatgctaaacatccatgagaacttgctggagagcctgcttgaacttcaggcatatcccgatgtgcaggcagttctggcgaagtatgatgacataagcctgcccaagagtgctgcaatctgctacacagccgctctacttaagactagaactgtgtctgagaagttctcaccagagactgctagcaggagaggtctgagtaccgcggagattaacgccgtggaggccatccatagggccgtcgaatttaacccgcacgtgcctaagtaccttcttgagatgaaaagtctgatcctcccacccgaacacattctgaagagaggggacagtgaagcaatcgcctacgcatttttccacttacagcattggaagcgcatcgagggggctctgaatctcctgcagtgcacatgggaaggcacattccgtatgattccctatcccctggagaaaggacacttgttctacccatacccttcttgtacggaaacagcggaccgcgagctattacccacttttcatcacgtctcagtctaccccaaaaaagaactccctctgtttatccactttactgcagggttctgttcctcaaccgcaatgattgcgatcctcacacatcagttccccgagattatgggaatcttcgctaaagcagtccttggcctttggtgcccgcagccttgggccagcagcggttttgaagagaatacgcaggacctcaaatcagaggacctgggtctgagtagtgggtag

SEQ ID NO: 59981 - DNA, 1635 bp, Artificial Sequence
  Description of Artificial Sequence: Synthetic coding sequence
atggccgaccgaggaggcgtgggagaggcggctgcggtgggagcatctcccgcttccgtacccggactcaaccctacactgggttggagagaacgcctgcgtgccggtctggcaggcacaggggcaagcctttggttcgttgccggactgggactcctgtatgccctgcggattcccctccggctgtgtgagaatctcgcagctgttactgtgtttttgaattctctcaccccaaaattctacgtggctctgaccggtacaagtagcctgatttccggactgatcttcatttttgagtggtggtacttccataaacacgggacttccttcattgaacaagtttcagtgtctcacctgcagcctctgatgggcggaactgaatcttctatttcagagcctggaagcccgtctcgaaaccgggagaacgagaccagccgccagaatctgagcgaatgcaaggtgtggaggaatccgctgaacttatttaggggcgcagaataccgtcgttatacctgggttaccggaaaagagccattgacctactacgacatgaatctttcagctcaggaccaccaaacattctttacctgcgatacagattttctgcgtccatccgacactgtgatgcagaaggcctggagggagagaaatccacccgctagaattaaggctgcctatcaagccctggagcttaacaatgattgtgctactgcctatgtgctacttgcagaggaggaagccacaactattgtggacgcagagcggctattcaaacaagcactgaaggccggtgagaccatttacagacagtctcaacagtgtcagcaccagtccccccagcatgaagcccagctgcgtagggatacaaacgttttagtttacataaagagacgccttgccatgtgcgctagaaagctcggacggattagagaagcagtaaagataatgcgcgatctcatgaaagaattccctccactgacaatgctaaacatccacgaaaatctgctggagtctttactcgagctgcaggcttacccagacgtgcaggctgtgttggcaaaatacgatgatatttcattaccaaaaagtgctgccatttgctataccgctgccctgctgaaaacacggactgtgtctgagaagttctctccagaaaccgcaagccgcagaggcctgagtaccgcagaaattaacgccgtagaagctattcaccgagccgtggagttcaacccacacgtgccaaaatatctgctggagatgaagtctttgatccttccaccagaacatattctgaaacgcggtgactctgaggcaatcgcttacgcttttttccacttacagcattggaagcggatcgagggagccttgaacttgttacagtgtacctgggagggaaccttccaccatgtgagcgtgtacccgaaaaaggagcttccactcttcatacacttcactgctgggttttgttcgagtaccgcaatgattgctatactgacacatcagtttccagaaattatgggcattttcgctaaagccgtcctggggctgtggtgtccacagccgtgggcctcaagcggctttgaggagaacactcaggatctcaaatccgaagacttggggctgtcaagcggatag

SEQ ID NO: 59982 - DNA, 690 bp, Artificial Sequence
  Description of Artificial Sequence: Synthetic coding sequence
atgagcccgtttctatttcgcgacgatatgaaggacctgacagtcttcttaaacagcctgacgcctaaattctacgtggctctgacaggtaccagttcactgataagtgggttgatttttattttcgagtggtggtattttcacaaacacgggacttctttcatcgagcaggtgtcagtgtctcacctccaacctctcatgggaggtaccgagagttctatcagcgagcctggaagcccctcgcgaaaccgcgagaatgaaacttcccggcagaatttgtctgaatgcaaggtgtggcggaaccctctgaacctatttagaggcgcagaatatagaaggtatacctgggtgactgggaaggagcctttaacatattatgacatgaatctgtccgcccaggaccaccaaacatttttcacatgtgacactgacttcctgagaccatctgacaccgttatgcagaaagcctggagagagagaaacccgcctgccagaatcaaggccgcttaccaggccctagagttaaacaacgactgcgctaccgcttacgtcctcttagcagaggaagaggctactaccatagtggacgcagagaggctgttcaagcaagccctcaaggcaggcgagactatctatcgccagagtcaacagtgtcagcaccagagcccgcagcacgaggcacagctctag

SEQ ID NO: 59983 - DNA, 966 bp, Artificial Sequence
  Description of Artificial Sequence: Synthetic coding sequence
atgggcggtaccgagtcctcaatttccgaaccgggatctccaagcaggaatagggagaacgagaccagtcgacagaatctcagcgaatgcaaggtttggcggaaccccctgaacctgtttagaggcgctgaataccgccgatatacatgggtcactggtaaggagcccctgacttactatgatatgaacttatctgcacaggatcaccagacgttctttacatgtgacaccgacttcttacgaccctcggacaccgttatgcagaaggcttggcgcgagagaaacccaccggcaagaatcaaagcagcctaccaggcactggaactgaacaacgattgtgccacggcctatgtgctgctggcggaggaggaagcaaccacaatagtagacgccgagagactatttaaacaggcgctaaaggccggtgagaccatttatcgacaatcccaacagtgccagcaccagtcccctcaacacgaagcgcagctcagacgggatacaaatgtcctggtttacattaagcgtcggctggccatgtgcgccaggaaactcggaaggattcgggaagccgtcaagataatgagagatctcatgaaagagtttcccccactaactatgcttaacattcacgagaacctgcttgagtctttactcgaacttcaagcttatccagacgtgcaggctgtattagccaagtatgatgatatttcactccctaaaagcgcagctatttgttatactgccgcactccttaaaacacgaacagtgagtgaaaaattttccccggaaactgcaagtcggaggggactcagtacagccgagattaatgcagttgaggccattcaccgggctgtcgaattcaacccccacgtgcctaaagtcgagatctacccattctccccccagctcaacatcaaagccgtggataactcagccattagcaaatatcccgctaatatgtactag

SEQ ID NO: 59984 - DNA, 1617 bp, Artificial Sequence
  Description of Artificial Sequence: Synthetic coding sequence
atggcagatcgagggggagtgggggaggcagccgctgtgggtgcttcacccgcaagcgtgccgggactgaatccgaccctgggttggcgggagcgacttagggcaggcctggctggaacgggcgcttccctttggttcgtggctggcttaggcctgctgtatgcattgcgcattccgcttcgcctgtgcgaaaatctcgcggcaggcacaagtagtctgattagcggactcatttttatcttcgaatggtggtattttcataaacacggaacctctttcatcgaacaggtcagcgtctctcatctgcaaccgctgatgggcggaaccgagagcagcatctctgagcctgggtccccatctcgaaatagagaaaacgaaacatcccggcagaatctcagcgagtgcaaagtctggaggaatcctctgaatctctttcgtggtgccgagtacagacggtatacatgggtcaccggaaaggagccactgacttactatgacatgaacctgtccgcccaggaccatcaaaccttcttcacttgtgacacggactttttgcggcctagcgatacggttatgcaaaaggcctggagagagaggaaccccccagctcgcattaaagccgcttatcaggccctggaactgaacaatgactgtgcaacagcatatgtgttactggccgaggaggaggccaccactatcgttgatgccgagcgcctatttaagcaggccctgaaagcaggagaaacaatctatcggcagtctcagcagtgccaacaccagagcccacaacacgaggcccagctgaggcgcgacacgaacgtgttggtgtatatcaagagacgactcgcaatgtgcgctaggaagctgggacgtatccgagaggctgttaaaatcatgcgggatctgatgaaggaattccctcctctgacaatgcttaacattcacgagaatttactggagtccctgttggaactgcaggcgtatccagacgtgcaggctgtcctcgctaagtacgatgatattagcctccctaaatcggcagcaatctgttacactgcagctctgcttaagactaggaccgtttctgagaagtttagccccgagactgcctccaggcgtggcctctcgacggccgaaatcaacgcagtcgaggccatccatcgggcagtggaatttaacccccacgtgcccaagtacttgcttgagatgaaatcattaattctccctccggagcatattctgaagcggggagatagcgaagccattgcctacgccttttttcacctacagcactggaaaagaatagaaggcgcacttaatctgcttcaatgtacgtgggaaggcacatttagaatgataccatacccgctggagaaaggccatctgttttacccttacccaagttgtacagagacagccgacagagagctgctgcctaccttccatcacgtgagtgtctatcccaaaaaagagcttccactttttatccacttcaccgctgggttttgttcgtccactgccatgattgccatcctgactcatcagtttcccgagattatggggatttttgcaaaagcggtgagtatgatatcaaggacttgcgtcgattacctgtag

SEQ ID NO: 59985 - DNA, 1668 bp, Artificial Sequence
  Description of Artificial Sequence: Synthetic coding sequence
atggccgataggggcggagtgggagaggcagctgctgtaggcgcatcccctgcatcagtccccggattgaaccctacattgggatggagagaacggctacgtgcaggcctcgcaggcacgggggcttcactctggtttgtggccggactggggcttctttacgctttgcggatcccactcaggctgtgcgagaatctggctgccgtgacagtgttcttgaactccctgaccccgaaattctacgttgccctcacaggcacctcatccctgattagtgggctgatctttattttcgaatggtggtactttcataagcatggtacaagcttcattgagcaggtctccgtatctcatctgcagccactgatgggagggaccgagagctcaatcagtgagcctggcagcccctctcggaaccgggaaaacgaaacctctcgccaaaacctctccgaatgtaaggtgtggagaaatccgctgaacctcttccggggagctgagtaccggcgttacacgtgggttactggcaaagagccactcacctactacgacatgaacttgagtgctcaggaccaccagaccttcttcacctgcgacactgacttcttgcgtccctctgatacagtcatgcagaaagcttggagggaacgcaacccaccagctaggatcaaagcagcgtatcaagcccttgagttaaacaacgactgcgctactgcatacgtacttctggctgaagaagaggcaacaaccattgttgatgccgaacgcctgttcaaacaggccttaaaggccggagaaaccatatatcgtcagagccagcagtgccaacaccagtctccccagcacgaggcccagttgcgaagggataccaacgtgctcgtctacataaagcgccgactcgctatgtgtgcccgaaagttggggcgaattagggaagctgttaagatcatgagagacctgatgaaagagtttcccccacttactatgctcaatattcatgagaacctgttagagtcccttctcgaactgcaagcctatcccgatgtgcaagccgtgttggcgaaatatgacgatattagcctgcccaagagcgccgctatttgttacacggcagcactgctcaaaacaagaacagtcagtgaaaagttcagtcccgaaactgccagtagacgaggactcagcactgccgagatcaacgctgtagaggctattcaccgggcagtggaatttaatcctcacgtacctaagtacctgctcgagatgaaaagtttaatcctgccccctgagcacatactcaagcggggagactccgaagcaatagcatatgcattctttcacctgcagcattggaaaaggattgagggtgccctgaacctgcttcagtgtacctgggagggcacgtttaggatgatcccatatccactagaaaaagggcatcttttttatccttacccaagttgcaccgagaccgcggacagagaactcctgcccacattccaccatgtatccgtgtatcctaaaaaagagcttcctctgttcattcactttactgcagggttttgttcttccactgctatgatcgcgattcttacccaccagttccccgagatcatggggatttttgcaaaagctgtggtaggggtgaagacccagaaggagaacgctgattag

SEQ ID NO: 59986 - DNA, 1179 bp, Artificial Sequence
  Description of Artificial Sequence: Synthetic coding sequence
atgaatctgtcagctcaagaccaccagacgttttttacttgcgatactgatttcctgaggccgagtgatactgtgatgcagaaggcttggcgagagagaaacccacctgcccgtatcaaggcggcatatcaggctctagaactaaataacgattgcgctaccgcctatgttctattggccgaagaagaggctacaacgatcgtggacgccgagcgcctgttcaagcaggccctgaaagctggagagaccatttatagacagtcccaacagtgtcagcatcaaagccctcaacatgaggcacagctaagaagggatactaacgtactcgtgtatatcaagagaagactggctatgtgtgcgagaaaattaggacgcattcgggaggctgtgaagattatgcgtgacctgatgaaggaatttccaccactcaccatgctgaatatacacgagaacctgcttgaatcattactcgagctgcaagcgtacccagacgtacaggctgtgcttgcaaaatacgatgacattagtctgccgaagagcgccgctatttgctatacagcagctctcctgaagacacgcaccgtttccgagaaattctcacccgaaacagcaagtaggagagggttgagtacggccgagattaatgctgtggaagcaattcacagggctgtggaatttaacccgcacgtgccaaagtatctacttgaaatgaagtccctgatactgccacctgagcacatcctcaaaagaggtgattccgaggccatagcatacgcattctttcatctgcaacattggaaaaggatagaaggggcactaaacctcctccagtgcacctgggagggaactttcagaatgatcccatacccattggaaaagggccacctcttctacccctatccaagctgcactgagacagccgatagggaacttctaccgacttttcatcacgtctctgtatatccaaaaaaagaactccccctctttattcactttaccgccggtttttgttcttcaaccgctatgatagctattctgacccaccagtttcccgagatcatgggtatatttgccaaggccgtgcttgggctgtggtgtcctcaaccctgggcatcttcaggcttcgaggagaacacccaagacctcaaatccgaggatctgggactgtcttctggctag

SEQ ID NO: 59987 - DNA, 978 bp, Artificial Sequence
  Description of Artificial Sequence: Synthetic coding sequence
atgggcggaacagaaagctccattagtgagcctggatcacccagtcggaatagagagaacgaaacatcccgacagaatttaagcgaatgtaaagtttggcggaaccctcttaatttattcaggggagctgagtataggcgctatacctgggtgactgggaaggagcccctgacttattatgacatgaatctgtccgcacaggaccaccagacattcttcacctgcgacaccgattttttacgcccaagcgacaccgtcatgcagaaggcctggagagaacgcaatcccccagcaagaatcaaggccgcatatcaggcattggaactcaataacgactgtgctaccgcttacgttctgttggcagaagaagaagccactacaatcgtggacgccgaacgactgttcaaacaggctctaaaagctggagagaccatctaccgccagagtcagcagtgccagcatcagtcaccacagcatgaggctcaattaagaagggataccaacgtcctagtctacattaagcggagactggctatgtgtgccagaaaactcggcaggattcgggaagccgtaaagatcatgagggattacctgctcgagatgaagagcctgatcctgccccctgagcatattctgaagcgcggagattccgaggctatagcctatgcttttttccacctccagcactggaaacgcattgagggcgcacttaacttactgcagtgcacatgggaaggcacgttccaccacgtgagtgtctaccctaaaaaagaactgcctctgttcatccactttaccgcaggattctgctcaagtactgcaatgattgcgattctgacacatcaatttcccgagatcatgggtatctttgcaaaggctgtcctgggtttatggtgccctcagccttgggcaagcagtggcttcgaggagaacacacaagatttaaagtctgaagacctcggactgtcttcaggatag

SEQ ID NO: 59988 - DNA, 864 bp, Artificial Sequence
  Description of Artificial Sequence: Synthetic coding sequence
tgaatttctgagcctggttccccgagccggaaccgggaaaacgagacatctcgccagaatctgtcagaatgtaaagtatggcgaaacccactgaacttgttccgcggtgcagagtatcggagatatacttgggtgacaggcaaagaaccactgacctactacgacatgaatctgtccgcacaggaccaccagacctttttcacctgtgatactgatttcctgagaccatcagacactgtgatgcagaaagcctggagagaaagaaatcccccagcacgaatcaaagctgcataccaggcactggagctgaataatgactgcgctaccgcttatgtgctcttggccgaagaggaagcaacaaccatcgtcgatgctgagaggctcttcaaacaagctctgaaggccggtgagaccatataccggcaaagccagcagtgccaacatcagagcccgcagcacgaggctcagttgcgccgtgacacaaacgttctggtgtacatcaaacggaggctggctatgtgtgcacggaagctgggcagaattcgtgaggctgttaagatcatgcgagattatctgttggagatgaagtctcttattctaccgcctgaacatattttgaaacgtggcgacagtgaggctatagcgtacgccttcttccacttacaacattggaagcgcatcgaaggtgccctgaacctgctccagtgcacctgggagggaacctttcaccacgtatcagtctacccaaagaaggagctgcctttatttattcatttcaccgccggtttctgctcatcaacagccatgattgccatcctaacccaccagttccccgaaatcatggggatcttcgccaaggcctag

SEQ ID NO: 59989 - DNA, 1677 bp, Artificial Sequence
  Description of Artificial Sequence: Synthetic coding sequence
atggccgacagaggcggagtgggagaggccgctgccgtcggtgctagtcccgcatcagtgccgggactgaacccaacacttggctggcgggagcgccttagagcaggactggcaggtacaggggcttcgctgtggtttgtggctggcttagggcttttatacgcccttcgcattccactacgtctctgtgagaatctcgcagcaggaaccagtagcctgattagcgggctgatctttatattcgagtggtggtattttcacaagcatggtaccagtttcattgagcaggtcagtgtctctcatctgcagccactgatgggcggaaccgagtcatctatttcagaacccggtagcccatctaggaatcgagaaaatgaaacatctcgtcaaaacttgtccgaatgtaaggtgtggcgcaaccctctgaacctcttccgaggcgctgaataccggagatatacttgggttactggcaaagagcccttgacttactatgatatgaatttgtctgcccaggaccatcagacatttttcacttgtgacaccgattttctcagacccagtgataccgtgatgcagaaggcctggcgcgagcggaatccacctgctaggatcaaggccgcataccaagccctcgagctaaacaacgactgcgctaccgcgtatgtcctgctggccgaggaagaggccaccacaattgtggacgctgaaaggttgttcaaacaagcactgaaggcaggagaaacaatatatcggcagtcccagcagtgccaacatcagagtccacagcatgaagctcaacttaggcgtgacacgaacgttctggtatatatcaagcggagactcgccatgtgcgctcgtaagctggggagaattcgggaggccgtcaagataatgcgggatctgatgaaggagttccctccactgaccatgctgaatattcacgaaaacctgctcgaatctcttcttgagctgcaggcctaccctgatgtccaggcagtgttagctaaatatgatgacatatcactgcctaaatctgcggctatatgttacaccgctgctctcctgaaaacacgcacagtgagtgagaaattcagccctgaaaccgcctcccggaggggactctctactgccgagattaatgcagtggaggcaatccaccgcgctgttgaatttaatccgcacgtaccaaagtatctgcttgagatgaagtctttgatattgccccctgagcacatcctcaaacgtggcgattccgaggccatagcttacgcctttttccatctccagcactggaaacgtatcgagggggcactcaacctgttgcaatgtacctgggaaggaactttccgaatgattccgtaccctctggaaaaaggccacttattttatccttatccatcatgcacagagactgctgaccgggaattgcttcctaccttccatcatgtcagcgtttaccccaagaaagaactcccgctcttcatccatttcacggccggattttgttcctcaacagccatgatagcaatcttgacgcaccaattccctgaaatcatgggaatatttgccaaagccgttctgggactgtggtgcccgcagccgtgggcctcctcaggttttgaggagaatactcaggatctcaagagcgaggatctgggcctgtctagcggctag

SEQ ID NO: 59990 - DNA, 1500 bp, Artificial Sequence
  Description of Artificial Sequence: Synthetic coding sequence
atgtctccattcttgttccgtgacgatatgaaagatctgacagtcttcctcaattcccttacacctaaattctacgtggcattaacgggcaccagttccctgatttctggactcatttttatttttgagtggtggtactttcataaacacgggacgtcttttatagagcaagtgtcagtgagccacctccaacccttgatgggcggaaccgagagctctatcagtgagccagggtcccccagtcggaaccgagagaatgagacgtcacgccaaaatctgagtgaatgcaaggtatggcggaaccccctgaacctctttaggggggctgagtatcgtcggtacacctgggtgaccgggaaggagccactgacctactacgatatgaacctcagtgctcaggaccatcagacttttttcacttgtgatacagacttccttagaccaagcgacacagtcatgcagaaagcctggagagaaaggaacccgccagccagaattaaggctgcctaccaggctcttgagttgaataatgactgtgccaccgcttacgtgctactcgcagaggaggaggctaccaccattgtggacgccgaaagactgtttaagcaggcactcaaagctggggagaccatttacagacagtctcagcagtgtcaacaccaaagcccacagcacgaagcacagcttcgacgcgacactaacgtattagtttatattaaaagaagactagcaatgtgcgccagaaagctggggaggatccgtgaagcggtgaagatcatgcgcgacctcatgaaggagttccctccactgaccatgcttaatatccacgaaaatcttctggagtccctcctcgagctgcaggcctacccagacgtgcaggccgtgctagccaaatatgatgacatttctctgccaaagtccgcggctatttgctatacagcagccctgctgaagactaggaccgtctccgagaagttttcgcccgaaacggctagcagacgtggcctcagcaccgcagaaattaacgctgtggaagcaattcacagagccgtggagttcaacccccatgtgcccaaatatctgctggagatgaagtctctgattttgccacccgaacatatcttaaagcgcggagattccgaagctatagcatacgccttttttcacctgcagcattggaagaggatcgagggagccctcaatctactgcaatgcacctgggagggaacatttagaatgattccataccctctggaaaagggccatcttttctatccttatccaagctgcacggaaacggccgaccgggagctactccccacgttccaccacgtatcagtctatcccaagaaagagttacctttgttcatccacttcaccgccggattctgttcaagtactgctatgatcgcgatcctaacgcaccagtttccagaaatcatgggaatctttgcaaaagcggtgtccatgatctccagaacttgcgtggattatctttag

SEQ ID NO: 59991 - DNA, 1206 bp, Artificial Sequence
  Description of Artificial Sequence: Synthetic coding sequence
atggctgaccgaggaggagttggtgaagccgctgcagttggtgcttctcccgcaagcgtcccaggcctgaatcctactttgggttggcgcgagcggttacgcgcaggcctggccggtaccggagctagcctgtggtttgtggctgggctcggtctattatatgccctccgaatccccttgcggttgtgcgaaaacctggccgcaggcacaagcagtctgatttccggacttattttcattttcgaatggtggtatttccacaagcatggaaccagtttcattgaacaggtgtccgttagccatctccagcccctcatggggggaaccgaaagctctattagcgaacctggatcaccaagccgtaaccgtgagaacgaaacatctcgacagaacctgtccgagtgtaaggtgtggcgcaatcctctcaatcttttcaggggggcagagtaccgacgttacacctgggtaacaggaaaggagccgttaacctattatgacatgaatctgtctgcccaggatcatcagaccttttttacttgtgatactgactttttaagacctagcgacacagtaatgcagaaagcttggcgggaacggaatccccctgcccgaatcaaggctgcctatcaagccctcgagctgaataacgactgtgctacagcttacgttctcctggccgaggaagaagccacgactattgttgacgctgaacggctctttaaacaggcacttaaggccggagaaaccatctacagacagagccagcagtgtcagcatcagtccccgcagcatgaggcccagttgaggagggacaccaatgtcctagtatacatcaaacgccgtctggcaatgtgcgctcgtaagctgggacggatcagggaggcggtgaagatcatgagggatctaatgaaagagttcccgcctctcacaatgctgaatattcatgaaaacctgttggaatcactgctggagttgcaggcctacccagatgtgcaagccgtgctggccaaatatgacgacatatccctcccaaaaagcgccgcaatttgctatactgcggctctactcaagaccaggacagtgagtgagaaattctcccccgagacagcctctcgccgtggactgagtaccgccgaaattaatgccgtggaggctatccacagagccgtcgaattcaatccccacgtccctaagctgctcgaatag

SEQ ID NO: 59992 - DNA, 1533 bp, Artificial Sequence
  Description of Artificial Sequence: Synthetic coding sequence
atggccgaccgtggaggcgtcggcgaagccgctgccgtgggagctagtcccgcttcagtgcctgggctgaatcctactcttggatggcgggagaggctgcgagcgggtctggccggtacgggtgcctccttgtggttcgtggccggattaggtttattgtacgcactacgcatcccactgcgtctctgcgagaaccttgccgcagtcacggtttttctgaatagtctgactcctaagttctacgtggcgctgaccgggacttcgagccttatatccggcctgatctttatctttgagtggtggtattttcacaagcatgggacatcttttatcgagcaggtatccgtgagccacttacagcccttgatgggcggtacagagtcgagcataagcgaaccaggatctccatcccggaatcgtgagaatgaaacgtctcgtcagaacctgtccgagtgtaaagtttggaggaaccctttgaacttattcagaggcgcagagtacaggagctgtgcaacggcttatgtgcttttagctgaggaagaagccactactatcgtggatgcggaacggcttttcaagcaagccctgaaggccggagaaactatctaccgccagtcccagcagtgccagcaccagtcaccccaacacgaggctcagttaaggcgggacactaatgtcctggtctacataaaaagacgcttggcaatgtgcgctagaaagttgggccgaattagagaggccgtgaagatcatgcgggacctgatgaaagagttcccacctctcacaatgctcaatatccacgagaatctgctagaatccctcttggagctgcaggcctaccccgatgtgcaagccgttctcgctaaatatgacgacatttccctgcccaaatccgctgcaatttgctatactgcagcactccttaaaacccgaactgtgtccgagaagttctctccggagaccgctagtaggagaggactcagtaccgccgagattaatgcagtcgaagccatccatcgggcagtggagttcaacccccacgtccccaagtacctgctggaaatgaaatctcttatcctccctcctgaacatattcttaaacgcggagattccgaggcaatagcgtacgcttttttccacctgcagcactggaagagaattgagggggctcttaatctgcttcagtgcacatgggaaggaacattcaggatgataccgtatccattagaaaaagggcatctgttttatccgtatcctagctgtaccgagacagccgacagagagttgctccccactttccaccatgtttccgtataccccaagaaagaactgcccctgttcatacactttactgcaggattctgctcaagcacagccatgatcgccatattgactcaccagttccccgagattatgggtatctttgcgaaagctgtgctgggactctggtgcccgcagccttgggccagttcggggttcgaggagaatacacaggatctgaagtctgaggatctaggactctccagtggatag

SEQ ID NO: 59993 - DNA, 444 bp, Artificial Sequence
  Description of Artificial Sequence: Synthetic coding sequence
atggggtcccagggcagcggtggagtccccctggtccaggcaccttataccgtgctcctgcttcctctgggaacaagccggcaggaccctggagctcagtccttctttctttggctccggaggatgcaggcgttggagcgcgaacaggacgctctctggcaagggttggagcttctgcagcacggtcaggcttggtttgaggatcatctgagagaggctcagcgacagcagctgcacctcggggctttaggggaaaatttcctcaccgacctccactctgaacccggaagacctccactggcacagatccagaaggtgaacatctgtctacagaaccttatacacgagaaactgagcaggcaacagaagggggtgactcagccaaaagaagaaatggcccagcggggatgtaccaagggcccaagaggacctacgcgggtgtag

SEQ ID NO: 59994 - DNA, 537 bp, Artificial Sequence
  Description of Artificial Sequence: Synthetic coding sequence
atgggctcacagggcagtggcggagtcccgcttgtacaggctccgtataccgtactcttactgccattgggaactagccgccaggacccaggcgctcagtcattcttcttgtggttgagacggatgcaggcgctggagcgggagcaggatgctctctggcaaggccttgagctcctgcagcatgggcaggcatggttcgaagatcatttgcgggaagctcagcgacagcagcttcacctcggcgctctgggcgaaaacttcttgacggacctgcattctgaaccaggaaggccgccactggcccaaatccaaaaggtcaatatttgtctgcaaaatttgattcacgagaaattttcacctagtccactcaacaaggctagcagctgtaccacccaggactccaaggaaaggcgaagggagcaaaacctgtggcaacaacaggagctaagtcgccagcagaaaggcgttactcaacccaaggaggagatggcacagaggggttgtaccaaggggcctcgcggtcccactcgagtatag

SEQ ID NO: 59995 - DNA, 444 bp, Artificial Sequence
  Description of Artificial Sequence: Synthetic coding sequence
atgggctcacagggttcgggaggcgtccccctggttcaagccccttacacagtcctcctcctgcctctggggacttcaagacaggaccctggcgcacagtcttttttcctttggctcaggaggatgcaggctctggagcgagagcaagacgctttatggcagggactggagcttctgcagcacggtcaggcttggttcgaggaccacctgcgggaggcacaaaggcagcagctccacctcggggcactgggggagaacttcctgactgatctccattctgagccagggagaccccctctagctcaaatacaaaaggtgaatatttgcctgcagaacctgattcacgaaaaactttccaggcagcagaaaggggtcacgcagcccaaagaggaaatggcacagcgagggtgtacaaagggccctcgcggacccactcgggtttag

SEQ ID NO: 59996 - DNA, 447 bp, Artificial Sequence
  Description of Artificial Sequence: Synthetic coding sequence
atgggctcacaggggtccggaggtgtgccgctggtccaggcgccttacactgtcctcctcctgccattaggaacctcaaggcaggatcccggtgcgcagagcttcttcctctggctgcgccgtatgcaagcactggaaagggaacaggacgccctgtggcagggacttgagcttttgcagcacggacaagcctggtttgaggatcatctgcgagaagcccagagacaacagttgcatctcggagccttgggagagaacttcctgaccgacctgcacagcgagcccggacggcctccactagcacagattcagaaggtaaatatatgcttacagaatctcattcacgagaaggagctgagtcgccagcagaaaggggtcacacagccgaaagaggagatggctcaaagaggctgcacaaagggccctcgcggacccacccgggtctag

SEQ ID NO: 59997 - DNA, 444 bp, Artificial Sequence
  Description of Artificial Sequence: Synthetic coding sequence
atgggtagccaggggtccggcggtgtcccgctggtgcaggcaccgtatacggtgctcctcctcccactcggaacctcaagacaggatcccggagctcagtccttctttttgtggcttagacgaatgcaagcccttgaacgcgaacaggatgcgctctggcaaggcttggaactcctgcaacacggccaggcctggtttgaggaccacttaagagaggcccagcgccaacagctccatcttggcgctctgggcgaaaactttctaactgacctgcattcggagcccggaagaccacccttagctcagattcagaaggttaatatctgcctccagaacttgattcacgaaaaattgtcccgacagcaaaaaggggtgacacagcccaaagaggaaatggcccagcgagggtgtacgaaaggacccagggggcctacccgggtgtag

SEQ ID NO: 59998 - DNA, 444 bp, Artificial Sequence
  Description of Artificial Sequence: Synthetic coding sequence
atgggcagtcaggggtctgggggtgtgccattggtgcaagcaccctacaccgtgctgctgctgcccctgggaacctctagacaggaccccggagcccagtcattttttctgtggcttcgcagaatgcaagctttagaaagagaacaggatgccctttggcaaggcttagagctgctgcagcatgggcaggcctggtttgaggaccacttgagggaagcgcagagacaacagctgcacctcggtgctctgggcgagaattttttgaccgatttacatagcgaacctggacgccctcctctggcacagatacagaaagttaacatctgcttacagaacctgatacacgaaaagctgagccgtcagcagaaaggcgtcacccagccaaaagaggaaatggctcagcgcggttgtactaagggaccaagggggcctacacgggtttag

SEQ ID NO: 59999 - DNA, 444 bp, Artificial Sequence
  Description of Artificial Sequence: Synthetic coding sequence
atgggatcacagggatctggaggagttcctctggtgcaagccccatatacagtgcttctgttacctttgggtactagccgtcaagaccccggagctcaatctttctttctttggcttaggcggatgcaggccctggagcgggagcaggatgcactctggcaggggctcgagttgttacaacatggacaggcttggttcgaggatcatctgcgcgaggcccagaggcagcagctgcatttgggggctctgggtgaaaacttcttaacggatctccactctgagcccggaagacctcctctggcccagattcaaaaggtcaatatctgtcttcagaacctgatccatgaaaaactctcacgccagcaaaagggggtgacacaaccgaaagaagagatggcccagcgcggatgcaccaaaggcccacgcggaccaacaagggtgtag

SEQ ID NO: 60000 - DNA, 537 bp, Artificial Sequence
  Description of Artificial Sequence: Synthetic coding sequence
atggggtcacaaggctcaggcggtgttcccctcgtgcaagctccctacactgttttgttgctcccattgggaacctcccgtcaggatccaggcgcacaaagtttcttcctgtggctgagacggatgcaggctttggaaagagagcaagacgcactctggcagggtctcgagctgctgcagcacggccaagcttggttcgaagatcacttgcgcgaggcccaacgccaacagctgcacctgggcgcactgggcgagaactttttgaccgacttgcactcagagccaggccgtcctccgctcgcacagattcaaaaagttaatatctgtctgcagaacctcatccatgagaagttttctccttctcctttaaacaaggcctccagttgtaccactcaggattctaaggaaagaagaagggaacagaacctttggcagcagcaggagttgtccagacagcagaagggcgtgactcagccaaaggaagagatggcccaacgcggatgcaccaagggacccagaggaccgactcgggtgtag

SEQ ID NO: 60001 - DNA, 537 bp, Artificial Sequence
  Description of Artificial Sequence: Synthetic coding sequence
atggggagccaaggcagtggcggagtgcccctggtgcaggcaccatacacggtactcttgctccccctagggacatcaaggcaagatcctggggctcagtccttctttctgtggctacggagaatgcaggcactggaacgagaacaggatgccctgtggcagggcctggagttactgcagcatggacaggcctggttcgaggaccacctccgcgaagctcaaagacaacaactgcatctaggggcactcggcgaaaatttccttaccgacctgcatagcgagccagggagaccaccgctcgcccagatccaaaaggtgaacatatgtctgcagaatctaattcatgaaaagttcagcccatccccgttaaacaaggcctcttcttgtacaacacaggattcaaaagagcgacgacgggagcaaaacctgtggcagcagcaggagctgtctcgtcaacagaagggagtaacacagccaaaggaggagatggctcagcggggatgcacgaaaggtcctcgcggacccacaagagtgtag

SEQ ID NO: 60002 - DNA, 537 bp, Artificial Sequence
  Description of Artificial Sequence: Synthetic coding sequence
atgggctcccaaggcagcggtggagttcccctggtgcaagcgccatatacagtgctactcctacccctcggtacttccaggcaggacccgggagcacaatccttctttttatggctcagacggatgcaggcgctcgagcgagagcaagatgctttgtggcagggacttgaacttcttcaacatggacaggcgtggttcgaggaccatctgcgggaagcacagcgacagcagctgcaccttggtgcccttggagagaactttttgaccgacttacactcagagcccggtcggccacccttagcgcagatacaaaaggttaacatatgtttacagaacctgatccatgaaaagtttagtccatcgcctctgaataaggcaagtagctgcacgactcaggatagcaaggaacgcaggcgcgagcagaacctctggcaacagcaagagctgtcccgtcagcagaagggggtcacccagcctaaggaggagatggcgcagagggggtgtacgaaaggaccaaggggcccaactagggtctag

SEQ ID NO: 60003 - DNA, 444 bp, Artificial Sequence
  Description of Artificial Sequence: Synthetic coding sequence
atgggttcccagggcagtggcggagtgccgcttgtgcaggccccatatactgtccttctgctacccctcgggaccagtcgtcaagaccccggtgctcaatcattcttcctatggctccgcagaatgcaagccttggaaagagagcaggatgcactctggcaaggcttggagttactccagcacggccaagcatggttcgaagatcatctccgggaagcccagcgtcaacaactgcaccttggggctcttggggagaactttctcactgatctccacagcgaacccggtcgtcccccactagcccagattcaaaaggtgaacatctgcctgcaaaaccttatccatgagaagctgtcacggcagcaaaagggggttacacagcccaaagaagagatggcccagcgcggttgtacaaaaggccctagagggcctactcgcgtttag

SEQ ID NO: 60004 - DNA, 537 bp, Artificial Sequence
  Description of Artificial Sequence: Synthetic coding sequence
atgggctcccaggggagtggaggagtccctttggtgcaagccccatacaccgttttgctactccccctgggcacgtcacgtcaggatcccggtgcccaatccttttttctgtggctacggagaatgcaagcccttgaaagagaacaggacgccctgtggcagggcctggaacttcttcagcacgggcaagcatggttcgaagatcatctgcgggaagctcagcgccagcagctgcacctgggtgctctcggggagaactttttgacggatctgcactccgagcccggtcggcctccgctcgcccaaatccagaaagtgaatatttgcctccagaatctgatccacgagaagttctcccctagtccgctgaacaaggcctcttcgtgcactactcaagacagcaaagagcggagacgcgagcaaaacttatggcagcaacaggaattatctcgccaacagaagggcgtgacgcagcccaaggaagagatggcccagagaggatgtacaaaaggtcctcgaggaccaactcgagtctag

SEQ ID NO: 60005 - DNA, 447 bp, Artificial Sequence
  Description of Artificial Sequence: Synthetic coding sequence
atggggtcccagggctctggaggggttcccctcgtccaggccccttacacggtcttactgctgcccctgggtaccagcagacaggatcccggagcacagtcttttttcctctggctgcgcaggatgcaggccctggaaagggagcaggacgcgttgtggcaagggctggaacttctccagcacgggcaagcttggtttgaggaccacctgagggaggcccagaggcaacaactccatttgggagctctaggagaaaactttctcaccgacctgcactctgagccgggacggcctccactcgctcaaattcaaaaagtaaatatatgtttgcaaaacctgatccacgaaaaggagctgagtagacaacagaagggggtaactcaacctaaagaagagatggcccagaggggctgcaccaagggaccccgaggacccactcgagtgtag

SEQ ID NO: 60006 - DNA, 447 bp, Artificial Sequence
  Description of Artificial Sequence: Synthetic coding sequence
atggggtctcagggaagcggcggagttccattagtgcaggccccatatactgttctgctcttgcctctggggacaagtcggcaggatcctggcgcacagtcattctttttatggctccgccgaatgcaagccctagaacgagagcaggatgcactatggcaggggctcgagctactgcagcacgggcaggcctggtttgaggatcatctgcgcgaggctcaacgtcagcaactgcatctgggcgctctaggggagaactttttgactgatctacattccgaacccggacgccctccccttgcccagatccagaaggtaaacatctgccttcagaacttaatccacgagaaggagctgtctagacagcagaagggtgtaacccagcccaaagaagagatggcacagcgcggatgtactaaggggcctcggggtcccacccgggtttag

SEQ ID NO: 60007 - DNA, 447 bp, Artificial Sequence
  Description of Artificial Sequence: Synthetic coding sequence
atggggagtcagggctccgggggtgtaccactggtgcaagcaccctataccgtcctattgttacccctgggcaccagcaggcaagatcctggtgcccagtctttctttttatggctccggagaatgcaggcactcgaaagagagcaagacgcgctgtggcagggactcgaattattgcagcatggccaggcctggttcgaggatcacttaagagaggcgcaacggcagcaacttcacctgggcgctctcggtgagaattttctgactgacctccacagtgaacccggtcgccctccactggctcagatccagaaggtgaacatctgcctccagaacttaatccatgagaaagaactttcacgtcagcagaagggggtaacacagccaaaagaggagatggcccagcgaggttgtacaaagggccctaggggcccaacacgagtttag

SEQ ID NO: 60008 - DNA, 447 bp, Artificial Sequence
  Description of Artificial Sequence: Synthetic coding sequence
atggggtctcagggctcaggaggcgttccccttgtgcaagccccttacacagtcttattactgccactgggaacttcccggcaggaccctggcgctcaatctttttttctatggcttcgaagaatgcaggccctggagagggagcaagacgcgctctggcaaggcctagaactcctacagcatggccaagcctggttcgaagaccacctccgcgaggcccaacggcagcagctgcatctgggggcactaggtgagaatttcttgacagatttgcactcagaaccgggaaggccgccacttgctcagatccagaaggtcaatatctgcctacagaatttaatacatgaaaaggaactcagtcgtcagcagaaaggcgtgactcagccaaaggaagagatggcacaaaggggttgcactaagggtccgaggggccctaccagagtgtag

SEQ ID NO: 60009 - DNA, 447 bp, Artificial Sequence
  Description of Artificial Sequence: Synthetic coding sequence
atgggctcacagggatctgggggtgtgccactcgtgcaggccccatacacagtactgctgctgccactcggcacctcaaggcaagacccgggagctcaatcattttttctttggctgcgtcgcatgcaagctctcgagcgagaacaagacgccctgtggcaagggctggagctgcttcagcacggccaggcttggtttgaggaccatctgcgcgaggcccagcgtcagcaactgcatttaggcgctttgggtgagaattttctgaccgacttgcattccgaaccagggaggcccccattggcccagatccagaaagtcaatatctgcctgcagaatctaattcatgagaaggaacttagcagacagcagaagggagtcactcaaccgaaggaagagatggcccagagggggtgcaccaaaggacccagagggcctaccagggtgtag

SEQ ID NO: 60010 - DNA, 99 bp, Artificial Sequence
  Description of Artificial Sequence: Synthetic coding sequence
atggctgccgctgctgcgggacctgctgccagtcagaggtttttccaaagcttcagcgatgcattaattgaccaggatccccaggctgctcttgaatag

SEQ ID NO: 60011 - DNA, 99 bp, Artificial Sequence
  Description of Artificial Sequence: Synthetic coding sequence
atggccgctgccgcagcaggccctgctgctagccagcgcttcttccagagcttcagtgacgcccttatagaccaggaccctcaggccgctctggagtag

SEQ ID NO: 60012 - DNA, 4986 bp, Artificial Sequence
  Description of Artificial Sequence: Synthetic coding sequence
atggaggcacccgcagccgagcccccagtcagaggttgcggtccccagccagcgccagctccagcacccgctcccgagcgaaaaaaaagtcaccgcgctccctcacccgctaggccaaaagatgtggccggatggtccttagcgaagggcaggcggggacctggtcctggctcagccgtagcttgctcggccgctttctccagccgacctgacaaaaaaggtagggcagtggccccaggcgcaagaggagcgggtgtgagagtggctggggttcggaccggggttcgagccaaagggaggcccagaagtggagcaggtccgagaccgcctcccccaccaccctctttaacagatagctcaagcgaagtgtctgactgtgcctcagaagaggcaaggctccttggcctcgagcttgcactgtcatcggacgccgaatccgctgcaggcggaccagcgggtgtcagaactggtcagcccgctcagccggctccctccgctcagcaacctcctcggccacctgcctctccagatgaacctagcgtcgctgccagtagcgttggttcctcccgtctgcctctgagcgcatccctcgctttctctgatttgactgaggagatgctcgattgcgggccaagcggacttgtcagagaactggaggaactccgatccgagaacgactacctgaaagatgagattgaggagttacgggcagaaatgctggaaatgcgagatgtgtatatggaagaggatgtttatcagctccaagagctccgacaacagcttgatcaggcctcaaaaacctgccggattttacagtacagactgaggaaggctgagaggcggtcccttagagcagctcagacaggccaggtggatggggaactcattaggggtctggaacaggacgtaaaggtcagcaaggacatatccatgcggctgcataaagagcttgaggttgtggagaagaaaagggctcgactggaggaggaaaacgaagagctgagacagagactgatcgaaacagaactggcgaagcaagtgctgcagacggagttggaacgcccaagagaacactcgttgaagaaacgtggcactcgctcactgggaaaggctgacaaaaaaacactggtgcaggaggacagcgctgatctgaaatgccagctgcattttgccaaagaagagagcgctttgatgtgtaaaaagctgacaaagctggccaaggagaatgatagtatgaaggaagagttgctcaagtacaggtccctgtacggagacctggacagtgccctttccgcagaggagctggcagacgcaccccactccagggaaaccgagctgaaggtgcacctgaagctcgttgaagaggaggcaaaccttctgagtaggcgtattgttgagcttgaagtggaaaatcgcggactccgggcagagatggatgacatgaaagaccatggcggtggctgtggcggacctgaggctcggctggcattctccgctctgggagggggagagtgtggagaaagtctcgctgagctgaggcggcatctgcagttcgtggaggaagaggccgaactgcttcgtaggtcctcggccgagctagaagaccagaataagttgttgctaaatgaactcgccaaatttagatcagagcacgaacttgacgttgctctatccgaggactcctgctctgttctcagcgagcctagccaggaggagctcgcagcagccaaactgcagatcggggaactctctgggaaggtgaagaaactacaatacgagaaccgggtgctcttgagcaacctgcagcggtgcgatttggctagttgccagagcacaaggccgatgctagaaactgatgcagaagccggagattccgcacagtgtgtgcccgctcctctaggcgaaactcacgagtctcacgcagtgcggctttgccgtgcccgtgaggcagaagttcttccaggactgagggaacaagccgctctcgtgtccaaggccatcgacgtgctggttgccgacgctaacgggttcactgccggtcttagactctgtctggacaatgagtgtgccgattttcgactgcacgaggcccctgacaacagcgagggacccagggacacgaagctaatccatgcaatcctggtcagactgagtgtgttgcagcaggaacttaacgcctttacgcggaaagcagatgccgtactggggtgttcagtgaaggaacaacaggagagtttcagctcactgccacctctgggatctcagggcctgagcaaagagatcctccttgccaaggacctcggctcagattttcaaccccctgacttccgggacctgccagagtgggagcctcggattcgcgaagcctttagaacaggtgatctggacagcaagcctgatccatcccgttccttccgaccctatcgtgcggaggacaatgactcatatgcatctgagatcaaggagttacagctcgtgttagcagaagcacacgactctctgaggggcctccaggagcagctgagccaggagcgccagttgagaaaagaggaagctgacaattttaaccaaaagatggtacagttgaaggaagaccagcagagggccctgttgcgtcgggaatttgagctgcagtccctctctctccaacgaagactggaacagaagttctggagccaggaaaagaatatgcttgtccaagagagccaacagtttaagcacaactttttgctgctctttatgaagttgcgctggtttcttaaacggtggcgtcagggaaaggtactcccttcagaaggagacgattttctcgaggtcaactcgatgaaggaactgtacctcttgatggaagaagaggagatcaacgcccagcattcagacaataaggcttgcacgggcgacagctggacacaaaatacccccaacgagtacataaagactctggcggacatgaaagtgactctaaaggagttatgttggttgttgcgggatgaacgcagggggctgactgagttgcagcagcaatttgcaaaggcgaaagcaacctgggagactgaaagggcagagctcaaggggcacacatcccagatggaactaaaaaccggcaaaggcgctggcgaacgggctggcccagactggaaagcagccctccagcgagaaagagaggagcagcagcatcttttggctgagagctattcggctgtgatggaacttaccaggcagttacagattagcgaaagaaattggtcacaggagaaactacagctagtggagcgcctccagggcgagaaacaacaggtggaacaacaggttaaggaactgcagaatagactttcccagcttcagaaagcagccgatccctgggtgttaaagcactccgaactcgagaagcaggataacagttggaaggaaactcggtccgaaaagatccacgacaaggaggctgtctcagaagtggaactgggagggaatgggctgaaacgtactaaatccgtgtcttctatgtctgaattcgaaagcctcctagattgctccccatatctggctggtggggacgctcgcggaaaaaaactccccaacaatcctgcattcggtttcgtttcatccgagccgggtgatccagaaaaggataccaaagaaaaaccgggtctcagctcccgcgactgtaatcatctcggcgctctggcctgccaggaccccccaggacgccagatgcagcggtcttatacagcccctgacaagacaggcatccgggtgtattacagcccccctgtagctcggagacttggcgtccccgtggtgcatgacaaagaaggcaaaattataatcgaacctggttttctcttcaccacagcaaagccaaaagaatctgccgaggctgacgggctggccgagtctagttacggtcggtggctttgcaattttagcagacaaaggttggacggcggttcagcagggtctccatctgccgcaggccctggttttcctgccgcactgcatgactttgaaatgtcagggaacatgtccgacgacatgaaggaaataacgaactgtgtgcgacaagccatgcgtagcggctccttagagaggaaggtaaagagtacatctagccaaacagtcggactggcatctgtcggtacacagacaattcggacagtcagtgtcggactccaaaccgatccgccaaggtctagtttgcacggtaaggcgtggtctcctcgtagctcttctctagtgtccgttcgaagcaagcaaatctcttcttctttagacaaggtgcacagtcgtatcgaaaggccctgctgctccccaaaatacgggagccccaaactgcagcgacggtccgtgtccaaattggactcctcaaaagataggtccctgtggaaccttcatcaagggaagcaaaacggttcagcttgggcccgatctacaacaactagagacagcccagtgctcaggaacattaacgacggcctgtcgagcttgttttcagtagtcgagcactcgggatctaccgagtctgtctggaagcttggcatgtctgagacccgcgcaaagcctgagccaccaaagtacggcatcgtacaggaatttttcaggaatgtgtgcggcagggctcctagccccacatccagcgccggtgaggaggggaccaagaagccggaacctctgtcaccagccagttaccaccagcccgagggcgttgctagaatcttaaacaagaaggcggcaaaattggggagctcggaggaagtaagacttaccatgctcccccaggtggggaaagatggagtgctacgggatggagatggcgcagtggttctgccaaatgaggatgcagtctgcgattgttcgacacagtcattaacctcctgctttgcacggtcctctcgtagtgccatacgacactctccctcgaagtgcaggctgcaccccagcgaaagcagctggggcggtgaagagagagctctgcctcccagcgagtaa

SEQ ID NO: 60013 - DNA, 3051 bp, Artificial Sequence
  Description of Artificial Sequence: Synthetic coding sequence
atgctagagatgagagacgtgtatatggaggaggacgtgtaccagttacaagagttgaggcagcagcttgaccaagcaagcaagacatgtagaatccttcagtacagactgaggaaggctgaacggagatcactgcgtgcagcacagactggtcaggtggacggcgagctcattcgcggactggagcaggacgtaaaggtgtcaaaggacatcagtatgcggcttcacaaggagctggaagtagtggaaaaaaagagggcccgtctggaggaggagaacgaggagctcagacaaagactgatcgagactgaactcgctaagcaggtactccagacagaactggaacggccaagggaacattcccttaaaaagaggggcactaggagtctgggtaaggccgacaaaaaaactctggtgcaggaggacagcgccgatttgaagtgccagctgcacttcgccaaggaggaaagcgccttaatgtgtaagaagctgacgaaactagctaaagaaaacgactcgatgaaagaagagctgctgaaataccggagcctgtatggagacctggacagcgccctaagtgccgaggaactcgctgatgctccacactccagagaaaccgaattgaaggttcacctgaagctggtggaggaggaagctaacctgcttagtaggaggatcgttgagttagaggtggaaaacaggggtctgcgggctgaaatggacgacatgaaggatcacggagggggttgcggaggacctgaggcacggttggcgttctcagccttggggggaggggagtgcggcgagagcctcgccgagctgcggagacacctccagttcgtagaggaggaagctgagcttcttaggagaagctccgcggagttggaggatcagaataagttgcttctgaacgaattggccaagttcaggagtgaacacgagctggacgttgctctttcggaagatagttgctctgttttatccgagccttcccaggaggaactggccgctgctaaattgcagataggagaacttagcggaaaagtgaagaagttgcagtatgaaaaccgagtgctgctgtcaaacctgcagcggtgtgatctggcatcgtgtcagagcactaggccgatgcttgagaccgatgcagaggcaggcgacagcgcgcaatgtgttccagctcccctgggtgaaactcacgagtcccatgccgtgcggctatgtcgagccagagaagccgaagtgctcccaggccttcgggagcaggctgcattggttagtaaggctatcgatgtactggtggccgacgcaaacgggtttactgcagggctgagactgtgtctcgacaatgaatgtgccgactttcggttgcacgaagcccctgataattctgagggacccagagacactaagctcattcacgccatcctggtgcgcctcagtgtcttacagcaggagctaaacgcatttacaagaaaagccgacgccgtccttgggtgcagtgtaaaagaacagcaggagagttttagtagtcttcctcctctcggctcgcagggactttccaaagagatcttacttgctaaagaccttggatccgatttccagccccctgatttccgcgacctgcccgaatgggaaccaaggattcgggaggccttcagaaccggcgatctggactcaaagccggacccatcaaggtccttccgcccatatagggccgaagacaacgatagctatgcatcagaaataaaggaattacagctagtgcttgccgaagcccacgacagcttacggggactgcaggaacagctttcccaagagcggcaactcagaaaagaagaagctgataattttaatcagaagatggtacagcttaaggaggatcagcaacgggctctgttgaggagagagttcgagcttcagagtcttagtctccagcgtagactggaacagaagttctggagccaggagaaaaatatgctggtacaggaatcccagcaatttaagcacaatttcttattgctgttcatgaaactgcggtggttcctgaagcgctggaggcagggcaaagtgcttccttccgaaggtgacgacttcctcgaagtaaactctatgaaggaactgtatctgttgatggaagaagaggaaattaatgcccagcattcagataataaggcctgtactggtgactcatggacccagaacacacccaatgaatatatcaaaacactcgccgacatgaaagtgacgctcaaggagctgtgttggctcctgcgagacgagagacgcggacttaccgagcttcaacagcagtttgctaaggccaaggccacctgggaaaccgagagagctgagctgaagggacacaccagtcagatggagctgaagactgggaagggagccggtgaacgggcagggcctgactggaaggccgctcttcaacgtgagagggaggagcagcagcacttactggccgagagctactctgctgttatggagctgacacggcaattgcagatctccgagaggaattggagccaagagaagttgcagttggtcgagagactgcagggcgaaaagcagcaggtagagcagcaggttaaggaattgcagaacagactcagccagctgcagaaggcagcagacccctgggtgctcaaacactctgaactggaaaagcaagataacagctggaaagagacacgcagcgagaagattcacgacaaagaggcagtctccgaggtggaattgggaggcaatggtctgaagaggacaaaaagtgtcagtagcatgagcgaatttgagagcttgttggattgttcaccttacctggcaggaggagacgccaggggtaagaagctgcctaataaccctgcgttcgggttcgtctcatccgagcctggcgatccggagaaagatacaaaggaaaaacctggcctgagtagcagggattgtaaccatcttggtgccctggcctgccaagatcccccagggtcccaaaagcttccttttctcctgatcctggcgccaccgcaacccccacctatactctag

SEQ ID NO: 60014 - DNA, 4272 bp, Artificial Sequence
  Description of Artificial Sequence: Synthetic coding sequence
atgcttgagatgagagatgtctacatggaggaggacgtctatcaactgcaggagctgcgacaacaactcgaccaggcatcaaaaacctgccgaattttgcagtatcgattgaggaaagcggaacggagatcgcttagagccgcacagacaggacaggtggacggggagcttataagaggattggagcaggacgtcaaagtcagcaaagacatctccatgcgactacacaaggaactggaagtggtggagaagaagcgtgccaggctagaggaagaaaacgaggaactccgccaacggctgatcgagacagaactagcaaagcaagttttgcaaacagagctggaacggcctcgggagcactccctgaagaagcggggaacccggtccctgggtaaggcagacaaaaaaactttagtgcaagaagacagtgccgatctcaaatgtcagctgcactttgccaaggaggagagtgcgctcatgtgtaaaaagctgacaaagctggctaaagaaaacgactcaatgaaggaggagttgctgaaatacagaagtttgtatggggacctcgatagcgctctctccgccgaggaacttgcagatgctcctcacagcagagaaactgagcttaaggtgcatctgaaattggttgaggaggaggcaaacctgctctctaggcgtatagtggagctggaagtggaaaataggggcctgcgagctgaaatggatgatatgaaggatcacggagggggatgtggcggacccgaagcaaggctggccttctccgcgctcggtggcggtgaatgtggagaaagtctggcagagctacggcgtcatctccagttcgttgaagaggaggcagaactgcttcgacgctccagcgctgagctagaagaccagaataagctgcttctcaacgaactcgccaagtttcggagcgagcacgagctcgacgtggcactgtcagaggactcctgttccgtgctgtccgaacctagccaggaagaactcgcggcagccaaattacagattggcgagctgagtgggaaagttaagaaactacaatatgagaatcgtgttttactaagtaaccttcagcggtgtgatttggcatcgtgccagagcaccaggccaatgctggaaacggatgctgaggcaggtgattcagcccagtgtgtacctgctcctctcggcgagacacacgagtcacacgcggtgcgcctatgccgggctagggaggcagaggtgctgcccggtctgcgggagcaggccgctttggtctccaaggccatcgacgttttggtagctgatgccaacgggtttacggccggactccgcttgtgcctcgataacgagtgcgccgacttcaggctgcacgaggcacccgacaattctgagggccctagagataccaagctgatccacgccattcttgtgcggctaagcgtgctccagcaggagcttaatgccttcactcgcaaagctgacgccgtactggggtgtagcgtgaaggaacagcaggaatccttcagtagtcttcctccactcggctcccagggcttgagtaaagaaatcctgctggctaaggatctcggatctgacttccagccccctgacttccgggacctgccagaatgggaacctcgcatacgcgaggcttttcgaacgggcgacctggattctaagcccgatccctcgaggagcttccgtccctacagggctgaggacaacgattcttacgcctccgaaattaaagagttgcagctggttctggccgaggcccatgactcgttgagaggacttcaagagcaactatcacaggagcgccagttgagaaaggaggaagctgacaattttaaccagaagatggtccagctgaaggaagaccagcagagagcacttctgcggagggaattcgagcttcaatccttaagcctgcagcgtcggttagaacagaagttttggtcgcaggagaaaaacatgcttgtccaggagtcccaacagttcaagcataacttcttgctgctctttatgaaattgcgctggtttctcaagcgatggaggcagggtaaggtcctaccaagtgagggagatgacttcttggaggtcaattccatgaaggaactctatcttctaatggaagaggaagaaattaacgcccaacacagcgacaataaggcttgtactggtgacagctggacacagaacacacctaatgagtatatcaagactctcgctgatatgaaggtgaccttaaaggagttgtgctggttattgagggacgaaaggagggggctaacagagctccagcagcagtttgcaaaagcaaaggcaacctgggaaacagagagggccgaactcaagggccacacctctcagatggaactgaaaacaggaaaaggcgcaggggagagggccggacccgattggaaggcggctctccagagagaacgagaggagcagcagcacctccttgcggagagctacagcgccgtcatggaattaaccagacagttgcagatttcagaacgcaactggtcacaggagaaactgcagctggtagaaaggctccagggcgagaagcaacaagtggaacagcaggtaaaggagttacagaacaggctgagccagctccagaaggctgcagacccctgggtcctcaagcatagcgaactggagaagcaggataattcctggaaggagaccaggtctgagaaaatacacgataaggaggctgtgtctgaagttgagctgggcggaaatgggcttaaacggaccaaatccgtctccagcatgtctgaatttgaatcactgctagattgttcaccttacttggccggaggagacgcgaggggaaagaagctccccaacaacccagccttcggctttgtctctagcgagcccggagatccagaaaaagatactaaagagaaacccggacttagctctcgcgattgcaatcatctgggagctctggcgtgtcaggacccacccggtagacagatgcaaaggagttacactgctcccgacaagaccggcattcgcgtgtactattcaccgcctgtagccaggaggttgggtgtgcctgttgtccatgataaagaggggaagatcattatcgagcctggcttcctctttaccaccgctaaacctaaagagtctgcggaggccgatggcctcgccgaatcctcctacggaaggtggttgtgtaacttttcccggcaacgattggatggagggagcgctggatccccgtccgctgccggtcccggatttcctgcagctttgcacgactttgagatgtccggaaacatgagcgacgatatgaaggagattactaattgtgtgaggcaggccatgcggtccggtagcctcgagagaaaggttaaatccacgagtagtcaaaccgtgggtctcgctagcgtggggacccagaccatcaggaccgtgagcgttggcctacagacagatccacctcggtcctccctgcacggaaaggcctggtcccccaggagctctagtttagtcagtgtccgaagcaagcagatttcctctagcctggataaagtgcactctagaattgaacggccatgctgcagtcctaaatacggctctcctaaacttcagcggaggagcgtctctaaactggattcttcgaaggaccggagcttatggaaccttcatcagggcaagcagaacggctctgcctgggccaggtccactactacccgagactcccctgtccttaggaacatcaatgatggtttaagttctctcttcagtgtggtggaacactcaggatccacagaatcagtgtggaaactgggcatgtctgaaactagggcgaagcctgaacctccgaagtacggtatagtgcaagaatttttccggaatgtgtgcggacgagccccaagtccaactagcagtgctggggaagagggtactaaaaagccggagccattgtctcccgcaagctatcatcagcccgaaggggtggccaggatcttgaataaaaaggctgctaagttgggaagttcggaggaggtgaggttgactatgctccctcaggtggggaaggacggagttttacgggacggagacggggcagtggtcctgcctaacgaagacgctgtgtgcgactgtagcacccagtctctgacttcctgcttcgctcgatcctcgagatcggctatccggcacagcccatcgaagtgccgcttacatccgagcgagtctagctggggaggggaggagagggctctgccgccaagcgaatag

SEQ ID NO: 60015 - DNA, 3795 bp, Artificial Sequence
  Description of Artificial Sequence: Synthetic coding sequence
atgtgtaagaaactgactaaactggccaaggaaaatgactccatgaaggaagaactgctcaagtatcgctcgctatacggggatctggatagtgcactgtctgccgaggagctcgccgacgcacctcactccagggagactgagttgaaagtacacctcaaactcgtggaagaagaagcaaatctgcttagccgccgtatagtggaactggaagtggaaaaccggggtctccgggcagagatggacgacatgaaagaccacggcggaggttgtggcggaccggaggcacgattggcatttagcgccttgggcggaggcgagtgcggggaaagccttgcagagcttagaagacatctgcagttcgtggaagaggaggccgaattacttaggcgaagctctgcagagctggaggaccaaaacaagctgctgctgaacgaactggcaaaatttcgttcagaacatgaattagacgtggcactgtctgaggacagttgcagtgtgctgtctgaaccaagccaagaggagctggcagccgcaaagctgcagataggcgagctcagcggtaaggtgaagaagctgcaatatgaaaaccgggtgctgctgtctaacctgcaaaggtgtgaccttgctagctgccagtcgacacgaccaatgctcgagaccgatgccgaggccggagacagcgcccaatgcgtgcctgcaccgctcggcgaaacccatgagtcccatgccgtgaggctttgtagagcacgggaggccgaagtccttccaggcctaagggaacaagctgcgctcgtcagtaaggctattgacgttctcgtggcagatgctaacggctttaccgcagggctgaggctttgtctggataacgaatgcgcagactttcgactgcatgaggctcctgacaactctgaaggaccgagagacacaaagctgattcacgctattctcgtccggctctctgtgctgcagcaagaactgaacgcgttcacgcgaaaggcagacgcagtgctaggctgcagcgtaaaagaacaacaggagtcattctcctcactgcctcctctgggttcgcagggcctgtctaaggagattcttctcgcaaaagacttgggttccgacttccagcctcccgattttcgagacctgcccgagtgggagcctcggattagggaagccttccgcaccggcgacctagacagtaaacctgacccaagtcgttcatttcgcccataccgcgctgaggataacgatagctatgccagtgaaattaaggagctgcagctggttctggcggaagctcatgacagtcttcggggactgcaagagcaactttctcaagagagacaactccgaaaggaagaagctgataacttcaaccagaagatggtgcagttgaaggaggatcagcaacgggcactgttgaggagagaatttgaactgcaaagtctgtcgctgcaaagaagactagagcagaagttttggtcccaggagaagaatatgctggtacaggagtcacagcagttcaagcacaactttctgcttctgttcatgaaactgaggtggtttctgaagaggtggagacagggtaaggtcttgccaagtgagggagacgacttcctggaagtcaactccatgaaagagctttatctcctgatggaagaagaggagattaacgcccagcactctgataataaagcctgtaccggggacagttggacccagaacactcctaacgaatacattaaaaccttggcggacatgaaggtgactttgaaggagctgtgttggctccttcgggatgagcgaaggggactgaccgaactgcagcaacaattcgcaaaggcgaaagccacatgggagacagagcgtgcagagctgaagggccatacctctcagatggagctgaaaacggggaaaggggctggcgaaagggccggtccagattggaaagccgctctgcagcgcgaacgagaggagcagcagcacttgctcgctgagtcttatagtgctgtcatggagttgactcgccaactgcagatcagcgaacggaattggtcccaggagaagctccaactggtcgaaaggctgcagggcgagaaacagcaggtcgagcagcaggtgaaggaactgcaaaacagactgagtcagcttcaaaaagccgcagatccgtgggttttaaagcactccgaactcgagaaacaggataactcctggaaggagaccaggtccgagaaaatccatgacaaagaagcagtaagcgaagtcgagctgggcggtaacggcctgaagagaaccaagtcggtgtcctcaatgtcggagttcgagagtctactggattgcagcccttatctcgccggaggagacgcacgtggaaagaagctgcctaataatcctgcttttggtttcgtgtctagcgagcccggagaccccgagaaggataccaaggagaagccgggactttctagcagggattgcaaccatctgggcgctcttgcctgtcaagacccacccggtaggcaaatgcagcggtcatatacagccccagacaagactggcatcagggtttactacagcccgccagtggcgaggcgactcggagtcccagttgtacacgataaagaagggaaaataattatcgagcccggtttcctcttcacgactgcaaaaccaaaggagagcgccgaagctgatgggctggcagagagcagctatggtcgctggctctgcaatttttctaggcaaagactggacggaggctcagccggttctccaagcgccgcaggtccaggattccccgctgctctgcatgactttgaaatgtcaggcaacatgtcagacgacatgaaggaaatcactaattgcgtgcgccaagcgatgcgctcaggcagtctggaaaggaaggttaagagtacgagttcccagactgtgggtcttgcttcagtcggaacacagacaatcaggacggtgagcgtgggcctacagacagatcccccaagaagtagcctgcacgggaaggcgtggtcaccacgcagtagcagcctcgtgtccgtgaggagtaagcagatatcctctagtcttgacaaagtgcactcaagaatcgagaggccctgctgtagccccaaatacggaagcccaaagttgcagagacggagcgtttctaagctggacagtagcaaagacagatctttgtggaatctccaccaaggaaagcaaaatgggtccgcatgggcccgatccactacgacacgggattcacccgtgctacggaatataaacgacggcctttcatccttgttttctgtggttgagcacagcggaagtaccgaatctgtgtggaagctcggaatgtcagagacacgggcaaagccagagcctcccaagtatggcatcgtgcaggagtttttccgtaacgtgtgcggcagagccccaagtcccacatcttctgctggagaggagggaaccaaaaagcccgagcccctttctccggcatcctaccatcaaccggagggagtcgcaaggatccttaacaagaaagcagcgaaactcggctcgagcgaggaggtgagacttacaatgctgccacaagtcggaaaggacggagtgctccgggacggcgatggagccgtcgtgctgccaaacgaggacgccgtgtgcgactgtagcactcagtctctaaccagctgttttgcccgatcctcccgctctgctattaggcactcgcccagcaagtgccgcctccaccctagcgagtcatcatgggggggtgaagagagagcacttcctcccagcgaatag

SEQ ID NO: 60016 - DNA, 237 bp, Artificial Sequence
  Description of Artificial Sequence: Synthetic coding sequence
atggggtcggggctgcccctggtgctgctgctgaccctgcttgggtcgtctcatggaacaggcccaggaatgactttgcagctgaaactgaaggagagtttccttaccagctccagctacgaatctagttttcttgaattgctcgagaagctctgtctgcttttacacctccctagtggtacctccgtcacgctgcatcacgctcgaagccagcaccatgtggtctgtaacacttag

SEQ ID NO: 60017 - DNA, 690 bp, Artificial Sequence
  Description of Artificial Sequence: Synthetic coding sequence
atgcctgccgcagggcctcctctgctgctgctcgggacccctggctcggggaaaacggctctgctcttcgcagccgctttagaggccgctggagaaggccagggccctgtcctctttctgacccggcgacctctgcagtccatgcccagggggaccgggacaactctggacccgatgcgcctgcagaagattcggtttcagtatcctccgtcgacccgtgagctatttagactactctgttcagctcatgaagccccaggtccagcaccctcactgctgctgctagatggacttgaagaatacctggcggaagacccagagccacaggaagcggcttatctcattgctctgctcctggatactgcagcccatttcagccacagactcggtcccggacgggattgtggtctgatggtcgccttacagacccaggaggaagccggttccggtgacgtgcttcaccttgcacttttacagaggtacttccctgcacagtgttggctgcagcctgacgctcccggaccgggagaacacggactgcgggcttgcctggagcccggtgggctgggacctagaaccgagtggtgggtgactttccgcagcgacggggagatgatgatcgccccttggccaactcaggctggcgacccctcttccggcaaaggatcctcatcaggcggtcagccatag

SEQ ID NO: 60018 - DNA, 2703 bp, Artificial Sequence
  Description of Artificial Sequence: Synthetic coding sequence
atgtctagtaaggaaagttgtggcaaaaaggagaccagtcaaagaaaagacactacaacctcaagccctaatttcggggaaaaagacaagaaagagaggaagacacccgcttcgtcaacatccagttcctccatccgctccgttagcagcgagaaaagaaaactgaagtctgaccacaccgacgtactgtactataatatcaagcgtagacagggcttaaaacgactgtccgttgaaatcgacactttgagacgtagaccaaagatcggctctagtagccagagacccatcaagttgaaggaagcctcctatagcaacgacaaccagattatcctccaatctccttcctccaacggaacgaaaaaggacattcacaagtgcgtagactttaagcctaaagacataaaacttacaaacgccggtagtaagctcgatcatggcattaagtccctgtccagcccaaaaattgctagtgacgtgaaacctaaagcggagggccaggccagtgaaaacaaatggtctcacctgcttgtacagcgcgagaagatgaaggagctcaaaaaagggcgtaacagtaagttccgagacaactccgaaaagtgtgttcttgaaaagtggaagcgaaaccagtttagccaagactacaattccaacaagatcattaaggagcctctgggctcaagacggcagaaaatctcctttaaaatccctatcaaatcccgggatactcttcaaaaactggtggaagaaaacgtatttaatatcgattccaataacagcaagaccaagcaggaagaaagagaatacctggagtccagtcaagtgagcctgaacgttactcgtcaaaaaaccgagcacctgttgtctgatttcacctacaaacggaccgtccacgaatggaaacggaaacatcactacgatcatcaggaaagcaacgatagtcatagtagggagaacttaacgcagtcctttgaggccccttgctgctctgtgagttcagagtctatccaagacgctgatcaggaaatgcaaattgtggaagaattgcacgccgcaagggtcggaaagtccgttgaccttcccggagagctcatgtcaatggagattgacctggaagatgacgtgcacagcagtagcgctaacaacactagcgatagaaagctgctgattgttatcgatacaaatattctcatgaatcacctgaagttcgtgaggatcctgaaaacaaccgaggtgcccggttttgacaaacttgtcctgatcattccatgggtagtcatgcaggaactggaccgaatgaaggaaggcaagctgctgaaaagggcccagcataaggccattcccgctgtgcactttatcaatgactccctaaagaatcaggatcgcaaattgtggggtcagtctatccagttggcaagtcagaagcattatggcctctctgatgaaaacaacgatgaccgggtcctcaaatgttgcttgcagcatcaggaactctttccatgctccttcgtgatcctgtgcacggacgacagaaaccttcgcaacaagggtctgatatcaggcgtcaagtccctgtcgaaggaggagttgtcagcagaacttctccacctttctttgaatacagacgtgtgtcaccagccgtgcatcccgaaacagcagctgaaggcagaaactactcccctgaaggaatcttacaaagaagaaagcaccaattccggcctgagcatcctgctggagtctatcgtgagcgatctggagaaatcgttggggacaggcctgtcctccatactggaaaccgagatgaagatcgctttcgggaacctgtggatggagattctttaccttaaacctccttggacactgctccacctactgcagtgttttaaaaagcactggctggcggtatttggattggtgatggagaaaaacttgcttctgaccatcgagtcactttacaaaaacttgaggaaggcaaacaaggccgttgacttcacgaccgtgaaattcttgctccaggactcccggagcctccttcacgccttctcaactcgttctaattacgacgggatactcccccagactttcgctcaagtaaataatttgttgcaaacctttgccgaagtaaagactaaactcaagcctaattcttcagagaataccgtaacaaaaaaacaggagggcacaagcttgaaaaacagtcataatcaagagattacagtattctccagctcacatctgccccagccatcaagacaccaggaaatatggtcgattctggaatcagtgtggatcactatttaccaaaactcgaccgacgttttccaacgcctcggttcaaactccgccctcactacgagtaatatcgcttcttttgaggaagccttcatctgccttcaaaagcttatggctgcagtgagggatatactcgaaggaatacagcggatcctggctcccaactccaattaccaggatgttgaaactctttacaacttcctgattaaatatgaagtcaacaagaatgtgaagttcaccgcgcaggagatatatgattgtgtgagccagaccgagtatcgggagaaactaacaatcggatgtcggcagttggtagagatggagtacactatgcagcagtgcaatgccagtgtgtacatggaggccaagaaccgaggctggtgcgaggatatgctgaactaccggatctag

SEQ ID NO: 60019 - DNA, 2703 bp, Artificial Sequence
  Description of Artificial Sequence: Synthetic coding sequence
atgtcgtcaaaagaaagctgcggcaaaaaggagacttcacagagaaaagacacaaccacaagttcccctaactttggcgaaaaggacaagaaagaaagaaaaacccctgcgagctcaacaagcagcagcagcatccgctccgtcagctccgagaaacgcaagcttaagagcgaccataccgacgtactctattacaatataaaaaggcgacagggattaaaacgccttagcgtcgagattgatacactgcggcgtcggcctaaaattggctctagttcacagagaccaatcaaacttaaggaggcttcctactccaacgacaaccagattatccttcagtctcccagctcaaacggtactaaaaaggacatacacaagtgcgtcgacttcaagcctaaggatataaagttaaccaacgctgggtcaaaactggatcatggcattaagagcttgtcatccccgaagattgcatctgacgtgaaacctaaggcagagggccaagcatccgaaaataagtggtcccatctgcttgtgcagcgcgagaagatgaaagaactaaagaagggcagaaacagtaaatttagagacaactcagaaaagtgcgtacttgaaaagtggaaacgcaaccagttcagtcaggactataactccaacaagattatcaaggagcccctggggtcaagacgccagaagatttcctttaagattccaataaaatcccgcgatacacttcagaagcttgtcgaagaaaacgtattcaacatagactctaataattccaagaccaagcaagaagaacgcgaataccttgagtcatctcaggtgtctctcaatgtgacccgccagaagacagaacatctcctgagcgacttcacatacaaacggacagttcatgagtggaaacgtaaacaccactatgatcaccaggagtcaaatgactcacactccagagagaatctgacccagagtttcgaggccccttgttgctcggtgtcttcagaatcaatccaagacgccgaccaggagatgcaaattgtggaggagctccacgcggctagggtgggtaaatcggtggacctgccaggggagctgatgtcaatggagatcgacctcgaagacgatgtccactcctctagtgcaaataacacaagtgaccgcaagctattgattgtgatcgatactaacattctgatgaatcacttgaagtttgtccggatccttaaaacaactgaagtgccaggatttgataagttggtactgattattccatgggtcgtcatgcaggagctagatcgcatgaaggaaggcaagctcctcaaacgagctcaacacaaggccatccccgcagttcattttattaatgacagtctgaagaatcaggaccggaagctctgggggcaatctatccagctcgcctcccagaagcactatgggctgagcgacgaaaataatgacgaccgcgtgctgaaatgctgtctgcagcaccaggagctttttccttgctcctttgttatcctgtgtacagacgatagaaaccttcgcaacaagggccttatttcaggggtgaagagtctgtcaaaggaggaactttctgctgagcttctgcacctttctttaaacacagatgtgtgccatcagccctgtatccccaaacaacagctcaaagcagagacaactccactgaaggagagctacaaggaagaatccaccaattcagggctttctattctgctggagtccattgtatcagacctggagaagagcctgggcacgggactgtcctctattcttgagacagagatgaagattgccttcggaaatctgtggatggagattctgtaccttaaaccaccttggaccctcctgcatctcctgcagtgtttcaaaaagcactggctcgccgtctttggattggttatggaaaagaaccttttgttgaccatcgagagtctctacaaaaacttgcgcaaagcgaataaagccgtggacttcaccacagtgaaattcctcctccaggatagtcgttcactgctccacgcattctctacccggagtaattatgacggcatactaccccaaacgtttgcacaggtgaataatctcctacagaccttcgccgaagtcaagacgaaactgaaacctaatagctctgagaatacagttaccaagaagcaggaaggaacctctctgaagaactcccacaaccaagaaatcactgtgttttcatcatcacatctaccacagccctcgcgccaccaggaaatatggtccattctggaaagcgtctggattaccatttatcaaaacagcaccgacgtgttccagaggctcggatcgaatagcgctctcaccacctccaacattgcatcttttgaagaggcatttatctgtctccagaaattgatggcggcagtccgtgacatcctggagggaatccagcgtatccttgcgccaaatagcaactaccaggacgtggagacactgtacaacttcttgatcaagtatgaagtgaataaaaacgttaaattcacagcccaggagatttacgactgcgtgagtcaaacggaatatcgggagaaactcaccattgggtgtcggcagctggtggaaatggagtacacaatgcagcaatgcaacgcatctgtgtacatggaagcaaagaaccggggatggtgtgaagatatgctcaattatcggatctag

SEQ ID NO: 60020 - DNA, 483 bp, Artificial Sequence
  Description of Artificial Sequence: Synthetic coding sequence
atgtccagtaaggagtcctgcggaaagaaggaaacatcccagcggaaagacaccacaacttcaagtcccaattttggagaaaaagataaaaaagagcggaagaccccggcttctagcacatcctctagcagcattcggtctgttagtagcgagaagcgcaaactgaagtccgatcacactgatgtactctattacaatatcaagaggcgccagggcctcaaaaggctcagtgtcgagatcgacaccctgaggagaagacccaaaatcggctcttcgtcccagaggccaatcaagttgaaagaggcatcctatagcaatgataatcagatcatcctgcagagtcccagtagcaatggcaccaagaaagacatccacaagtgtgtggatttcaagcctaaggatattaagcttactaatgcgggtagcaagctcgaccacgggattaagagcctaagcagtccaaagattgcctccgacgtctag

SEQ ID NO: 60021 - DNA, 1545 bp, Artificial Sequence
  Description of Artificial Sequence: Synthetic coding sequence
atgatgaactttctgcgcaggcggctgtcagattcgtcccttttttcttcccttagccaggccgtgaagcagactgcggcaagcgcaggcctggtagacgcaccaggtgctgctccagccgctgcacgaaaggcaaaggtgctcttagtggtggacgagccccacgctgactgggctaagtgctttagggggaaaaaagtcctcggcgattacgacatcaaagtcgagcaagccgagttttccgagctgaacctggtggcacacgccgatgggacctacgctgtcgacatgcaggtactacgtaatggcacaaaggtcgtgcggtcttttcgcccagacttcgtcctgattaggcaacacgcgttcgggatggccgagaatgaggattttcgtcacctcattatcgggatgcagtacgccggactcccttctatcaactctttggaaagcatctataacttctgcgacaaaccttgggtgttcgctcagctggtcgcgatctataaaactcttggcggagaaaagttccccctgatagaacagacttactatcctaatcacaaggaaatgctcacactgcccacttttcctgtcgttgtcaaaattgggcacgcccattctggtatgggaaaagtcaaagtagaaaatcactacgattttcaggacatagccagcgtggtggctcttacgcaaacgtacgccactgctgaacccttcatcgattctaaatacgacataagggtgcagaaaatcggcaataattacaaggcctatatgagaacatccatcagcggcaattggaagaccaacaccgggagcgcgatgctggaacagatcgccatgagcgatagatataaactttgggttgatacttgcagcgaaatgttcgggggtctcgatatttgtgctgtaaaagccgtccacggcaaggatggcaaggattacatttttgaggtgatggattgctcaatgcccctcatcggcgaacaccaggtcgaggatcgacagttgataacagagctggtcataagtaagatgaaccagctgctcagcagaacaccagcactctctccccaaaggcctctgacaacacagcagcctcagagtggaaccctgaaagatcctgattcaagtaaaacccccccacagcggccacctccacaggggggtcctggccaacctcaggggatgcagccaccaggaaaggttctgccacctcggagattacctccaggtccaagcctccccccatcttcgagttcttcctctagctcctcatcctccgcccctcaacgacccggaggaccaacgacacacggagacgccccatcctccagttcctcgctcgcagaggcccagcccccattggccgctccaccccagaaaccgcagccccaccctcagttaaacaaatcccagagtctgactaatgcgttctccttctctgagtcttctttcttccggtcaagcgcaaacgaggacgaggctaaggctgaaactatccggagcttgcggaagagttttgctagtctgttcagcgattag

SEQ ID NO: 60022 - DNA, 729 bp, Artificial Sequence
  Description of Artificial Sequence: Synthetic coding sequence
atggctggtaagcttaaacccctcaacgtggaggccccagaagcaaccgaagaagcagagggacaggcaaagagcctgaaaacagaggacttgctggccatggtgatcaaactgcagaaggagggatctcttgagccacagatcgaggatttaataagcagaatcaatgacctgcagcaggccaagaagaaatcatctgaggaacttagggaaacccattctctgtgggaggctctgcaccgcgagttggactctctgaacggggaaaaggtgcatctggaggaggtgctggggaagaagcaagaagctctgcgtatcctgcagatgcattgccaagaaaaggagtcagaagcccagagactagatgtgcggggacagctagaggatcttatgggacaacacaaggatctgtgggaattccacatgctcgagcagcggcttgctagggagattcgcgcactcgagagaagtaaggagcaactgctgtccgaacgcagattagtgagagcgaaactcagggaagtcgaacgcagattgcacagccctccggaagtagagggcgcaatggccgtgaacgacgggttaaaggctgaactggaaatcttcggggaacaggtccggtccgctccagaagtgggcgcaggggagggggaggctggcccagaactgccaagagcacgggatgaagaagatcctgagccaccagttgccgctcccgatgccctttag

SEQ ID NO: 60023 - DNA, 267 bp, Artificial Sequence
  Description of Artificial Sequence: Synthetic coding sequence
atggacgacgccgatcccgaggagcgaaattatgacaacatgctcaagatgctcagtgacctgaacaaagatcttgagaaactcctggaagaaatggagaagatcagtgtacaggctacctggatggcctatgacatggtggtgatgcgtacaaaccctacattggctgagagtatgcgtcggttggaggacgcctttgtgaactgcaaggaggagatggaaaaaaactggcaagagctacttcatgaaaccaagcagagactgtag

SEQ ID NO: 60024 - DNA, 942 bp, Artificial Sequence
  Description of Artificial Sequence: Synthetic coding sequence
atgctgctgttggccgacatggatgttgtgaaccagctggttgcagggggacagttccgggttgtgaaagagcctctggggttcgtgaaagtccttcagtgggtcttcgcgattttcgcttttgctacttgtggctcttactccggggagttacagctgagcgtggactgcgctaacaagacggagtcagatctatctattgaggtggagttcgagtatcccttccggttacaccaagtgtacttcgacgctccaacatgccggggagggacaaccaaggtttttcttgtcggggattattcaagctcagccgaattctttgtgacagttgctgtgtttgcttttctgtacagtatgggcgctctcgcaacctacatctttctgcagaacaagtacagagagaacaacaaaggtccgatgctggactttctggccaccgcagttttcgcgttcatgtggttggtcagctcatcagcctgggccaaggggctttcagacgtgaagatggccacagaccccgagaatatcatcaaagaaatgcccgtgtgccggcaaaccggtaatacatgtaaggaactccgtgatccagttacatccggcttgaacacaagcgttgtgttcggctttctcaatcttgtgttgtgggtaggaaacctgtggtttgtgttcaaggagacgggatgggcggctccctttttgagggcacccccaggcgctcccgagaagcagccagcccctggcgatgcttacggtgacgccggttatggccagggcccagggggatacggaccacaggactcgtacgggcctcagggcggatatcagcctgattacggccagcccgcaggcagcggcggatctggctatggccctcagggagattatgggcagcaggggtacgggcctcagggagctcctacaagtttctcaaatcagatgtag

SEQ ID NO: 60025 - DNA, 1173 bp, Artificial Sequence
  Description of Artificial Sequence: Synthetic coding sequence
atggcggagcagctggcgctggtcatcgggggtacgattgggggtttgcttctgctgctcctgatcggcgcaagttgctgcctctggcgcagattctgtgctaccctgacatatgaggagctaccaggcacccccgctatggccaccacagctgcttccagcggtcaaagggacaggccctgtcagccccatgccaggacacaactcagtagacccccagcagtcccattcgttgtaccaccaacgctgcaaggaagagattgggtccctctgcattcaggggaatgggctgacgcaccctgggatccatgcccagcgagtgaactgctgcctcacacctccagcgggggattgggagacgcctgtatggtgggcgctatcaaccctgagctgtataaatttcccgaggataagtctgaaacagattttcccgacggctgtctgggaagactatggttcagtgtcgagtacgaacaagaggccgagcgcctcctggtgggactgatcaaagctcagcatctgcaagcgcctagcgagacctgctccccgctggtcaaactgtacttgttaccagacgaacgtaggttcctccagtcaaagactaagcgcaaaacatctaacccgcaatttgacgagcactttatctttcaggtgtccagtaaaacaattacccagagagtcctcaaattctcagtctaccatgtggatcggcagcgaaaacatcagttgctgggccaggtactgttcccgctgaagaatgaaacccttgtaggtgattgccgcagggttatctggagggacctggaggccgagagcctcgagccccctagtgagttcggcgatctgcagttctgtcttagctataacgactacctctcccgcctgacagtggtggtgcttcgagctaaagggctgagactccaggaggatcgtgggatagtcagcgtctttgtaaaagtttccctgatgaaccataacaaattcgttaaatgcaagaagacgagcgcggttcttggatccatcaacccagtttacaatgagactttctcgtttaaagccgatgccacagaactagacacagctagcttatctctgacagtggtgcagaacatggaaggagataagcaagcgaccaccgtggaattgtttctgttccacctcacgtcaggctag

SEQ ID NO: 60026 - DNA, 1833 bp, Artificial Sequence
  Description of Artificial Sequence: Synthetic coding sequence
atggcccaagagattgatctgagcgctctgaaggagcttgaaagggaggccattctacaggtgttgtacagggatcaagctgtccagaacaccgaggaagaacgtacccgcaagctgaaaacacacctgcagcatttgcggtggaagggcgctaagaatacggactgggaacacaaagagaaatgttgtgcaaggtgtcagcaggttttaggctttcttctccatcgcggagccgtctgtcggggttgctctcacagagtgtgcgcccagtgtagggtttttttgcgaggtacacatgcctggaaatgcacagtttgtttcgaggacagaaatgtaaaaattaaaacaggagagtggttctatgaggagcgcgctaaaaagtttcccaccggaggcaagcacgaaaccgtgggcggacagctgcttcagtcttaccagaagctctcaaagatctccgtggtcccccctactccgccaccagtgtccgagagccagtgtagtcgatcccccggtagactgcaggagtttggacaatttcggggatttaataaatctgtagaaaacctttttttgtccctggccactcacgtgaaaaaactctcgaagagccagaatgacatgacatccgaaaaacacctgctggctaccggcccacgtcagtgcgttggacagacagaacgtcgctcacagtctgataccgcagtgaacgtgacgaccaggaaggtgtctgctccggacatcttaaagcctctcaatcaggaggatccaaagtgcagcaccaatcctatattgaaacagcaaaacctgccatcctcgcccgctccgtctaccattttctcagggggtttccgacatgggagtctgatttcaattgactctacctgcactgaaatggggaactttgacaacgcaaatgtgactggcgagattgagttcgccatccattattgtttcaaaacccacagcctggagatctgcattaaggcatgcaaaaaccttgcgtatggggaagaaaagaagaagaagtgcaacccctacgtcaaaacttacctcctgcccgacagatcttctcaagggaagcggaaaactggagtccagcggaacaccgtggatccgacatttcaggaaacgctcaagtaccaggtggcaccagcccaacttgtaacaagacagcttcaggtcagcgtctggcacctcgggaccctcgctcgacgcgtctttctgggcgaggtgatcatcccgctggcaacgtgggatttcgaggacagcacaacacagagtttcagatggcatccactccgagccaaagccgagaagtacgaggattcagtcccacaaagtaatggcgagctaaccgtccgcgctaagttggtgctgccatcaagaccaagaaagctgcaagaagcccaggagggcaccgaccagccttctctgcacggccagctgtgcttagtagtgttgggcgcaaagaatctgccagttagaccagacggcactctgaactctttcgtgaaggggtgcctcactctcccggaccagcagaaactcaggctcaagagcccggtgctcaggaagcaggcgtgtccacaatggaaacactcctttgtgttcagcggggtaacccccgctcagttgcgccagagctccctcgagcttacggtgtgggaccaggcattgtttgggatgaatgatagactcctcggagggactcggcttggatcaaagggcgatacggcagtagggggagacgcctgcagtctatctaaactccagtggcagaaggttctatcatcccccaatctgtggaccgatatgacactagtgcttcactag

SEQ ID NO: 60027 - DNA, 1629 bp, Artificial Sequence
  Description of Artificial Sequence: Synthetic coding sequence
atggcacaggagatcgacctgtcggcactgaaagagctcgagagagaggcgatcctgcaggtactgtaccgggaccaggctgtacaaaatacagaggaagaaaggacgcgtaaactcaagactcacctacagcatctccggtggaagggcgctaaaaatacagactgggagcataaagaaaagtgttgcgctcgatgtcagcaggtgctggggttcctactgcaccgcggtgctgtctgtcgtggctgttctcatagagtgtgtgcccagtgtcgcgtctttctacggggtacgcacgcatggaagtgcacagtgtgcttcgaggaccggaacgtgaagattaagaccggcgagtggttctacgaggagcgtgccaagaaattcccgactggcggaaagcacgaaaccgtagggggacagctgctccaatcttaccaaaaactcagtaaaatttctgtggttcctcctacgccccctcccgtttctgaatcgcaatgtagccgctctcctggacggaaagttagcgctcctgatatcctgaaacccttaaaccaggaggatcccaagtgttccactaatccaatcttaaagcagcagaatctgccaagctcaccggcacccagcaccatcttctcagggggatttcggcacgggtccctgatttccatcgactcaacttgtactgagatgggaaactttgacaatgcgaacgttactggggaaatcgagttcgctatacactattgctttaagacacactctctggagatttgtatcaaggcctgcaagaacctggcatatggcgaagagaagaagaagaaatgtaacccatatgtgaagacctacctgctccctgatagaagctcccagggcaaacggaagaccggagtgcaacggaacaccgtggaccctaccttccaggagactctgaagtaccaagtggccccagctcagttagtcacgagacagctccaggtgagcgtatggcatctgggcacactggcacgtcgggtatttcttggcgaagtgatcattccccttgccacatgggatttcgaggactctactacccaatcatttcggtggcaccctttgcgcgcaaaggccgaaaagtacgaagatagcgttccacagagtaatggagaacttactgtgagggctaagctggtcctcccttcccgtccacgcaaattacaagaggctcaggaaggcacggaccagccttcccttcacggacaattgtgccttgtcgtgttgggtgctaaaaatttgcccgtacgaccagacggaaccttgaacagcttcgtgaaagggtgtttgaccctacctgatcagcagaagctgcgtctaaaaagcccagtattacggaagcaggcctgtccccaatggaagcacagttttgtgttttcgggggtcactccggctcagctcagacagtcatccttggagcttacagtctgggatcaggctctcttcgggatgaatgatcgcctcctggggggtacacgcttgggctctaaaggagacacagctgtgggaggggatgcatgtagcctgtccaagttacaatggcagaaggttctgagctcaccaaacctttggacggatatgacccttgtgctgcattag

SEQ ID NO: 60028 - DNA, 1011 bp, Artificial Sequence
  Description of Artificial Sequence: Synthetic coding sequence
atgcggaacgagcctcgcaacttccaactggaagggtcactcatttccatcgatagcacatgcaccgaaatgggcaatttcgataacgctaacgtgactggcgaaatcgagttcgccatccattactgttttaagacccattctctagagatatgcattaaagcctgtaagaatttggcctacggtgaggaaaaaaaaaagaagtgtaatccctatgtgaagacgtacttgctgcctgatcgatcctcccagggcaagcgcaagaccggtgtgcagagaaacacagtcgaccccactttccaagagaccctgaagtaccaggtcgctccagcccaactggtgacgagacagctccaagtttccgtgtggcacttgggtaccctagcccgacgggtcttcctaggagaagtgataattcccctcgctacctgggattttgaagattcaacaactcagtcctttcgatggcaccctctgcgcgctaaggcggagaagtacgaagattccgtgccccaaagcaacggggagttgaccgtgagggcgaagctcgtcctcccatcacgccctaggaagttgcaggaggcgcaggaggggactgaccaaccttccctgcacggacagctttgcctggtggtgctcggggctaagaacctgcctgtcaggccagacggcacgcttaactcatttgtgaaagggtgtctgactctgcctgaccaacagaagctgcgtctgaagtcaccagtactcagaaaacaggcttgcccacagtggaagcatagctttgtcttttctggggtgactcctgcacaattgagacagtcaagcttagaactgactgtttgggatcaggctcttttcggcatgaatgaccggctgctggggggaacaaggcttgggagcaagggagatacagcagtggggggtgatgcatgttccctttccaaactgcaatggcagaaggtcctgtcctcacccaatctgtggactgacatgaccctggtattacactag

SEQ ID NO: 60029 - DNA, 1704 bp, Artificial Sequence
  Description of Artificial Sequence: Synthetic coding sequence
atggcccaggagatagatcttagtgcgcttaaggagttggagagagaggcgattctgcaggttttgtatcgtgatcaggccgttcaaaacacagaagaggagcgtacccgtaagttgaaaactcacctccagcatctgcgttggaagggagctaagaacactgactgggaacacaaggaaaaatgctgtgcaaggtgccagcaggtcctgggcttcctgctgcatcgcggagctgtctgcaggggctgttctcacagggtttgtgcacaatgcagggtgttccttagggggacacatgcttggaagtgtacagtgtgcttcgaagatcggaacgtcaagattaagaccggtgagtggttttacgaagagagggctaaaaaattcccgaccgggggaaagcatgagaccgttggagggcaacttttgcaaagctaccagaagttgagtaaaattagtgtggttccaccaactccccctcctgtcagtgaatctcaatgcagccggtctcctggaaggcttcaggagtttggacagttccggggatttaataaaagcgtggagaatctttttctgagtttagcaactcacgtgaagaagctcagcaaatctcagaacgacatgaccagcgaaaaacatctactggctactggccctagacagtgcgtcggacagaccgagaggagaagccaatcagatacggccgtcaacgtgacgacgcggaaagtgagtgctccagacattcttaaaccactaaatcaggaggatcccaagtgcagcactaaccccatcctaaaacagcaaaacttacctagctcgcctgctcctagtacaattttttcaggcggattcagacacggaagtctcatcagcatcgactcgacctgtaccgagatgggcaacttcgacaatgctaacgtcacaggggagatagagtttgctattcattactgcttcaagactcactctctggagatctgcattaaggcctgcaaaaatctggcttacggagaagagaaaaagaagaaatgtaacccgtatgtcaagacctatctgctcccagacagatcatctcagggaaagaggaaaacgggagtgcagaggaataccgttgatcctacattccaggagaccttgaaataccaagtggcacccgctcaattggtcactagacaactccaagtatccgtgtggcacctgggaaccctggctcgcagagtttttctgggagaagtcattattcctctggctacatgggatttcgaggacagtactacacaaagttttcggtggcatcccctgcgcgctaaagctgaaaaatacgaggatagcgtgccccagagcaacggagaactgactgtccgtgccaagctggttctcccttcccgcccaagaaaattgcaagaagcacaggagggcacggatcaaccatccttacatggtcagctgtgtctggtagtgctgggtgccaagaatctgcccgtacgccctgacgggacgctgaactcattcgtcaaaggctgtttgactctacccgatcaacaaaaactgcgcctcaagtcaccagtgctgcggaagcaagcctgcccacagtggcgacactcctgctggcgcggatgcatgttgactatcgaagctccagttgcagagagcccctttcaaccccagtcaatggaccgccacgattcatgtcccgctctgacgtag

SEQ ID NO: 60030 - DNA, 2193 bp, Artificial Sequence
  Description of Artificial Sequence: Synthetic coding sequence
atgtctaagaattccgaatttatcaatctgtcattcctgcttgaccatgaaaaggaaatgattctgggggtgctgaaacgcgacgaatatctgaagaaggtggaggataaacggatcagaaaactcaaaaacgagttgctggaagctaagagaagaagcggaaagacccaacaggaggcttcccgggtgtgtgtgcattgccatagaaatctgggattgattttcgatcggggtgatccctgccaggcttgttctctgcgggtgtgccgggagtgccgcgtagccggaccaaatggttcttggaagtgtaccgtttgtgacaaaatagcccagctccggattattacaggagaatggtttttcgaggagaaggctaaacgcttcaagcaggtcaacgtcctgggtaccgacgtggtgcgccagtccattctgcggagatcgcccggagcagaagaggtgcaatcccaggagcagacgcggcaagatgccgagaagagcgataccagtccagttgcagggaaaaaggccagtcacgacggacccaaacgtaaaggctttctgctgagcaagttccggtcagctactaggggtgagattattacacccaaaactgacaccgggagatcatacagcctggatctggacggccagcattttcgatcgttgaagtctcccccaggctctgatcggggaagcacaggctcaagcgacttgaatgaccaggagccaggacctcggaccccaaaatcctcgcgatcgaatggtgtgacacctggaacacagtcctccccagcaccttctacccgcacagtgactagtgtgatatcacgagagtacggctttgaaaacagcatggatctggcagccattgaggggactagtcaagagctcacaaagagccaccggagaaatacttcgggaacccctagtatcgccgtttctggcacctctttaagtagtgatcaatctcgatctgagctggacttgtcggaatcctttacggaggactcagaagacaccgtaagcatacggagtaaatcagtccccggtgccctagacaaggattcactcgaggagaccgaagagagtattgacgctcttgtatcctcacagctcagtacaaacacacaccgacttgcatctgggctcagcacaacatctctgaacagcatgatgagcgtgtatagtgaaacgggagactacgggaacgtgaaagtctccggagaaatccttttgcatatctcttactgttataagactggaggtctctatatatttgtgaagaactgtcgcaatttggccattggggatgaaaagaagcaacgaacagatgcctatgtgaagagctacctgcttccagataaatcgcggaataacaaacgcaaaactaagatccggactggtacaaacccagagtttaacgagactctaaagtataccatttcacacacgcagctagagacacgaacactacaattgagcgtatggcattacgatcgcttcgggcgaaattccttcctgggggaagtggagatcccgttcgactcctggaattttgagaaccctactgatgagtggtttgtcctccagccgaaggtcgagtttgcacccgatatcggtctgcagtataaaggcgaactcacagttgtgttgcgttatatcccccctgaggaaaacctgatgctcccacctgaacagttgcaggggaacaagacatttaagaaagggaaaaaaaaggagtcacccgttatctcaggcggtattctggaagtcttcattaaggaggctaagaacctgacagcggtcaagagcggcggtacaagtgattcgttcgttaaaggatatctgttgccggatgacagcaaggctacgaaacacaaaaccttggtgatcaaaaagtcagtgaatccccagtggaaccacactttcatgtttagtggcattcatccacaggacatcaagaatgtttgcctggaactgaccatctgggataaggaggcatttagctccaatatcttcctgggcggagttcgcttgaacagtggatcaggtgtgtcccacgggaaaaacgtcgattggatggactctcagggagaggagcagaggctgtggcaaaaaatggctaataaccccggtactccgttcgagggcgtattgatgctgcgcagttcaatgggcaagtgtcgactctag

SEQ ID NO: 60031 - DNA, 2193 bp, Artificial Sequence
  Description of Artificial Sequence: Synthetic coding sequence
atgagtaaaaacagcgagttcatcaacctgagcttcctcctcgaccatgagaaagaaatgattttgggcgtgctgaagcgcgacgaatacctgaagaaggtggaggataaaagaattaggaaactgaaaaacgagctcctggaggccaagagaaggagtggcaaaacacagcaggaggcatcccgggtctgtgtgcattgccaccgtaacctaggtcttatattcgaccgaggcgacccctgccaagcttgttccctgcgggtgtgtagagagtgcagggtggcgggacctaatggatcatggaaatgcacagtctgtgataaaattgcccagctgagaatcattaccggtgagtggttcttcgaggaaaaagctaagcgtttcaaacaagttaatgttctagggaccgacgtggttcgccagagcatcctgcggcgatctccaggcgcagaagaagttcagagtcaggagcagacgcgtcaggacgcagaaaaaagcgacacatccccagtggcaggaaagaaagcctcccatgatgggccaaagcgcaagggatttttgctgagcaaatttaggtcagcgacaaggggggaaattattacacccaaaacagataccggacggagctattcgctggatctggatgggcagcacttccgcagtctgaagtctcctccaggctctgatcgcggatctacaggcagcagcgacctcaatgaccaggaaccgggacctagaacccccaaaagctcccggtccaatggtgtcacccccggtactcagagttcccccgctccaagtacccggacagttacatccgttatcagtagagaatatggcttcgagaatagcatggacctggcagccattgagggtacgtctcaggagttgacaaaaagccacagacgcaacaccagcggaaccccgtcaattgccgtgagcggtaccagcctctcctccgaccaaagtcggtctgaactcgacttatcagagtctttcaccgaggacagcgaagatactgtgtccattcggtccaaatcagtgcccggtgcactcgacaaagacagcctcgaagagacggaagagtcgatcgatgcactggtgagctctcagctgagcacgaacactcatcgactggcctcagggctgtctaccacctctcttaactccatgatgtccgtgtactcagaaacaggagattacggcaacgtgaaggtctccggagagattttgctgcacatatcttattgttacaagacgggtggcctctacatttttgttaagaactgcagaaatctggcaattggtgacgagaagaagcagaggactgatgcatatgttaaatcttatttactccccgacaagagcaggaataataaacgcaaaacaaagatccgcaccggaacaaatccagaattcaacgagacacttaagtatacgatatctcacactcaattggaaacccggacactccagctgtcagtgtggcactatgatagattcggccgtaactcctttctgggcgaggtggagattccgttcgacagctggaacttcgagaaccccacagatgaatggttcgtactgcagcctaaggtagaattcgcacccgatatcggcctgcagtacaaaggcgagctgactgtggtcttgcggtacattccccctgaagagaacctgatgctgcccccagagcagttacagggtaacaaaactttcaagaaaggaaagaaaaaggagtcaccagtgatcagtggcggtatcttggaggtattcatcaaagaggcgaagaatctcactgctgtgaaaagtgggggaacgtctgactcctttgtaaaaggctacctgctgccggacgactcaaaggcaacaaaacacaagacgcttgtgatcaagaaaagcgtgaacccccagtggaatcacacctttatgttctctggaatccacccacaagatattaaaaacgtgtgcctggagcttactatatgggataaggaggcattcagctccaatattttcctgggaggcgtacgtttgaactctggttctggcgtgtcacacggtaaaaacgttgattggatggactcccagggcgaggagcagaggctgtggcagaaaatggctaacaatcctggtaccccttttgaaggggtgctaatgttacgatcgagtatggggaagtgtaggctatag

SEQ ID NO: 60032 - DNA, 2259 bp, Artificial Sequence
  Description of Artificial Sequence: Synthetic coding sequence
atgagcaagaattcagagttcatcaatctgagctttctgctagaccacgaaaaggagatgattctgggagtcctgaaaagagatgagtacctgaagaaagtcgaagataagagaatcaggaaactgaagaatgaactgcttgaggccaagcgcaggagtggaaaaacgcagcaggaggcttctagggtctgcgttcactgccatcgcaacctcgggctgatcttcgatcggggtgacccctgtcaggcctgtagccttcgggtttgccgtgagtgccgggtcgcgggacccaacggttcctggaaatgtaccgtttgcgacaaaatcgcacagctgcggatcataacaggagaatggttctttgaggagaaggccaagagattcaagcaggttaatgttttgggaaccgatgtcgtccgacaatccatcctcaggagatccccaggtgccgaggaggtccagtctcaggagcaaacaagacaggatgcagagaaatccgacacaagccctgtggcaggtaagaaagcttcacacgacggtccgaagcgaaaggggttcttactctccaaatttaggtcagccacacgcggtgaaatcatcacacccaaaaccgatacagggagaagttactctctggacctggacggccaacatttcagatccttaaaatcacctcccggtagcgatcgaggctctacgggctccagtgacctcaatgatcaggaaccagggcctaggacgccaaaatcctcacgttctaatggcgtcacaccgggaacccagtcgagccccgcaccaagcacccggacagtgactagcgttataagccgcgagtatggctttgagaatagtatggaccttgcggcaattgaggggacgtctcaagagctgaccaaatctcatcgacgcaatacttcaggaacaccatcgattgctgtttcaggaacctcactgtccagtgatcagtcccgaagcgagctggatctgagtgaatctttcacagaggattctgaagacacagtgagcatccggtccaaatccgttcccggtgctttagacaaagacagcctagaagagactgaggaatctattgacgctcttgtgagctcacagctgtcaacaaatacacacagactggcctcagggttatccacatcctcacaagctgggagcgaccgcaaatggacctatcttaacgtgcccgacgcggatagtgatacgacatccctcaatagtatgatgtcagtgtacagcgagaccggggattatggcaacgtgaaggtctctggggagatccttctgcacatatcttattgttataagaccggagggttatacatcttcgtgaaaaattgcagaaacctggcaatcggggacgaaaaaaagcagaggaccgatgcttatgtgaaatcctatctgttaccagacaaaagcagaaacaacaaacggaagaccaagatccgcacaggaaccaatcccgaatttaacgaaaccctaaagtataccatctcccacactcagctggagacccggacactccagctgtccgtgtggcactatgatcggtttggcagaaatagtttcctgggtgaggtcgaaataccctttgattcatggaactttgagaatcccaccgatgaatggttcgtattacagccaaaggtagaatttgctcctgatattggactgcagtataagggtgaactcactgtggtgcttcggtacattccaccagaggaaaacttgatgctgcctcccgagcagcttcaagggaacaaaaccttcaagaagggcaaaaaaaaggaatctcccgtcatctccgggggtattttggaggtgtttattaaggaggcaaagaatctaactgccgtcaagtctggaggcactagcgacagttttgtgaagggctatctgctcccggacgacagtaaagccacaaagcacaaaactctggtgataaagaagtccgtgaatccccagtggaatcatactttcatgttttcaggcattcatccacaagatatcaaaaacgtgtgcttggagctcacaatctgggacaaggaggctttttccagtaacatcttcctgggcggtgtgcggctaaacagtggtagtggcgtgagccacggtaaaaatgttgattggatggattcccaaggtgaagaacaacggttgtggcagaaaatggcgaacaaccctggaaccccattcgaaggagtgctgatgctaaggtcctcgatgggtaaatgtcgcctgtag

SEQ ID NO: 60033 - DNA, 3762 bp, Artificial Sequence
  Description of Artificial Sequence: Synthetic coding sequence
atgctgtcttggcgcctccagacaggacctgaaaaagccgagttgcaggagctgaacgccagactttacgactacgtgtgtagagttcgggagctcgaaagggagaacttacttcttgaagaggagctcagggggagacgcggaagagaaggcctctgggccgagggtcaggcaagatgtgccgaggaggctcggtctctgaggcagcagctcgatgaactttcctgggccactgctctggctgaaggggaacgggacgcgcttcggcgagaattgagggaacttcaaaggctggatgctgaagagagggccgctcgaggaagactcgacgcggagttaggagcccagcagcgcgaactgcaggaggcccttggggcacgagccgctcttgaagcactcctggggcgactccaggcggaacggagagggctcgatgctgcgcacgaaagggatgtgcgggagttacgggctcgtgcagcctctctaaccatgcactttagagccagggccaccggacccgcagcccctcctcctagactgcgcgaggtgcacgactcctatgcccttctagtcgcagaatcttggagggagacagtccagctctacgaggacgaggtgagggagctcgaagaggccttgagacgaggccaggagtcaaggttacaggccgaagaggagacccggctgtgcgctcaagaagccgaagcgctgcggagggaagcgctcgggcttgagcagctccgagcccgtctggaagatgctctactcagaatgcgcgaagaatacgggatccaagcagaggaacgtcagcgggttattgattgcttagaggacgaaaaagcaacgctgaccctcgctatggcagattggctaagagactatcaggacctgctgcaggtgaagaccggcctcagcctggaggtcgctacataccgcgctctcctggagggtgagtcgaacccggagattgttatctgggccgaacatgtcgagaatatgccttccgagtttaggaataaatcctaccactacaccgatagcctcctgcagcgcgaaaacgaacgcaatcttttctcccgacaaaaagcccctctggcaagctttaatcacagtagcgctttgtatagcaaccttagtgggcatcgtgggtcacagaccggtacaagcataggcggagatgcacgcagaggattccttggttcaggctacagttcatctgcgacgacccagcaggaaaattcctacgggaaagcagtgagctcccagaccaacgttagaacatttagcccgacctatgggctgctcaggaataccgaagcgcaggtgaaaacgtttccagaccgcccaaaggccggagacacccgtgaagtgccagtctatataggcgaggattctaccattgcccgagagagttaccgggaccgcagagacaaagtcgcggctggagcgtccgaaagcacacgatccaatgaaaggaccgtcatcctgggaaagaagacggaggtgaaagcaacaagggaacaggaacggaataggcctgaaaccatcaggacgaagccagaagagaagatgtttgactctaaagagaaagccagtgaagaacgtaatctccgctgggaggaacttacaaagctcgataaggaggccaggcaacgcgaaagccagcaaatgaaagaaaaagccaaggagaaggatagtcctaaggagaaatccgtgcgcgaaagggaagtccctatctcactggaggtttcacaggacagacgcgcagaggtcagtccaaagggcctgcagacacctgttaaggacgctggcggagggacaggtcgggaggcggaggcaagagagctgaggttccggcttggaacctcagacgccactggtagcttgcagggagattctatgaccgagactgtcgctgaaaacatagtgacatccattttgaagcagttcacacagtcccccgagactgaggctagcgcggattccttccctgacacaaaagttacttacgtggaccgaaaagagctgcccggagaacggaagaccaagactgaaatcgtggtagaaagtaaacttactgaggatgttgacgtgtcggatgaagccggtctcgattatttgctctcgaaagatatcaaagaagttggactaaaggggaaatctgccgagcagatgattggagacatcataaacttgggactcaagggacgtgaaggtagagcaaaggtggttaatgttgagattgttgaggagcctgtcagctacgtgtccggcgaaaaacctgaggagtttagcgtaccgtttaaagtggaggaagtcgaggacgtcagcccaggcccttggggattggtcaaagaggaagagggatatggggagtcagacgtgacattctccgtgaaccagcacagacgcacgaaacaaccgcaggaaaacactactcatgttgaggaggtgacagaggctggagattctgagggggaacagtcatatttcgtgtctaccccagacgagcatcctggcggacacgaccgcgacgacggctccgtgtacggccaaatccacatcgaagaagagtcaaccatccgctattcttggcaggatgaaatagtccaggggactagacggagaactcaaaaggacggagcggtgggtgaaaaagtggtcaaacccctggatgtccccgcaccatcgttggagggggatctgggcagtacccactggaaggaacaggccagatctggtgaatttcatgcggagccaaccgtaatcgagaaagagatcaaaatccctcacgagtttcacacatcaatgaaggggatcagctcgaaggaaccccgtcagcagttggtggaggttataggacagctcgaagaaaccctgcctgaacggatgagggaggaattgtccgccctgacccgggaaggccaaggtggccctgggtctgtgtcagttgatgtcaagaaggtgcagggggcaggaggatcctctgtcaccctcgtggccgaagtcaatgtctcccagaccgtcgatgcagataggctggacctcgaagaactctctaaggacgaagcatccgagatggaaaaagcagtcgagagcgtcgttagggaaagtctcagccgtcagagatcccccgctccaggatctccagatgaggagggaggcgctgaagctcctgccgctggaattagatttcgcaggtgggcaaccagagagttgtatatcccgtccggggagtccgaggtggctggaggagcgtctcattcctcaggccagcgcacaccccagggccctgtcagcgccaccgtggaagtgagtagcccaacggggttcgcccaaagccaggtgctggaggacgtgagccaggccgctcgccatatcaagctcggacctagcgaggtctggaggactgagcgaatgagctatgaaggacccaccgcggaggtcgtcgagatggacgtgagcaatgtggaagccatccgctcaaggactcaggaggccggagctctgggagtttctgacagggggtcttggcgagatgccgactcccgaaatgatcaggccgttggcgtgagctttaaggcatctgccggtgaaggggaccaggctcacagggagcagggcaaagagcaggctatgtttgacaaaaaggtccagctccagcggatggtggaccagcggtctgtaatctctgatgagaagaaagtggcgctgctatacctcgataacgaggaagaggaaaacgatggacactggttttag

SEQ ID NO: 60034 - DNA, 3759 bp, Artificial Sequence
  Description of Artificial Sequence: Synthetic coding sequence
atgttaagctggcgcctgcagactggtcccgagaaggccgagctacaagaactgaatgctaggttatatgactatgtttgtagagtacgggaattggaacgagaaaacctgctgctagaagaagagctgcgagggaggagaggcagagagggactctgggcggagggtcaggccaggtgcgccgaggaggctcgcagcctcaggcagcagctggatgagctctcgtgggccactgccctggctgaaggcgaacgcgatgccctgcggagggaactgagagaactgcaaaggttggacgctgaagagcgagctgcaaggggcagactggatgcagagttgggcgcacagcagagagaactgcaagaagcactcggtgctcgggctgcgttagaagcactgctgggcagattgcaggccgaaagaagagggctggacgcggctcatgagcgggatgtgagagagctgagagcccgagcggcatcactgaccatgcacttccgcgctcgtgccacagggccagctgcccctccccctagactcagggaggtccatgacagctatgcattattggtggcagaatcgtggcgggagacagtgcagctttacgaagacgaggtacgtgaactcgaagaagcacttcgacgaggccaggaaagtaggcttcaggctgaagaagagaccaggctatgcgcccaagaggccgctctacgcagggaagctctgggcctagaacagttacgggcaagactcgaggacgcactgctgcggatgagggaagagtacgggatccaggcagaggaacgccagcgagtgattgattgcctcgaagacgagaaggctaccctcacactcgcaatggcagactggctcagagattaccaagatctgctacaagttaagacaggactgtccttagaagtcgccacctatcgagcactactcgagggcgaaagtaaccctgagatcgtcatttgggctgaacatgtggagaatatgccctccgaatttcgaaacaaaagctatcattacactgattccctgctacagcgagaaaacgagcgcaatttattttctagacaaaaggcccctttggcctcttttaaccactccagtgctctgtactctaacctgtccggccaccggggatcccagacaggaacctccattggcggtgacgcaagacgcggtttcttgggctctgggtactccagtagtgccacaactcagcaggaaaattcctatggcaaagcggtgagcagccagaccaacgtgcggacattctctcccacctacggcttgctgcgcaacacggaggcccaggtaaagaccttcccagataggccgaaggccggtgacactagggaggtccctgtctatatcggcgaggacagtactattgcacgagagtcctatcgcgataggcgggataaggtagccgctggtgccagcgaatctacacgatccaatgaaagaactgtgattcttggaaagaaaacggaggtaaaagccacccgagagcaggagcgaaataggcccgagaccattagaaccaagccagaagaaaagatgttcgactctaaggagaaggcctcggaggaaagaaatttgcggtgggaggagcttacaaagctggacaaggaggccagacagagggagtcccaacagatgaaggaaaaggccaaagagaaagatagtccgaaggagaaatctgtcagggagcgtgaagtccccataagtctcgaggtctcgcaagacagaagagcggaggtcagccctaagggtttacaaacccctgtgaaggatgcagggggagggaccggacgcgaggccgaggcgagggagttgagatttcggttgggtacatctgatgccacgggctccctccaaggggactccatgaccgagaccgtcgcggaaaacatcgtgacgagcattttgaagcagttcacccagtcgccagaaacggaggcctctgctgactctttcccagatacaaaagtcacgtacgtggaccgcaaagagctcccaggtgagaggaagactaagacagagattgtggtcgaatctaaattaactgaagatgttgatgtatcagacgaggcgggacttgactacctcctgagcaaggacattaaagaagtaggactcaaaggaaagagcgctgaacagatgataggagatatcatcaacctcgggttgaagggccgagagggaagagcgaaggtcgtgaacgtcgaaatcgtggaagagcctgtgagctatgtctcaggcgagaagcccgaagaatttagcgtaccttttaaagtggaggaggtggaagacgtttcccctggaccatggggcctggtaaaggaggaagaggggtacggcgagtccgatgtcacctttagcgtaaaccagcatcgtcgaactaaacagccacaggaaaatacaactcacgtcgaagaggtgaccgaagccggagactctgagggggagcaaagctacttcgtttcaacgcctgatgagcacccagggggtcacgacagagatgatgggagcgtgtacggacagatccacattgaggaagaaagcacaatccggtacagttggcaagatgaaattgttcagggtacccgcaggagaactcagaaggatggggcagtcggggagaaggtggtaaagcctctggatgtccccgctcctagcctggagggcgaccttggctccacgcattggaaagaacaggccagatcaggcgaatttcacgccgagcccacagtgatcgagaaggaaattaaaatcccccacgaattccacacaagcatgaaaggcatttcttcaaaagagccccgacagcaactcgtcgaggtgatcggtcaactggaggaaacgctgcctgagcggatgagggaagagctcagcgccctgacaagagaaggtcaaggaggtccaggctctgtgtcagtcgacgttaagaaagtccagggagctggaggctcttctgtgacactggtggcagaggtgaacgtatctcagactgtcgatgccgatcgtcttgatctggaggagctcagtaaagatgaagcatcagagatggaaaaagcagtcgagagcgtggtaagggaatcattgtctcgacaaagatcccccgctcctggctctcctgatgaggaaggaggagccgaagcgcctgccgctggtatacgctttcgcaggtgggccacccgggagctgtatattcctagcggtgagtcagaggtggctggcggagcttcccatagttcgggacaacgcactccacaaggacccgtttcagcaacagtggaagtgtccagtcccacaggcttcgcccagagtcaggtcctcgaggacgtgtctcaggccgctagacatattaaactcggcccatcagaggtttggcgtacagagcgcatgtcatacgaggggccaaccgcagaggtggtagaaatggatgtgagcaatgtcgaagccatcagatctcgcacccaagaggctggcgctctgggggtctccgaccgaggatcctggagggacgcagactccaggaatgatcaggctgtgggagtgtcatttaaagcttctgctggagagggcgaccaagcacacagagaacagggaaaggaacaagctatgttcgataaaaaggttcagctgcagaggatggtggaccagaggagcgtcatcagtgacgagaaaaaggtggctctactgtaccttgataatgaagaagaagaaaacgatggccattggttctag

SEQ ID NO: 60035 - DNA, 4695 bp, Artificial Sequence
  Description of Artificial Sequence: Synthetic coding sequence
atgctttcatggcgcttacaaaccggccctgagaaggccgagctgcaagaattgaatgctagactatacgactacgtttgccgcgtgcgggaactggagagagagaacttgctcttggaggaagaattacgagggaggagggggagagaaggcttgtgggctgaagggcaagccagatgtgctgaggaggcaagatcactgcgacagcagctcgatgagctgtcctgggctactgcactagcagagggcgaacgggacgctttgagacgagaattgagagagctgcagagattggatgccgaggaacgcgctgccaggggcaggcttgacgccgagttaggcgctcaacaacgtgagctgcaggaagccctgggggcaagagcggctctcgaagctctgctgggaaggctccaggcagagagaagaggactggatgctgctcacgaaagggacgttcgggagctgagagcccgagcagcaagtcttaccatgcactttcgtgccagagccacagggccagcagctcctcccccacgcctgcgagaggttcacgacagctacgccttactggtggccgagagctggagagagacagttcagttatacgaggatgaggttagggagctggaggaagctttgcgtaggggtcaggagtctcgcttgcaggctgaggaggagactcgcctctgcgctcaggaggcagctctacgcagagaagcacttggcttagagcagctgcgcgcaaggttggaggacgctctcttgcgaatgcgagaggagtacggaattcaggccgaagagagacagagagtcattgactgtttagaggacgaaaaggcaacactgacccttgctatggccgactggctccgcgactaccaggatttgcttcaggtgaagaccgggttaagcctggaagtcgcaacatacagggcactgttggagggcgaaagcaatcccgagatcgtcatctgggcagaacatgttgagaacatgccgtctgagtttcggaataaaagttatcactatacagacagcctactgcagcgcgagaatgaacgcaacctcttttcacgccagaaggccccactggccagcttcaaccattcctccgcactttactctaacctcagcggccaccgaggtagtcagacaggaacatccatcggaggcgatgccaggcgtgggtttctcggatcggggtacagcagctcggctactacccaacaggagaacagctatggcaaggctgttagttctcagactaacgtcaggaccttcagtcctacatatggactactgcggaacactgaggctcaggtaaaaacattccctgaccggccaaaagccggagacacacgggaggtgcctgtgtacatcggtgaggacagtacaatcgcccgtgagagctaccgggatcggagggacaaagtagctgctggggctagcgagtcaacacgatccaacgagaggactgtgatcttaggcaagaaaaccgaagttaaagccacccgggagcaggagagaaatcgccctgaaacaatccgcacgaaacctgaagagaagatgttcgactctaaagaaaaagctagcgaggagaggaatctgcggtgggaagaacttaccaaactcgacaaagaggcccgtcagagggaaagtcagcagatgaaggaaaaggcaaaagagaaggattcaccgaaggaaaagagcgtaagagagcgcgaagttcccatcagcctcgaagtaagccaagacagaagagctgaggtgagccccaaaggcctccagactcctgtgaaagacgctggaggcggaacaggtcgagaggcagaggctcgggaactccggttcagacttggtacaagcgacgcaacaggatctctccaaggcgactccatgactgagaccgtggcggaaaacattgtcacaagtatcctcaagcaatttacgcagtcacccgagacagaggcatctgcagattcctttccagacactaaggtgacatacgtggatcgtaaagaactgccaggagaaaggaagacaaaaacggagattgtagtggagtcaaaattaacagaggacgttgacgtgagcgatgaggctgggctcgattatctactgtccaaggatatcaaggaggtgggcctcaaaggaaaaagcgcagaacaaatgattggcgatattatcaatcttggcctgaagggaagggaaggtagggcaaaggtggtcaacgtggagatcgtggaagaacctgtgtcttacgtgtctggcgagaaacccgaagagttctcagtgccctttaaggtggaggaagttgaggatgtaagccctgggccttgggggttggtgaaggaggaagagggttatggggagtccgatgtcacattctcggtcaaccagcaccggcgtactaagcaaccccaagagaatacaactcatgtagaggaggtcactgaagcaggggacagtgagggggagcagagctactttgtgagtactccggatgagcacccaggtggccatgaccgcgacgatggatccgtttacggtcagatacatattgaagaggagagtaccattaggtactcctggcaagacgagatagttcaggggacacgccgaaggacacaaaaggacggggctgtgggtgagaaagtggtcaaaccgttagacgtacccgctccaagtctcgagggtgatctcggtagcacacactggaaggaacaggcaagatctggagaatttcacgccgaacctacagtgatagagaaagagattaaaatccctcacgagttccatacctctatgaaagggatttcctccaaggagcctagacaacagctggtagaagtcatcggtcaacttgaagaaaccctgcccgagaggatgagagaagagctatccgcactgactcgtgaaggccaggggggacctgggtcagtgagcgtagacgtaaaaaaagtccagggagctggcggtagtagcgtaacactggtcgccgaggttaacgtgagtcaaaccgtggatgctgaccggcttgatctggaggagctgtctaaagacgaagcaagcgaaatggagaaggccgtcgaatccgtcgtgcgtgaatcactgtctaggcagcggagccctgccccaggctccccagacgaggaaggtggggctgaggcacctgcagctgggattcgtttcaggcgttgggcaacccgcgagctgtacattccaagcggtgagtccgaggtggcaggcggagcttcccactcatctggtcagaggacaccccaggggccagtctcagccacagtggaggtcagttctcctaccggattcgctcagagccaggtccttgaagatgtctctcaggccgctcgtcacattaagcttggaccttccgaagtatggcggactgaaaggatgtcgtatgagggacctactgctgaggtcgtggaagtctcagccggtggggacctgtctcaagcggcaagcccaacgggcgcaagtcggtccgtgaggcacgttacattagggcctggtcagagtcccttgagccgggaggtgatctttctgggacccgctccggcatgccccgaggcgtgggggtctcctgagcccggtcccgcagagagttccgccgatatggacggatctggcagacattctacttttggttgtagacaattccatgcagaaaaggagataatcttccagggcccaatctcagcggcaggcaaggtaggggactactttgcaactgaagaaagcgttgggacccaaacttctgtgaggcaattgcagctgggccctaaagaggggttctcaggacagatacagtttaccgcccctttgtctgataaggtggaacttggcgtgattggggacagcgttcacatggaaggtctccccggttcatccacaagcatcaggcacatctctattggtccacagaggcatcagaccacgcaacagatagtctaccacggccttgtgcctcagctgggcgagagcggggactctgagagcacagtgcacggggagggaagcgccgatgtccatcaggctactcattcacacacctcaggcaggcagacagtcatgacggagaagagcacgttccagtcagtggtgagcgaatctccacaggaggacagcgctgaagacacttccggtgctgagatgacaagcggggtgagtagaagttttcggcatataaggctggggcctactgaaacggaaacaagcgaacatatcgctatcagagggccagttagccgcacattcgtcctcgccggatcagccgattcccccgagctgggtaagctcgcagacagttctaggactctgcgccacatcgcccctggaccaaaggagactagcttcacattccagatggacgtaagtaacgtcgaggccatcaggtccaggacacaggaggcaggcgctcttggcgtgtctgatcgcggaagctggcgggacgccgatagccgcaatgatcaggccgtcggcgtatccttcaaagcgtccgccggtgaaggggaccaggcacatagggagcaaggtaaggagcaggccatgttcgataagaaagtgcagctgcaacgtatggtcgaccaacggtcagtgatctctgacgagaaaaaggtcgcattgctttacctcgacaacgaagaagaggagaatgatggacactggttctag

SEQ ID NO: 60036 - DNA, 567 bp, Artificial Sequence
  Description of Artificial Sequence: Synthetic coding sequence
atgaatggcgacgacgctttcgtccgacggccaagggtcggaagccagattcccgagaagatgcagaaggcttttgacgacattgccaagtacttttctgaaaaggaatgggaaaaaatgaaggcatccgagaagatcatctacgtgtatatgaagcggaagtatgaggcgatgactaagcttggattcaaagctactctacccccattcatgaggaataagagggtcgcggacttccagggcaatgacttcgacaacgacccaaacagaggaaatcaggtggagcatccccagatgacattcgggaggctgcaaggaatattcccaaaaatcactccagagaagccggctgaagagggaaatgacagcaagggagtgcctgaagccagtggtcctcaaaacaacggaaagcagctcaggccatccggtaaactgaatacctcggaaaaggtgaacaaaacatccggcccaaagcgaggcaagcatgcctggacccatcgggtcagggagagaaagcagctggtgatctacgaagaaatctctgacccccaggaagacgatgagtag

SEQ ID NO: 60037 - DNA, 885 bp, Artificial Sequence
  Description of Artificial Sequence: Synthetic coding sequence
atgaaggataggctacaggagctgaagcagcgcacaaaggagatcgaattaagtagggactcacacgtctccacaaccgaaacggaggagcagggtgtgtttctgcaacaggcagtcatctacgaaagagagccggtggccgaacgacacctacacgagatccagaaactccaggagtcaattaacaatctcgcagataatgtgcagaaatttggccagcaacaaaaaagcctcgtggctagtatgagaagattttcgctcctgaagagagaaagcacaattacgaaagaaatcaaaatacaggccgagtatatcaaccgctcccttaacgatttggtgaaggaggtcaagaaatccgaggtggaaaatggtccctctagcgtcgtgacaagaatacttaaaagtcagcacgctgctatgttccgccatttccaacagatcatgttcatttacaacgataccatcgcggcaaaacaggagaagtgtaaaaccttcatacttcgccagttggaagttgccggtaaagagatgtcagaggaggatgtgaacgatatgttacatcaaggtaagtgggaggtatttaatgagtcccttctgacggagattaacattacaaaggcacagctctcagaaattgagcagaggcacaaggagctggtcaacctggagaatcagatcaaggatttaagagatctattcatacaaatttctctcctggtcgaagaacagggagaaagtattaataatatcgagatgactgtgaacagtacgaaggaatacgtgaacaacacaaaggaaaagttcggtttggctgtaaagtataaaaagagaaatccctgcagagtactgtgttgttggtgttgtccctgttgctccagtaagtag

SEQ ID NO: 60038 - DNA, 393 bp, Artificial Sequence
  Description of Artificial Sequence: Synthetic coding sequence
atggagactgttgtgaccacccttcctagggagggtggagtgggaccctctcgtaagatgttgctgctactgctgctcttaggcccaggaagcggtctttctgcagtagtgagtcagcacccatcccgcgtgatatgcaagagcggaaccagtgtgaatatcgagtgccggagtctcgactttcaggctaccacaatgttttggtataggcagctgaggaagcaatctctgatgctgatggccaccagcaacgagggcagtgaggttacatatgagcagggcgtgaaaaaagacaagtttccaatcaaccacccgaatctcacattcagtgcattaactgttacctccgcccaccctgaagactccagcttctatatctgttctgcccgatag

SEQ ID NO: 60039 - DNA, 345 bp, Artificial Sequence
  Description of Artificial Sequence: Synthetic coding sequence
accggaacgaggctgttaggatgggtcgcactgtgtctgctggccgcaggatgcttccacgctaaggttacccagactcctggatatctcgtgaaaggtaagggccgaaagacaaaaatgtactgcactcccaagaacggacatacattcgtatgttggtaccagcagaatcaaaacaaggagtttatgttcctgatctcatttcaaaacgagcaggtactccaagagatggaaatgcataaaaagcgatttagctcgcaatgtcccaagaaccctccttgcagccttgcaattctatcatctgagccaggtgacactgccttatatctgtgcgcaactagctag

SEQ ID NO: 60040 - DNA, 339 bp, Artificial Sequence
  Description of Artificial Sequence: Synthetic coding sequence
atgaccattcggttcctcagacaagtcgccttttactttcttgaggcaggcttgaaggaggcggagatttatcaaaccccacggcatcgcgttatcggcgcagggaagaagataactcttgagtgtagccagaccatgggccatgacaaaatgtactggagtaggagtcgaaacgggattactcctcatcctcccttcctctgggtcaatagtacagaaaagggggatctgtgttcagagagcacggtgtctagaattagaatcgagcgctttcccctcacccttgagtccgcgtccccgtctcatacaagtcaatacctatgtgcctcgtccgaatag

SEQ ID NO: 60041 - DNA, 525 bp, Artificial Sequence
  Description of Artificial Sequence: Synthetic coding sequence
atggctgacgctgccgctacagctggcgcaggagggagcggaactaggagtggctcaaagcagtccactaaccctgccgataactatcacctggccaggcgcaggaccctgcaggttgtcgtgagctccctcttaactgaagctggcttcgaatctgccgaaaaggcaagtgtcgaaacacttactgaaatgctgcagagttatatcagcgagattgggagatccgctaaaagttactgtgagcatacagctcgaacacagcctacactctctgacatcgtggtcactcttgtagaaatgggtttcaatgtagacactctgccagcatatgctaaacgttcccaacgcatggtcataaccgctcctcctgtaactaaccaacccgtgacacctaaagccctgaccgccggtcagaatagaccacatccccctcatataccttcccattttcccgagtttccggatccacacacatatattaaaacccccgtgtccgatgaggcgctaggactgcgcgttgtgtag

SEQ ID NO: 60042 - DNA, 1017 bp, Artificial Sequence
  Description of Artificial Sequence: Synthetic coding sequence
atggctgatgcggctgcaactgcgggtgccggaggttccgggactcggtcgggctcaaaacagtcaactaacccagcggacaattatcacctggccaggagaaggacactccaagtagtggtcagctcattgttaaccgaggctggattcgagagcgcagagaaagcaagtgtagaaaccctcaccgaaatgctgcagtcctacatcagtgagattggacgcagcgcaaagagctactgcgagcacacggctaggactcagccaaccctctccgatatcgtagtgacattagtggagatgggctttaacgtggacacactgcctgcctacgcaaaacgtagccagagaatggtgattacagctccaccagtaaccaatcagcccgttaccccgaaagctttgaccgctgggcagaatcgaccacatcctcctcatataccttcgcattttccggaattcccagatcctcacacatacataaagacaccaacttatagagagcctgtgtcggattaccaggtgcttcgggagaaggccgctagccaacgtcgggacgtagaaagagctctgaccagattcatggctaaaacaggggagacccagagtctcttcaaagacgacgtttccacattcccactgatcgctgccaggcctttcactattccatatttaactgccctgttgccctctgaattagaaatgcaacaaatggaagaaacagactcctcagagcaagacgaacaaaccgacaccgagaacctggccctccacatatctatgatcgaatcgcgcagcgtaacacaagctggtgtgcagtggcaagacctcggaagtttacaacccccacctcccggattcaagagattcagctccctgagtctgttatccagttggaactacaggcgcatcctcgagcccagaagaaggacgccgctatcttgcagcaggacccctccgtgccgggttgccggaatggggagaagaacaagctccatcaccttgatttgtggccgttag

SEQ ID NO: 60043 - DNA, 936 bp, Artificial Sequence
  Description of Artificial Sequence: Synthetic coding sequence
atggccgatgcagcagcaaccgcaggtgcaggaggttcaggcactagatccgggtccaagcagtctaccaatcccgctgacaactatcaccttgcacgccgacgcactctccaggtggtcgtttccagccttttaaccgaagccggattcgagtcagctgagaaggctagcgtcgaaaccttaacggagatgctacagtcttatatcagcgaaattggacggagcgctaagtcctactgcgaacacactgccagaacccaacctaccctgtctgatattgttgtgacccttgtagaaatggggtttaacgtcgacacgctccctgcttacgccaagaggagccaacggatggtgattaccgcccctcccgtgaccaaccaaccagtgaccccaaaggctctaaccgccggacagaacagacctcaccccccacacattcctagccattttccagagttcccagatccacatacttacatcaaaacgcccacatacagagaacccgtgagtgactaccaggtgctccgcgaaaaggcagcgagccaacgcagagatgtggagagagccctgaccagatttatggccaaaactggtgaaactcagtcgctgtttaaggatgacgtgtctacctttccattaatagctgctcggccttttacaatcccatatctgacagctcttctccccagtgagctggagatgcagcagatggaagaaacggactcatcagaacaagacgaacaaaccgacacggagaaccttgccctgcacatatctatggaggatagtggagcagagaaggagaatacaagcgtgctgcagcaaaatccaagcctttccggaagcaggaatggggaagagaatatcattgataatccttatctccggccagtaaaaaaacctaagatccgcaggaagaagcctgacaccttctag

SEQ ID NO: 60044 - DNA, 1017 bp, Artificial Sequence
  Description of Artificial Sequence: Synthetic coding sequence
atggccgatgcagccgcaactgcaggggcaggcggatctggcaccagatctggaagcaagcagtctaccaaccctgccgacaactatcacctggcgagacggagaactctgcaggtggtggtcagctctcttctgacagaggccggattcgaatctgccgaaaaagcaagtgtagagaccctcactgagatgctccagtcttatatttcagagatcggtagatccgccaaatcctactgcgagcacacagctaggacccaacctaccctttccgatattgtcgtgacgctggttgagatgggattcaacgtcgacacactgcccgcatacgctaagaggagtcagcggatggtgataactgcacccccagtcaccaatcaacctgtgaccccaaaggcattaacagccggtcagaatagaccacacccaccacacattccttcacactttcctgagtttcccgacccgcacacttatatcaagacccctacttatagggagccagttagcgactaccaggtgctgcgggaaaaggccgcaagccagcgaagggacgtggaaagagctctgactcggtttatggctaagaccggcgagacccagtcactgtttaaggacgatgtttccactttccctcttatcgccgctaggccattcaccatcccctacctgacggcccttctacccagtgagctggagatgcagcaaatggaagagacggacagctctgaacaggatgagcagacggatactgagaatctcgccctgcatatctctatgatcgagagtcggtccgtcacacaggctggcgtgcagtggcaagaccttggttcacttcagccacccccaccgggattcaagcggtttagcagtttgagcctgctgtcgagctggaattacaggcgtatcctggagccgcgacggaggactcctctgtcttgctctcgcactccgccttgccgagtcgctggtatgggaagaagaacgtcctctatcactctcatatgcggcaggtag

SEQ ID NO: 60045 - DNA, 795 bp, Artificial Sequence
  Description of Artificial Sequence: Synthetic coding sequence
atggagagtggcaagaccgcaagccctaagtccatgccaaaagatgcccagatgatggctcagatactgaaggatatgggcataaccgagtatgagccacgagttattaaccagatgttggaatttgcttttaggtatgtcaccacgatactcgatgatgccaagatctacagtagccatgctaaaaaggccactgtggatgcagatgacgttaggcttgctattcagtgtagagcagaccagtcttttacctcccctcccccaagagattttcttctggacattgcacggcaaaggaaccagacacccctgccccttattaagccatatagtggtcccaggctgccacccgaccgatattgtctgactgccccaaattatcgccttaaatctcttcaaaagaaggcaagcacaagcgccggtaggataaccgtcccgagactttccgtgggatctgtgacttctcgcccatctactcctaccctggggactccaactccacagaccatgtcagtgtcaacaaaggtgggcacccccatgtctttaaccggccagcgtttcaccgttcagatgccaaccagccagtcaccagcagtgaaggccagtataccagccacttccgccgttcagaacgtgctaataaatccgtctttgattggttcaaagaatattttgattaccaccaatatgatgtctagtcaaaataccgctaacgaatcatctaacgccctcaagcgaaaacgcgaggatgatgatgatgacgacgatgacgatgatgattacgacaatctgtag

SEQ ID NO: 60046 - DNA, 1374 bp, Artificial Sequence
  Description of Artificial Sequence: Synthetic coding sequence
atggagtttctgttagggaaccccttctcaactccagtggggcagtgcctggagaaagcaaccgatgggtccctccaatctgaggattggacgctcaatatggaaatttgcgatatcatcaacgagactgaagaggggccaaaggacgctattagagcacttaagaaacgcctgaacggcaatcggaactaccgggaggttatgctcgcactcacagcctgggctgatgctttcaggtccagtcccgatctgaccggtgtcgtgcacatttacgaagaactgaagcggaagggggtggagtttcctatggcagacctggatgccttgagcccaattcacacgccccaacgttcagtgcccgaggttgatcctgccgctactatgccacggtctcagagccagcagagaacctccgctgggtcctacagcagccctccccctgccccatactcagctccacaggcccctgctctgtccgtgactggacccataaccgccaatagcgaacaaattgcacgcctccgatctgagcttgatgtcgtgaggggaaacaccaaagtgatgagcgaaatgctgaccgagatggttcccggacaggaggatagcagtgatctggagcttctgcaggagctcaataggacctgtagggcgatgcagcagagaattgttgagcttatatcccgggtgtcaaatgaggaggtcacagaggaacttctgcacgtcaacgacgatctgaacaacgtgtttctaaggtacgagcggttcgaacgatatcgaagcgggagatctgtgcagaacgcaagcaacggcgtcctgaacgaagtgacagaggataacttgatcgacctgggccctggatctcctgctgtcgtatcacccatggtgggaaatacagcacctccctcttctctgagttcccaattagctggcttggaccttgggacagaatcagtgtcaggcactctgtcttctttgcaacagtgtaatccgagggatggctttgacatgtttgcccagactagggggaatagcctggctgaacagcgcaagacagtaacgtatgaagatccccaagcggtgggagggctggcatctgccctggacaaccgcaagcaatctagtgaaggaatccccgtcgcccaaccatccgtgatggacgatattgaggtttggctcaggactgatttaaagggcgacgacctcgaagagggcgtgacaagtgaggaattcgataagttcctggaggagcgggctaaggccgctgagatggtgccggacctgccctctccccctatggaggctcctgcgccagcttctaacccatccggcaggaaaaagcctgagaggagcgaggacgcactgttcgccttgtag

SEQ ID NO: 60047 - DNA, 1524 bp, Artificial Sequence
  Description of Artificial Sequence: Synthetic coding sequence
atggagttcctgctggggaatcccttcagcaccccagtcggccagtgtctggaaaaagccaccgatggctctctacagagtgaagattggacactcaatatggagatatgtgatataatcaacgagaccgaggaaggccctaaagacgccatcagggcattaaagaagagacttaatggaaacaggaattatcgcgaggtgatgttggccctaacggtgctggagacatgtgttaagaattgtgggcatcggttccacattcttgtggccaaccgggacttcattgactcggtactggtgaagatcatcagtcccaaaaataatcctcccacgatcgttcaggacaaggtcctcgcattgattcaggcttgggctgatgcgttccgatcctcaccagacttgaccggagtcgtgcacatttatgaggagcttaagaggaagggtgtcgagtttcccatggctgacctcgatgccttatcccctatacacaccccacagagaagcgtgccggaggtggatcccgctgctacgatgcccagaagccaatcccaacaacggaccagcgccggttcatacagttcacctccccctgccccttattctgcaccgcaggctccagccctgtcagtcacaggccctatcacagccaactccgaacagatcgctaggctacggtctgagctggacgtcgtaagaggaaataccaaagtgatgtccgagatgctgaccgaaatggtccctgggcaggaggattcttccgacctggagcttctccaggagttgaaccggacatgtagggccatgcagcaacggatcgttgaactgatcagtagagtgtcgaatgaggaggtgacagaagagcttctgcacgtgaacgatgacttgaataatgtgtttttaaggtatgagaggttcgagcggtatagaagcggaaggagtgttcagaatgctagcaacggagttctgaatgaggtgactgaagacaatctgatcgatctaggccctgggagccccgcagtggtgtcccccatggttggaaataccgccccaccaagtagcctgtcgtctcagctggctggcctcgatttgggcaccgagagcgtgagcggcaccctcagctcccttcaacagtgcaatccaagagatggattcgacatgtttgcgcagaccagagggaacagcttagcagaacagcgcaaaaccgtaacgtacgaggacccccaggccgtgggcggactagcctccgcactcgacaataggaaacagtcatctgaaggcattccggtggcccagccttctgtaatggacgatatcgaggtttggctaaggaccgacctgaagggcgatgacctcgaagagggagtgacatccgaggagtttgataaatttctcgaggagcgagcaaaggctgccgagatggtcccagacctgccaagcccgccaatggaggccccagccccagccagtaatccatcaggcaggaagaagcctgagcggagtgaggatgctttattcgccctgtag

SEQ ID NO: 60048 - DNA, 1389 bp, Artificial Sequence
  Description of Artificial Sequence: Synthetic coding sequence
atggaattccttctggggaatcccttcagcacccctgtgggtcagtgtctcgagaaggccacagatggctcattgcagagcgaggattggaccctcaacatggagatttgtgacattatcaatgagactgaagaaggacctaaagatgcaatacgggctctcaagaagagactgaatggaaacaggaattacagagaagttatgttagctctgaccgtgctggagacttgtgtgaagaattgcggccatcgattccatattctggtcgctaatagggacttcattgattctgttctcgttaaaataatctcacccaagaacaacccacctaccattgtacaggacaaggtgctggcccttatacagtctgtgcctgaagttgaccccgcagcaacaatgcctcgctctcagagccagcaaagaactagcgcaggctcctactcttccccaccacccgcaccttattctgcgcctcaggcccctgccctgtccgttactggaccaattactgccaacagtgagcagatcgccagactgagatctgagctggatgtggtgagggggaacactaaagtgatgagcgagatgctaaccgagatggtccctggccaggaagactcttctgacctggagctcttgcaggaactcaatcgcacttgtagggcaatgcagcagaggatcgtggagctcatttcccgtgtgagcaacgaggaagtgacggaagaactgttgcatgtgaatgacgacctaaataatgtcttcctgagatacgaacgattcgagaggtatcgcagcggcaggtcggtgcagaacgcctcaaacggcgtcctgaatgaagtgactgaagacaacttaatcgacctgggtcccggttccccggctgttgttagtcctatggtcggcaatactgcaccgccatcctccttgtcaagccagctggcgggtctcgatctagggaccgaaagcgtctcaggcacactctcttcattgcagcaatgtaatcctcgcgacggcttcgacatgttcgctcagaccagaggaaattcattggcagagcagaggaagaccgtgacctacgaagatccccaggccgtgggcggtttagcgagcgctctggataaccggaagcagtcatctgagggcatccccgtagcacagcctagcgtgatggacgatatcgaggtgtggctgcgcacagatctgaagggcgacgatctggaggagggagttacttctgaggagtttgataaatttctcgaagagagggccaaggccgcagagatggttcccgacctgccatctccgccaatggaagcaccagccccagcatccaatccctccggcaggaaaaaacccgagcgttccgaggacgcattatttgcactctag

SEQ ID NO: 60049 - DNA, 1452 bp, Artificial Sequence
  Description of Artificial Sequence: Synthetic coding sequence
atggagttcctgttgggcaaccctttttctacgccagtggggcagtgtctcgagaaagcaacggatgggtccctgcagtcagaagactggacgctcaatatggaaatttgcgacataatcaatgagaccgaggaagggccaaaggacgcgatacgggctctgaagaaaagattaaatggcaatagaaactatcgagaggtgatgctcgccctaactgtgttagagacctgcgtcaaaaattgcggtcataggtttcatatccttgtggccaaccgcgactttatcgacagcgtcttggttaagattatttcccctaagaacaacccgccaacgattgtccaagacaaggtcctcgccctgattcaggcctgggcggatgcattcagatcttccccagatttaactggcgttgtgcatatttacgaggagctgaaacggaagggggtcgaattccctatggccgatttggacgctctgtcccccattcatacaccgcagcgcatcgctcgtctgagatctgagttagatgtggtacgaggcaacacgaaagtgatgtccgaaatgctgactgagatggtgccagggcaggaggactcgtcggatctcgaattactgcaggagctgaaccgcacctgtagagcaatgcagcaaaggatcgtcgagctaataagcagagtgtccaatgaggaagttaccgaggaactccttcatgtaaatgacgatctgaacaacgtgtttttaaggtacgagcgtttcgagaggtaccggtctgggaggagtgtgcagaacgccagcaacggagtgttgaacgaggtgacagaggacaatctgattgacctgggccctggctctcctgccgtggtatccccaatggtgggtaacaccgcccctccttcatctctctctagccagctagccggtctggacttaggcaccgagtccgtaagtgggactctctcttctcttcagcagtgcaatcctagggatgggttcgacatgttcgcccagactaggggaaatagcctggctgaacaaagaaaaacagtaacttacgaggacccccaagcggtggggggtctcgcaagtgccctggacaaccgcaagcagagcagtgaaggaactttcctgtccagcgcccagaaacgcggacgcggaggtgaaagtgacctggaaccaatcgactcatggctcatcactcagggcatgattcccgtagctcagccctcagtgatggatgacattgaagtctggttaagaaccgatctgaagggagatgatctggaagaaggagtcaccagcgaggagttcgacaagtttttagaagagagggccaaggctgcggaaatggtccctgacttgccatcccccccaatggaagctcctgcaccagcgtcaaacccatcaggcagaaaaaaacctgagcggtctgaagacgcccttttcgcactgtag

SEQ ID NO: 60050 - DNA, 834 bp, Artificial Sequence
  Description of Artificial Sequence: Synthetic coding sequence
atggagttcctgcttggcaatccatttagtactcccgtcggacagtgtctagagaaggctaccgacggctctctgcaaagcgaagactggacactcaatatggagatatgcgacatcatcaacgagaccgaagaaggtcctaaggatgctattagagccctgaaaaagaggctcaatgggaaccgtaactaccgcgaggtcatgcttgcactgacagcttgggctgacgccttccgttcttccccagacctcaccggcgtagtgcacatttatgaagaactgaagagaaaaggggtggagttccccatggctgatctggatgcactcagtccaatccatacccctcagagatccgttcctgaggtggatcccgcagccaccatgccacgcagtcaatctcagcaaagaacctctgcaggaagttactcatcacctcctcctgccccttattctgcaccccaagccccagctttgtctgttaccggccctataaccgcaaactccgagcaaattgcccgtctgcggtccgaactggacgttgtgagagggaatacaaaagtgatgagtgagatgctcacagaaatggtgccaggtcaggaggattcttccgacctggagctgctgcaggaactcaaccgaacgtgcagagctatgcagcagcgaattgtggaactgatcagtagggtctccaatgaggaagtaaccgaggaattactgcacgtcaatgacgaccttaataatgtgttcctgagatatgagcgttgggaacctgactttttcttcttttttttcctggagaagattgttgccattactgaaggctttctttcctag

SEQ ID NO: 60051 - DNA, 1170 bp, Artificial Sequence
  Description of Artificial Sequence: Synthetic coding sequence
atggaattcctccttggaaatcctttcagtactcccgtcggccagtgtctggaaaaagcaaccgatggttcattacagtctgaggactggaccctcaacatggaaatttgcgatatcatcaacgagaccgaggaaggcccaaaagacgccatacgcgctctaaagaagcggcttaacggaaaccgtaactaccgcgaagtcatgctggcgctgacagttcttgaaacctgcgtcaagaattgtggacaccgcttccacattttggtagccaatagggatttcatcgattccgtgttagtgaagataatatctcccaagaacaatccacctacaatcgttcaggacaaagtgctagccctaattcagattgcacgactgcggtccgagctagacgttgtgaggggaaataccaaagtgatgagcgagatgctcacggagatggtgccaggccaagaagactctagcgacctggagcttttgcaggagctgaatagaacctgccgggcaatgcagcaacgcatagtggaactcatatcaagggtgtccaatgaggaagttactgaagagctgctccacgtaaatgatgacctgaataacgtgttcttaagatacgagagattcgaacggtatcgctctggacgctccgttcaaaacgcatccaatggggttctgaacgaagtgactgaggacaacctcatcgaccttggcccaggatctcccgcagtggtatcgcctatggtgggaaatacggccccaccaagctcactgagttcccaactggccggattagacttgggcactgaatcagtctctggtacacttagctcattgcagcagtgcaatccaagggacggatttgatatgtttgcccagacacgcggaaactccctggccgaacagcgtaaaacagtcacctacgaggatccacaagcagtgggagggttagcctcagctctggacaaccgaaagcaaagttccgagggcaagggggatgatcttgaggagggtgttaccagtgaggagttcgacaaattcctggaggaacgagcaaaagctgctgagatggtccctgacttaccatcccctccaatggaggctccggcacctgcatccaatccttcaggacgcaagaagcctgaaagatctgaggatgcattatttgctttatag

SEQ ID NO: 60052 - DNA, 1167 bp, Artificial Sequence
  Description of Artificial Sequence: Synthetic coding sequence
atggaatttttgctaggtaatccttttagtacgccagttggacagtgcctggaaaaggccaccgatggaagcctgcagagcgaagattggactctgaacatggagatttgtgatataatcaacgaaacagaagagggtcccaaagatgccattagggccctgaagaagcgactgaatggcaacaggaattaccgtgaggtaatgttggctctaacgatcgccaggctgaggtctgagttggatgtagtcagggggaacaccaaggtcatgtctgagatgttgaccgagatggtaccaggtcaagaggattcgtcagacctcgaactacttcaggagctgaataggacttgccgagcaatgcaacagaggatagtcgaactgatctccagagtttcaaacgaggaggtcactgaggagctgctccacgttaacgatgaccttaataatgtattcctgagatacgagcgatttgagaggtaccgctcaggcagaagcgtgcaaaacgccagcaatggcgtcctgaacgaggttaccgaggacaatctcatcgacttgggacccggtagtccggctgtagtctcaccgatggtgggcaataccgctcccccaagctcacttagcagtcagcttgcaggcctggacctgggcaccgaatccgtctccggtaccttgagtagcctgcagcagtgcaatcccagggacggctttgatatgttcgcgcagacccggggtaactcgctcgcagagcagagaaagaccgttacctacgaagatcctcaagcagtgggcggactagcttcagctctcgacaatcgcaagcagtctagcgagggcacgtttctttcgtccgcgcaaaaacgaggcagaggcggagagtcagacctggagcccatcgatagttggctgatcactcagggaatgatcccggtcgcacaaccgtcggtgatggatgacatcgaagtttggctgagaaccgacctgaaaggcgacgacttagaggagggggtgacctccgaggaatttgacaagtttctcgaagaacgagccaaggccgcagagatggtgcctgatctgccttcaccacctatggaggccccagcccctgccagcaatccaagtggcagaaagaaacccgagcgctcagaagatgctctgttcgctctttag

SEQ ID NO: 60053 - DNA, 1374 bp, Artificial Sequence
  Description of Artificial Sequence: Synthetic coding sequence
atggagttcctcctcgggaatccgttcagtaccccagtgggccagtgcctggaaaaagccacggatggctcactgcagagcgaagactggacactcaatatggaaatttgtgatattatcaacgaaaccgaggagggccctaaggatgcgatccgggctctcaagaagcgccttaatggaaataggaactatagagaagtgatgctggctctgaccgcctgggctgatgctttcagatcaagccccgatctgacaggtgtagtgcatatctacgaggaactgaagaggaaaggagtcgagttccctatggccgatcttgacgccctcagccctattcacaccccacagcgctccgtgccagaggtggaccctgccgcaactatgccacggtctcaatctcagcagaggacttccgctggttcctacagcagccctccacctgccccttattcagctccccaggccccagctctgagtgtcaccgggcctatcacagccaacagtgaacagatcgctaggctgaggtccgagctggacgtggttcgtggcaacacaaaagtgatgtccgagatgctcactgagatggtcccaggccaggaggactccagcgacctggaattattacaggagctgaaccggacctgcagggctatgcagcagcgcatcgtggagctgatttccagggtctctaatgaagaggttaccgaggaactactccatgttaatgacgatctcaacaacgtgttcctgcgttacgagcgtttcgaaaggtaccgatccggtaggtcggtgcaaaacgcttccaatggagtgttgaatgaagtgacagaagacaacctcatcgaccttggacccggaagccctgcagtagtctcacccatggtgggcaatacagcgccaccatcgtcgctgagctcgcagctcgctgggcttgatctaggaacagaatcagtgtctggtactctatcctcactgcaacagtgcaaccccagggatggctttgacatgttcgcacaaactagagggaacagtctggccgaacaacggaaaaccgtgacctacgaagatccccaagccgtgggaggactcgcttctgcacttgataatcggaagcagtccagtgagggcattcctgtggctcaaccatctgttatggatgacattgaggtgtggctgcgaactgatcttaagggagacgatttggaagagggggtgacatcagaagagttcgataaattcctggaggagagggctaaagcagcagagatggtccccgaccttccttctccacccatggaggcacctgctccggctagtaatccatcgggcagaaagaaaccagaacgttccgaggacgctttattcgccctgtag

SEQ ID NO: 60054 - DNA, 2571 bp, Artificial Sequence
  Description of Artificial Sequence: Synthetic coding sequence
taatgcacaaatgaggccttggtggacgagataatgatgacccttaagcaggcgttcaccgtcgctgccgtgcagcagaccgcaaaggcacccgcacagctttgtgaaggatgccctctgcaatcactacacaagttgtgtgaaaggatcgagggcatgaattcctcaaagacaaagctcgagctgcagaagcacctgaccacgctgacgaatcaggagcaggctacgattttcgaagaggtgcagaaactgcggccaagaaatgagcagcgagaaaacgaactcatcatcagctttttgcgttgtctctatgaagaaaagcaaaaggagcatatacacattggggagatgaaacagacatcccaaatggccgcagagaacattggatccgagctgccccctagcgccacgaggtttcgtctcgatatgctgaaaaataaggccaagaggtcactgactgaatccttggaatcaattctgtctaggggaaacaaggcaaggggcctgcaagaacattccatatcagtagatctcgacagctctctgagttctacactgagcaatactagtaaggaacccagcgtgtgcgagaaagaggcactgcccatctccgagtcttcatttaaacttttgggatcgtccgaagatctgtcatccgactctgaatcacacttacccgaagagcccgcaccactgagcccccagcaggcctttaggcggcgtgccaacacgttatcccactttccaattgagtgtcaggaacccccacagcccgcaagaggcagccctggagtttctcagcgaaagcttatgcgctatcacagcgtgagcaccgaaactccccacgagcgaaatatttcctacagaaacgctctacggaagaagctgcatagctcctctagcgtccccaacttcctgaaattcttggcacctgtcgacgagaacaacaccagcgattttatgaacaccaagagggacttcgaatccaaagccaatcacctcggtgactctggtggtacccctgtcaaaacacggcgacactcttggcgccaacaaattttcctgagagtggccaccccccagaaagcatgcgactcaagtagcaggtatgaggattatagcgagcttggcgagctaccccctaggtcccccctggagccggtttgtgaggacggacctttcggaccccctcctgaagagaagaaacgcactagccgggagctgagggagctttggcagaaggccatactacagcaaattttgctgttgcgaatggaaaaagaaaaccagaagctccaagcttccgagaatgatctgctgaacaaaaggcttaaactggactacgaagagatcaccccctgtctaaaggaggttacaaccgtgtgggaaaagatgctgtcaacaccaggaaggagcaagataaagtttgacatggagaagatgcacagcgccgtgggtcagggtgtgccacggcaccatcggggtgagatatggaagttccttgccgagcagttccacctgaagcaccagttcccaagtaaacaacagcccaaagacgtcccttacaaggagctgctcaagcagctcacctcgcagcagcacgccattctgatcgacctgggcaggactttcccaacacatccctatttttcggcgcagctaggcgcagggcaactcagcctctacaacattctgaaggcctatagtctgctagatcaggaagtcggctattgccagggactatcttttgttgccggaatcctcctgcttcacatgtccgaagaagaggcttttaaaatgctaaagtttctgatgttcgacatgggcctgcgaaagcagtacagaccagacatgattatcctgcagatccagatgtatcagctgagcaggctgctgcacgactaccacagagatctctacaaccatctcgaagaacacgaaataggcccatcactttatgcagccccttggtttctgacaatgtttgcgtcacaattccccttgggcttcgtggcacgcgtctttgatatgattttcttgcaggggaccgaggtgatcttcaaggtggccctgagtctacttgggtctcacaagcccctgattctgcaacacgagaacttggaaaccatagttgactttatcaagtcaacacttccgaatttaggcctggtgcaaatggaaaagaccattaaccaggtgttcgagatggacatcgccaagcagctacaggcctatgaggtcgaataccacgttctgcaggaggaactcatcgacagttcacctctgtcggataatcagagaatggataaactagagaaaaccaacagctccctgaggaagcagaatttagacttgctggaacagttacaagtggctaacggaagaatccaatcactggaggcaactatcgaaaagctcttgagctcagaatcaaaactgaagcaggcaatgcttactctggagctcgaacggtcggccctcctacaaaccgttgaagaattaagacgcaggtccgctgagcccagtgatcgcgagccggaatgcactcagccagagccaactggtgactag

SEQ ID NO: 60055 - DNA, 2682 bp, Artificial Sequence
  Description of Artificial Sequence: Synthetic coding sequence
atgtttcctcttaaagacgccgaaatgggcgcatttacgtttttcgccagcgctctgcctcatgatgtgtgtggctcaaatggcctgcctctgacgccgaattcaattaaaatcttaggcagatttcagattttgaagacgataactcacccccgactgtgccagtatgttgacatatctcgaggcaaacatgagaggctggtcgtggtggcagagcactgcgagagatcccttgaggatttattgcgggagcgaaaacccgtgtcctgcagtaccgttctgtgcattgcatttgaggtgcttcagggccttcagtacatgaacaaacacgggattgtgcatagagctctcagtccacataatattctgctggaccgaaaaggccacattaaactggctaagttcggcttgtatcatatgacagcccatggcgacgacgtggactttcccattggatacccgtcttacctggcacccgaggtgattgcccaaggtatattcaagacaactgaccatatgccctccaaaaagcctttaccctcgggtcctaaaagcgacgtttggtcactcggcataatcctgtttgagctgtgcgtgggtcggaagttatttcagagtttggacatatcagaacgcttgaaattcctcctgaccttagattgtgtggacgacacactcatcgtcttggccgaggagcacggctgtcttgacattatcaaagagcttcccgagaccgtaatcgacctcctgaataaatgtttgacctttcatcctagcaagcgcccaactccagaccagttgatgaaggacaaagtgttctctgaggtctctccactttatactccatttactaagcctgcctcactgttcagctccagcctccgatgcgccgacctcacactgcctgaggatattagccagctctgcaaagacattaacaacgactatctggcagagcggtctatcgaagaagtgtattatctctggtgcctcgcgggaggtgacctcgagaaagagctggttaataaggaaataattagaagcaaacccccaatttgcactctccctaatttcctgttcgaggacggcgagagctttggacagggtagagacagaagctccttactggacgatactactgtaactctgagtttgtgtcagctgcgcaaccgactgaaggacgtgggcggagaggccttttatccactcctcgaagatgatcagagtaatttgccacacagcaactccaacaacgaattgtcagccgcagccacattaccactcatcatcagagagaaagataccgagtaccagttaaataggatcatcctattcgacagactacttaaggcatacccctataagaagaaccagatctggaaggaggcccgagtggacatcccgcctttgatgaggggtcttacttgggcagcgctcctcggcgtggagggcgctatccatgcaaagtacgacgcaatagataaggatacaccgattcccaccgacaggcagatcgaagtagatatccctagatgccaccagtatgatgagctgctcagttctcccgaagggcacgccaaatttcggagagtgctgaaagcgtgggttgtttctcaccccgacttagtgtattggcaagggctcgattcattgtgcgcccctttcctctatctcaatttcaataatgaagctttggcatacgcctgtatgtcagccttcattcctaagtatctctataatttcttccttaaggataactcccatgtcattcaagagtatttgacagtcttctcacaaatgattgcttttcacgaccccgagctttcaaaccacttgaacgagataggatttatccctgacttgtatgccatcccatggttccttactatgtttacgcacgttttcccccttcacaagatcttccacctctgggacactctcttactcggaaactccagcttcccgttttgcattggcgtagccatcctgcagcaattgagggaccggctcctagcaaacggattcaacgagtgcatcctcctttttagcgacctgccagagatcgacatcgaacgatgtgtaagagagtctataaacctattttgctggactccgaagtctgccacatataggcaacatgcccagccccctaagccgtcaagtgactcctcaggcggtcggagtagcgccccttatttctctgccgaatgccctgacccgcctaagaccgacctttccagagagtctatccctttaaatgatctgaagtccgaagttagtcccaggatctcagctgaggacctgattgatctgtgtgaactaacagtgactggccattttaaaaccccttccaagaaaaccaagtcttctaaacccaagcttctagtggtggacattcggaacagcgaggactttattcggggtcatatctccggcagcatcaacatcccattttccgctgcttttaccgccgagggggaactgacccagggtccatacaccgccatgcttcaaaacttcaaaggaaaggttatcgtgatagtcggtcatgtggctaagcataccgcggagtttgctgcacatctggtcaagatgaagtaccctcgtatatgcatcctggacggtggaataaacaagattaagcccaccggcctcctgacaattccaagcccgcagatctag

SEQ ID NO: 60056 - DNA, 2493 bp, Artificial Sequence
  Description of Artificial Sequence: Synthetic coding sequence
atgttcccgctgaaggatgcggagatgggcgctttcaccttcttcgctagtgctctccctcatgacgtgtgtggaagcaacggacttccacttacccccaacagcatcaaaatcctgggcagatttcagattctcaaaacaatcacccatccaaggctatgccagtatgttgacatatcaagggggaaacatgaacgactggtcgtagtagctgagcattgcgagaggtccctggaggacttgctgagggagcgcaagcctgtcagatacccttcatacctcgccccagaagtcatagctcagggtatattcaaaaccacagatcacatgccttcaaaaaagccactcccaagtggccctaagagtgacgtgtggtccctcggtatcattctgtttgagctttgcgtgggcaggaagctgttccagtcccttgatatctctgaacggctgaagttccttctgacactcgactgtgtagatgacacattgattgtgctcgcagaggaacacggctgcctcgacataatcaaggagctgccagaaaccgtcatagatcttttgaacaagtgtctcacgtttcaccctagtaagcgaccaactccggatcagttaatgaaagacaaggttttttcggaggttagcccactgtacaccccctttaccaagcccgcatccctgttttcttcatctctgaggtgcgctgacttgacgctgcccgaggatattagccagttatgcaaagacatcaacaacgactacctggccgagaggagtattgaagaggtttactacctttggtgcctcgccggtggggacctagaaaaggaattagtgaataaagaaatcatccggtctaaaccacccatttgcacgctacctaattttttgttcgaggacggtgagtcctttggtcaggggcgtgacaggtcaagcctccttgacgacaccacagtgaccctgtctctgtgtcaactgcgaaacaggctcaaagacgtggggggtgaagcattctacccattgctggaagacgaccaatctaatctgccccattccaactcaaataatgagctgtccgctgccgcaactctgcccttgatcataagagaaaaagatactgaataccagcttaatcgcatcatcctttttgatcgcttgttgaaagcttatccttataagaaaaaccagatctggaaagaagcgagggtcgatatccctcccttaatgcgcggtcttacttgggccgctctccttggcgtggaaggtgcaatccatgccaaatatgatgcaattgacaaggacacgcctatacccacagatcggcagattgaggtcgacattcccagatgccatcaatacgatgagctcttaagttctccggagggccacgccaaatttcggcgagtactgaaggcctgggtggtgagccaccccgaccttgtctactggcagggactggactctctctgcgccccttttctgtacctgaattttaataacgaggccctggcctacgcctgcatgtcagcctttattccaaaatacctgtataatttctttctgaaggacaatagccacgtgattcaggagtacctcacagtcttctcccaaatgattgctttccacgacccagaattgtctaatcacctgaacgagatcggctttattccggacctctatgccatcccttggtttttgacgatgttcacgcatgtgtttcctttgcataagattttccatctctgggacacattgctcctcggcaactccagcttcccattttgcattggtgtggctatcttgcagcagctgcgtgaccggttacttgcaaatggcttcaatgagtgcatcctgctcttttccgacctcccggaaattgacatcgaacggtgtgtccgggaatccattaatctattttgttggactcctaaaagcgcaacatacagacaacacgctcaaccccctaaaccttcatccgattctagcggcggtcggagttctgcaccatatttctcagctgagtgccccgatccacccaaaaccgatctctccagagaaagtatccctctgaatgacctcaagtcagaagtgtctcccaggatttctgccgaagacctgatcgacttgtgcgaactcaccgtcaccggccactttaagaccccatccaaaaagactaaaagtagtaaaccaaagctgctggtggtcgacatacgcaactcagaggattttatccgaggccacattagtggctcgattaacattccattttctgctgcattcaccgccgagggggagttgacccagggaccctatacggcaatgctgcaaaatttcaagggaaaagtgatcgtgattgtgggacacgtagcgaagcatacggcagagtttgctgcccacctggtgaagatgaagtatccgcgaatctgtattctggacgggggaatcaataaaattaaacctacaggcctgcttaccatccccagccctcagatttag

SEQ ID NO: 60057 - DNA, 2565 bp, Artificial Sequence
  Description of Artificial Sequence: Synthetic coding sequence
atgtttccgctgaaagatgccgaaatgggagccttcaccttctttgctagtgccctgccacatgacgtctgtggaagtaatggtttacctctgaccccgaactccattaaaatactgggacgctttcaaattctcaagacgatcacacacccaaggctgtgccagtacgtcgatataagcagaggcaagcacgagcgtctggtcgtcgtcgccgagcactgtgaacgctcgctggaggatctgttgagggaacgcaagcccgtttcctgttctaccgtcctctgtatcgctttcgaggttctccagggtttacagtacatgaataaacacgggattgtccatcgcgctctgtcccctcacaatatcttacttgaccggaagggccacataaagctggcgaaatttggactgtaccacatgacagcccatggcgacgatgttgacttcccaattggatatccaagttacctggctcctgagggtaggaaactattccagtcgctggatatcagtgaacggctgaagttcctgttgacactggattgtgtggacgacacgctgatcgttctggcagaagaacacgggtgtcttgatatcatcaaggagctgcccgaaacagtaatcgatctgctcaacaaatgcctcacctttcatccatcgaaacggccaacacctgaccagcttatgaaagacaaagtgttcagcgaagtgtcaccgctgtatacccccttcactaagcctgcatctctgttcagctctagtttgcgttgcgccgacttaacactgcctgaagacattagccagctgtgtaaggacattaacaatgactatctggccgagagatccattgaggaggtttattacctgtggtgcttagcgggtggcgatctggagaaggagctcgtcaacaaagagatcatacggtccaaaccccctatttgcacccttcccaacttcctgtttgaggacggggagtccttcggtcagggacgtgacagatcgtccctcctagacgacacaactgtcacactcagcctttgccagctccgaaacagactgaaagatgtaggcggagaagctttctatccactcttagaggatgatcagagcaatttacctcactcgaattcaaacaacgagctaagtgctgcagccaccctccctttaattatccgcgaaaaggacacagagtaccagttgaataggattattctgtttgaccgccttcttaaggcttacccctacaaaaagaaccagatttggaaagaggccagggtcgacatcccccctctgatgagaggtctcacttgggccgctctgctgggagtagagggggcaatccatgccaagtatgatgccatcgacaaagataccccgattcccacagaccggcagattgaggtggatatccccagatgtcatcagtatgatgagttgctctcgtctcccgagggccacgcaaagttcaggagagtcctgaaggcatgggtggtttcccaccccgacctcgtgtattggcaagggctggattcattgtgtgccccattcttgtatctcaacttcaacaatgaggccctggcctacgcctgtatgagtgcgtttatccctaagtatctgtataactttttcctcaaagacaacagccacgtaatccaggaatacttgaccgtcttttcacaaatgattgcatttcatgacccagagttgagtaatcatctgaatgagatcgggttcattccggatctgtacgccataccttggttcctgacaatgttcacacacgtgtttcccctgcataaaatcttccatctgtgggacaccctcctgctgggaaattctagcttccccttctgtataggagtggcaatcctccagcagctgagggaccgattgcttgccaatgggttcaatgaatgtatattgctgttcagcgacttgccagaaatagatatcgagagatgtgttcgcgagtcaataaacctgttctgctggacacctaagtcagctacgtatcgacagcatgctcagccgcctaagccatcaagcgattctagtgggggaaggtcttctgccccatatttcagcgcagagtgccctgacccccctaagaccgacctatcgcgagaatctatccctctgaatgatctcaaatctgaggtctctccaaggatttccgcagaggatctgatcgatttatgtgaactgacggtcaccggccatttcaagaccccgtctaaaaagactaaatcaagcaaacccaaactgttggtggtggacatccgcaattccgaggatttcattagaggccatatctctggcagcattaatatccccttctcagccgctttcaccgcagagggcgaactaacacagggcccatatactgctatgctgcagaactttaaaggaaaggttatcgtgatcgtggggcatgtcgccaaacataccgcagaatttgctgcacaccttgttaaaatgaaatatcctcgaatttgtatcctggacggcggtataaataaaattaagccaacaggccttctgaccattccaagtccacagatatag

SEQ ID NO: 60058 - DNA, 2682 bp, Artificial Sequence
  Description of Artificial Sequence: Synthetic coding sequence
atgttccctctaaaagacgccgaaatgggtgccttcaccttcttcgcctctgccctgccccacgacgtgtgtgggtcaaatggtttgccactgactcccaactccattaaaattcttgggaggttccaaattcttaaaaccataacacaccctcgactttgtcagtatgtagacatatcacgcggaaaacacgagagactggttgttgtcgccgagcactgcgaaaggtcgctggaggatctactgagggaacgaaagccagtgtcctgctcaaccgtgctctgcatagccttcgaggtgctgcaagggctccaatacatgaataaacatggcattgtgcaccgagctctctccccccataacatcttacttgaccgaaaagggcacatcaaactagcaaagtttgggctctaccacatgacagcacacggagacgatgtagactttcccatcgggtaccctagctacttagccccagaggttattgcccaggggatcttcaaaacaactgaccatatgcccagcaagaaaccattgccgtccgggccaaaatcagacgtgtggtcactgggcattatcctgtttgagctatgcgtgggcagaaagctctttcaaagccttgacatttccgaacgtcttaagttccttttgacactggactgtgtcgatgataccctcatcgtcttagctgaggaacacggatgcttggacatcattaaggaattaccggaaacagtgattgatctcttaaataaatgtttaaccttccacccttctaagagacccacacctgaccagctgatgaaagataaagtgttctcagaggtgtctcctctctatacaccttttacaaaaccagcttctctgttttcaagctctctgcgatgcgccgatttaacgctccctgaagatatcagtcagctttgcaaagacatcaacaacgattacctcgccgagagaagcatcgaggaggtttactatctgtggtgcctcgccggaggcgacttggaaaaagagttggtgaacaaagagatcatacggtcaaaaccaccaatttgcacgctgccaaactttctgtttgaggacggagagtccttcggccagggccgtgaccgatcctccctgctggatgatacaactgttacattgagcttgtgccaattgaggaataggctgaaggatgttggcggtgaagccttttacccactgcttgaggatgaccagtcgaacctgccccacagtaatagcaataatgaattgtctgccgctgcgacactccccttgattattcgggagaaggacacggagtaccaactgaatagaatcatccttttcgacagactgttaaaggcatacccgtacaagaagaatcagatctggaaggaagccagagtggatatccctccgctcatgcggggattaacatgggctgcgctccttggagtcgagggagcaatacatgccaaatacgatgcaatagacaaggatactccgattcccactgaccgccaaattgaagtggacattcccagatgtcatcagtacgacgagctcctgagctcaccagagggacacgctaaatttcgcagggtgctgaaggcttgggttgttagtcaccctgacctggtttactggcagggacttgacagtttgtgcgccccttttctgtatctgaactttaataatgaggcccttgcttatgcatgtatgagtgcgtttatccctaaatacctgtataacttttttctgaaggataactctcatgtcatccaggaatatctgaccgttttttcacagatgatcgcttttcacgaccccgagctcagtaaccatttgaatgaaatcggatttattcccgacctgtacgcaattccctggttccttaccatgttcacccacgtttttccactgcataaaattttccatctttgggacacacttctcctggggaattcttcttttcctttctgcatcggagtcgcaatacttcaacagctgagagatagattgctggccaatgggttcaatgagtgcattcttctgttctccgatctcccggagatcgatattgagcgctgcgtgagagaatccatcaacctattttgttggactcccaaaagcgccacgtacaggcaacatgctcaacctccgaagccgagtagcgatagcagtggcggacgcagttcagccccttatttcagcgcagagtgccccgatccccctaagaccgatttgtctcgggagtccataccccttaacgacctgaaaagcgaagtcagcccaagaatctcagctgaggaccttatcgatctttgtgagctgacggtgacgggacactttaagacaccctctaaaaagacaaagagctcgaaaccgaagctgctggttgtggatatccgcaacagtgaggatttcatcagaggtcacattagcggatctatcaatatccctttctcagctgcgttcacagcagagggcgagttgacacaaggcccatatacagccatgcttcaaaatttcaagggaaaggtcatagtgattgttgggcatgtggcaaagcacacggccgaatttgcagcgcatctggttaagatgaagtacccacggatctgtatacttgatggtggaattaacaagattaaaccaactgggcttctgactattccgagcccccagatctag

SEQ ID NO: 60059 - DNA, 2682 bp, Artificial Sequence
  Description of Artificial Sequence: Synthetic coding sequence
atgttcccactgaaggacgcagagatgggagcttttacattctttgcaagcgctctgccccacgacgtgtgtggatccaacggactgccactgactccaaactcaattaaaattctgggtaggtttcagattctgaagaccatcacccacccaaggctgtgccaatatgttgatatttcccggggaaagcacgaacggctggttgtggtcgcagagcattgtgaacggtccctcgaagatcttctgcgcgagaggaagccagtgagctgcagtaccgttctctgtatcgcttttgaggtcctgcagggcttacagtatatgaataaacatggcatcgttcaccgagctttaagtccacataatattctactggatcgcaaaggccacataaaattagccaagttcggcctgtaccatatgactgcccatggcgacgatgtggactttcccatcgggtatcctagctacttggccccagaggtgattgctcagggaatctttaagactacggaccacatgccttccaagaagccactgccttctgggcctaaatctgatgtctggtccctgggaattatcctgttcgaactctgtgttggcaggaagttgttccaatccctcgacatttctgagcggttgaaattcctgcttaccctggactgcgtggacgacactcttattgtgctagcagaagaacacggttgcctggacataatcaaagaactacccgagacagtaattgacctgttgaataagtgtctaaccttccatcccagcaagagacctacaccagatcaacttatgaaggataaggtgttctcagaagtgtcaccattgtataccccctttaccaaaccagcttccctgttcagtagttcattgaggtgtgcagacctgaccctgcctgaggacatctcccagctttgtaaagacatcaataatgattatctggctgaacggtccattgaggaagtatactacctgtggtgtcttgctggtggggacctggagaaagaactcgtgaacaaggagatcattcgctcgaagcccccaatctgcaccctcccaaatttcctgtttgaggacggcgagtcttttgggcagggccgagacagaagctctctgttggacgatacaaccgtgacactctccctatgccagctgaggaatcgcttaaaagacgttggcggagaggcattttatcctctcttggaggacgaccaatcaaatctacctcattccaacagcaataacgaactgtcagccgctgcaacccttccactgatcatcagggagaaagataccgagtaccaactcaatcggattatcctgtttgatagattgcttaaggcctacccatataagaagaaccagatatggaaggaagctagggtagacatccccccactgatgaggggactgacttgggccgctctccttggtgtggaaggagccatccacgcaaagtacgacgccatcgacaaagatacaccgattcccacagaccgccagattgaagtggatattccgcgatgtcaccagtatgacgaactcttgagctcaccagaaggccacgccaagtttcggagagtcctgaaggcatgggttgtttcccatccggatttagtgtactggcagggcctagacagtctttgtgcccctttcctgtatttaaactttaacaatgaggcactcgcctacgcctgcatgtccgcgtttatcccaaagtatctgtacaacttctttctaaaagataactctcatgttattcaggagtacttaaccgttttctcacaaatgatcgcttttcatgatcccgagctgtcgaaccacctcaacgaaatcggattcataccggacttgtacgccatcccttggtttctgacaatgttcactcatgtattcccattgcacaagattttccatttgtgggacactctgcttctgggtaactccagctttccattttgtatcggagtcgcgatcttgcaacagcttagggatagactgctcgcaaacgggttcaacgagtgtattttgctgttcagcgatctccctgagatcgacatcgagagatgcgtgcgcgagtccattaatctgttttgctggacgcccaaaagcgctacgtacagacagcacgcacaaccacccaagccgagctctgactcatcagggggtagatcaagcgccccatattttagcgccgagtgtccagacccacccaagacagacctgtcccgggagagtattcccttgaacgaccttaagtctgaggtgtcaccccgtattagtgctgaagatttgattgacctttgtgaactgacagttacaggacacttcaaaacgccttctaaaaaaacaaagagctccaaacccaagctcctggtcgtggacattaggaattcggaggacttcattagaggccacatctccggcagcatcaacatccctttcagcgccgcattcactgctgaaggcgaactcactcaggggccatacaccgcaatgttacagaatttcaaggggaaggtcatcgtgatcgtggggcacgttgccaagcatactgctgagtttgcagctcacctggtgaagatgaaatatcctagaatctgtattttagatggcggaatcaacaagataaagcctacgggcctactgacgatacccagtccccagatatag

SEQ ID NO: 60060 - DNA, 207 bp, Artificial Sequence
  Description of Artificial Sequence: Synthetic coding sequence
atgttcccgctaaaagacgccgagatgggggcattcactttttttgcttctgctctgccacatgacgtctgtgggagcaatggtctgccgttaactcctaatagtataaagatccttggccgattccagattctaaagaccatcacccaccccagactctgccagtacgtggatatatcacgcggaaagcacgaacgtttggtttag

SEQ ID NO: 60061 - DNA, 480 bp, Artificial Sequence
  Description of Artificial Sequence: Synthetic coding sequence
atgtttccactgaaggacgcagaaatgggcgctttcacattcttcgcctctgctctgccccacgatgtgtgtggtagcaacggtctcccactgacccccaactcaattaagatcctgggaagattccagattctgaagaccattacacatcctaggttgtgtcagtatgtcgatattagccggggtaagcatgaacgcttggtggtcgtggcagagcattgcgaaagaagcctggaggacctgctgcgggaacggaaaccagtgagttgtagtactgtcctgtgcatcgccttcgaagtccttcagggcctccagtatatgaataaacacggcattgtgcacagagcactttctccccacaacatcctactggaccgaaagggccatatcaagttggctaaattcggcctgtaccacatgaccgcacatggagacgatgtggatttcccaatcggctatccgagttatttggcaccttag

SEQ ID NO: 60062 - DNA, 318 bp, Artificial Sequence
  Description of Artificial Sequence: Synthetic coding sequence
atgtttcccttgaaggatgcagaaatgggcgcattcactttcttcgccagcgccttacctcatgacgtctgcgggtcaaacggtctccccttgactcccaacagcatcaagattctaggtagatttcagatcctaaagacaattactcatcccaggctctgtcagtacgtcgatatttcccgaggcaagcacgaacggttggtcgtagtggccgagcactgtgagaggagcctggaagacctgctacgagagagaaagcccgtgtcctgtagcactgtgctgtgtatcgcgtttgaagtcctgcagggcctccagtag

SEQ ID NO: 60063 - DNA, 753 bp, Artificial Sequence
  Description of Artificial Sequence: Synthetic coding sequence
atggaaatggacggagacccttacaatctcccagctcagggacagggaaacattattattactaagtacgagcagggccacagagctggcgcagctgtggatttgggccatgaacaggtcgacgtgcgtaagtatacaaataacttggggatcgttcacgagatggaattgcctcacgtgagcgccctcgaggtcaaacagaggcgcaaggagtctaagcggactaataaatggcagaagatgcttgccgattggactaagtaccgcagcacgaaaaagctctcacagcgagtctataaagtgataccacttgcagtgaggggcagagcttggtcactgctgctcgacattgacaggattaagtctcagaaccctggtaagtataaagtgatgaaggagaagggcaagcgcagctcccgtattatccattgcatccagttagatgtgtctcacaccctgcagaagcatatgatgtttatacagcgctttggcgtgaagcagcaggagttgtgcgatattctagtcgcatatagtgcttataacccggaagtgggataccacagagatctctcccgcattactgcaatcctactcctgtgcctgcccgaggaagatgctttctgggcgctgacgcagcttctcgccggtgaaaggcacagtctgtggtatagtaccgcccagatccttccgggatcgcgcggaagttatcgcacgcggtcccggtgctgcacatcaccatcccagaggtcgtag

SEQ ID NO: 60064 - DNA, 453 bp, Artificial Sequence
  Description of Artificial Sequence: Synthetic coding sequence
atgggacaccttgacaaggaaggactttgcacccagggctcctccttctcttggctgctcagagttctgaacgatggaatcagcctgggtctgacaccctgcctctgggatatgtatctgctcgagggcgaacagatgctgatgctgattacaagtatagccttcaaggtgcagaggtccctttatgaagagacgaataaggaaacctggggacctgcgactccaagggcgctgaaaggtactggacgcgcacggcctatctgcgaaagcctacatagctcactccaggccttgactgcaagtgaaagctcgagaggcccttcactgctgcagaccccacccagggtgccaggccagcaggcattgagtcgcggagataaaggaattagtgtgtcactcagcctgccatcccttccctcccgtcggggaagatgcgggaggattatcggatag

SEQ ID NO: 60065 - DNA, 2286 bp, Artificial Sequence
  Description of Artificial Sequence: Synthetic coding sequence
atgcggcaggacaaattaacgggatccctgcgcagggggggacggtgtctgaagaggcagggcggtggggtcggtactatcctctcaaatgtgctcaagaagcgttcttgtatctcccgcacggctccacgtctcctgtgcacgctggagcccggtgtggatacgaagttaaaatttacactggaaccatcacttggacagaatggattccagcagtggtacgatgccctgaaggcagttgcccgtttgtcaacgggcatacctaaagagtggcggagaaaggtgtggcttacacttgctgaccactacctgcactcaatcgctatagactgggataagaccatgcggttcaccttcaacgagcgtagcaaccctgacgacgactccatgggcattcagatcgttaaggacttgcatcggactggatgcagcagctattgtggacaggaagccgagcaggaccgcgtcgtgctcaagcgcgttctccttgcctatgccaggtggaacaagaccgtcggctattgccaaggttttaacattttagctgcgctcatactcgaagtgatggaggggaacgaaggcgacgctctcaagatcatgatttatctcatcgacaaagtcctacccgaatcctatttcgtgaacaatctgagggcactgtctgtggatatggctgtatttcgagacctcttgagaatgaagcttcccgagcttagccagcatttggacactcttcagcgcacagccaataaggagagtggcggaggctacgaacctcccctgaccaacgtgtttacaatgcagtggttcctaaccctcttcgccacttgcctgccaaaccagaccgtgctaaaaatttgggacagcgtatttttcgagggaagcgagatcatcctacgtgtaagtctcgccatctgggccaagttgggcgaacagattgagtgttgcgagacggcagacgaattctactctacgatggggaggctgacccaggagatgctggaaaatgaccttctacagagtcacgaattgatgcagacggtttacagcatggcaccttttccttttccgcagctggcagagttacgcgagaaatatacgtataatatcaccccctttccagccacagtaaagccgacctctgtttccggacgccattccaaagccagggactctgatgaggagaacgatcctgatgacgaggatgcagtggtgaacgcggtcggttgtttagggccattctcagggttcctggcgcctgaacttcagaaatatcagaaacagattaaggagcctaatgaagagcaatccctcaggtcaaacaacatcgccgaactcagcccgggagccataaactcctgtaggagcgaataccacgccgctttcaactctatgatgatggaacggatgactacggacattaatgctctgaaacgtcagtacagccgcatcaaaaagaagcagcagcaacaggtgcatcaggtctatattcgggctgacaagggaccagttacatccatcttaccaagccaggtgaattcctcaccagttattaaccacctgcttctgggtaagaagatgaaaatgactaatcgagctgctaagaacgcggttatacatattcccggtcacaccgggggaaaaatcagccccgtgccttacgaagacctgaagacaaagctgaactcaccatggcgcacccacattcgggtgcacaagaagaatatgcccaggacaaaaagtcaccctgggtgcggtgacactgttggcctgatagatgaacaaaacgaagcttccaaaacaaatgggctgggcgctgccgaggcctttcccagtgggtgcaccgccacggctggcagagaagggagttcgcctgaaggatctacccgacgcacaatagaggggcaaagccccgagccagtgttcggcgacgcagatgtggacgtgagtgccgtgcaggctaagctcggcgcactagagcttaaccagagggatgccgctgcagagaccgagctgcgggtgcacccaccatgtcaaagacattgcccagaaccaccatctgcacccgaagagaacaaagcaacatcaaaagccccacaaggctccaacagcaagacgcccattttctcacccttcccgtctgtgaagcccttacgcaaatccgccactgctcggaacctggggctgtatgggccaactgagcggacgcctactgtccatttcccacagatgagccgcagttttagcaagcccggagggggaaacagcggtactaagaaaagatag

SEQ ID NO: 60066 - DNA, 2454 bp, Artificial Sequence
  Description of Artificial Sequence: Synthetic coding sequence
atgtatcactcactcagtgagacccgtcaccccctgcaacctgaggaacaagaggtcggaattgaccccctctcgagctacagcaataaatcaggaggagattcaaacaaaaatgggagaaggaccagttccaccttggacagtgaaggaacatttaatagctatagaaaggaatgggaagagttatttgtcaacaataactacttggcaactattcggcaaaagggcatcaatggccagctgcggtcaagtcgcttccgttccatttgctggaagctcttcctctgcgtgctccctcaggataagagccagtggatttcccgcatcgaggaactgagagcttggtacagcaatatcaaagaaatccacatcaccaaccctaggaaggtcgtcggtcagcaggacctcatgattaacaatcctctgagccaggatgagggaagcctgtggaacaaattcttccaggataaagaactccgaagcatgattgaacaggatgtgaaaagaacctttccagagatgcagttttttcaacaggagaatgtccggaagattcttactgatgttctgttctgctatgctcgcgagaatgaacagcttttgtacaaacagggaatgcatgaattacttgcccctatcgtttttgtcctccactgcgaccaccaggcgttcctgcacgcttccgagtccgcccagccctctgaggagatgaagaccgtgctcaatcctgagtacctggagcatgacgcatatgcagtgttctcgcagcttatggagaccgctgaaccctggttcagcacatttgagcatgatggccagaaaggaaaagaaaccctcatgaccccaattcctttcgcccgaccccaggacctcggccctactattgctatcgtgaccaaggtgaaccagattcaggatcatctactgaagaagcacgatatcgaactgtacatgcatctcaatcgcctcgagattgctccacagatatacggcctgaggtgggtaaggcttctatttggacgcgaattcccgctgcaggatcttctagttgtatgggacgccctatttgctgacggtctgtctctgggcctagtagactacatttttgtcgctatgttgctgtatattagggatgcgctcatcagcagcaattatcagacatgcttggggctgttaatgcactacccatttattggagacgttcatagcctgattcttaaagcacttttcctgagagacccgaaacggaacccgaggccggttacctatcagttccatccgaacttggattactacaaagctaggggagccgatctgatgaataaatcaagaaccaatgcaaagggcgcaccgctcaatattaataaagtatcaaatagtctgataaactttggacgtaagctcatttcacccgcaatggctcctggctctgctggcggacctgtcccagggggaaattcatcatcgagctcctccgttgtgatcccgacaagaaccagcgccgaggctccaagccaccaccttcaacagcagcagcagcagcaacgactgatgaagagcgagagtatgcccgtgcagctgaacaagggggacgtcgtcactgggtccgatgctcaggtatccgtgcccgtccaaacactgacagatctacaaggcctgagtagtaagaatattagctccagtcccagtgttgagtctctgcctggaggtcgtgagtttaccggtagccccccttcctccgctacaaaaaaggactccttcttcagcaacatcagccgcagccgcagtcactccaagacaatggggagaaaagagagcgaagaggagctcgaggctcaaatcagtttcctccagggccagctgaacgatctcgatgctatgtgcaagtattgcgctaaagtgatggacactcacctggttaatatccaagatgtgattctgcaagagaacctagaaaaggaagaccagattctcgtcagcctggccggattgaaacaaatcaaagacatcctcaaagggagcctgcgtttcaatcaatcacaactggaggctgaggaaaacgagcaaatcaccattgccgataaccattactgttcctccggtcagggccaaggaaggggtcaaggacagagtgtgcaaatgagcggagccatcaagcaggcttcttctgaaactccaggatgtacagaccgagggaacagcgatgattttatccttatcagcaaagacgacgacggtagctccgcaagggggtcattcagtggtcaagcccaaccactacgcaccctgcgctcaaccagtggaaaaagtcaagcccctgtatgctcacctctggttttttctgaccctttgatggggcctgcaagtgcgagctcctctaatccctcatcttctccagatgacgactcgtctaaagactccgggttcactatcgtcagcccgcttgacatctag

SEQ ID NO: 60067 - DNA, 624 bp, Artificial Sequence
  Description of Artificial Sequence: Synthetic coding sequence
atgttagcgctgcggtgcgggtcgcgatggctgggacttctgtccgtcccccgaagcgtgccactcagattgcctgctgctagggcctgctctaagggtagcggggacccttccagctcctcatcctccgggaatccactcgtgtacttggatgtggacgctaacgggaagccactggggagagtggtgctggaactgaaagcagatgttgtgcccaagacagcggaaaattttagagctctgtgtacgggtgagaagggatttggatacaaaggttccaccttccaccgtgtaattccttcctttatgtgtcaggcaggtgattttacaaatcataacgggaccggcggtaaatctatttatggcagtcggtttccagatgaaaacttcacacttaaacacgtcgggccaggcgtactgtctatggccaacgctgggccaaataccaacggcagtcagttctttatctgcacaattaaaaccgactggttggacggtaagcatgtggtctttgggcatgttaaagagggaatggatgtcgtgaaaaaaattgaatctttcggatcaaaatcaggcaggaccagcaaaaagatcgtcattaccgattgtggccagttaagttag

SEQ ID NO: 60068 - DNA, 444 bp, Artificial Sequence
  Description of Artificial Sequence: Synthetic coding sequence
atgggcttcattttctccaagagcatgaatgagagcatgaaaaatcagaaagaattcatgctcatgaatgctagactacagctggaacgtcagctcataatgcagtctgaaatgagagaaaggcaaatggcaatgcaaatcgcctggtctagagaattcctcaaatatttcggcacgttcttcgggctcgccgcaatttctctgaccgcaggggcaattaagaagaagaagccagccttcctggtgcctatcgtcccgctgagctttattctgacctaccagtacgaccttgggtatggcacactgttggagaggatgaagggagaggccgaggacatcctcgagaccgagaagtccaagttacagctgccacgcggtatgattacttttgagtctatcgaaaaggcgaggaaggaacaaagccgatttttcatcgataagtag

SEQ ID NO: 60069 - DNA, 1203 bp, Artificial Sequence
  Description of Artificial Sequence: Synthetic coding sequence
atgagctcattgcacaagtccaggatcgcagacttccaagatgtgctgaaggaaccttccatcgcactggaaaagctgagggaactgagtttcagtggaattccctgtgagggcggtctccgctgcttatgctggaagatcctgctgaactatttgccattagaacgggcatcatggacctcaattttggccaagcagcgcgaactgtacgctcagttcctcagggaaatgattatccagccaggcattgctaaggcaaacatgggagtgagtagggaggacgtgacatttgaagatcaccccttaaacccaaatcccgatagccgatggaatacatattttaaagacaacgaagtcctactccagatagacaaagatgtccggaggctgtgcccagacatctccttctttcagcgcgctacagactatccatgcctgctgattcttgacccgcagaatgagttcgaaacgcttagaaaaagagtcgaacagacaaccctgaaaagccaaaccgttgcacggaaccggtctggcgtgacaaacatgtcttcgccacacaagaatagtgtcccaagttcactgaatgaatatgaggttctgccgaatgggtgcgaggctcattgggaggtagtagagcgtattttatttatttatgcgaaactcaatcctgggatcgcatatgtgcagggcatgaacgagatcgtgggccctctgtattacacctttgctacagaccccaatagcgaatggaaagagcatgccgaggccgacactttcttctgcttcactaatctcatggccgaaattagagataatttcataaagagcctagacgacagccaatgcggaattacttataaaatggaaaaggtgtactcgaccctgaaggataaagacgtggagctttacctcaaactccaggagcagaatataaaaccacaattttttgccttccggtggcttacactgttactcagccaggaatttctcttacctgacgtgatccggatctgggactctctgtttgctgatgataaccggttcgactttctgctgctggtgtgctgtgctatgcttatgctgatccgagaacagcttttggagggcgacttcaccgttaacatgcgcttgctgcaagattaccccattaccgatgtgtgccaaatcttgcagaaggccaaggagcttcaggattctaaatag

SEQ ID NO: 60070 - DNA, 660 bp, Artificial Sequence
  Description of Artificial Sequence: Synthetic coding sequence
atgtcaagtccccataaaaactcagtgccctcatcattaaatgagtatgaggttctccccaacggatgtgaggcccactgggaggtggttgagcgcatcttgttcatttacgctaagctcaatccaggaatcgcatatgtccagggtatgaatgaaatcgtcggccctctctattatactttcgctacggacccaaatagtgagtggaaagagcatgcagaagccgacaccttcttctgtttcacaaatttaatggctgagatcagggacaatttcatcaagtcattggatgacagtcagtgcggaatcacatacaaaatggagaaagtatattctaccttgaaagataaggacgtggaactgtacctcaagcttcaagagcagaacattaagcctcagtttttcgccttccgctggctgacgttattattgtcacaggagttcctgctgcccgatgtcataaggatttgggattcactgtttgccgatgacaacaggttcgactttctgctcctagtgtgctgtgcgatgctgatgttaatccgcgaacagctcctggaaggagactttacggtgaacatgcgtctcctccaggactatcccattaccgatgtgtgccagatcctgcagaaggccaaagagctccaggattccaagtag

SEQ ID NO: 60071 - DNA, 2082 bp, Artificial Sequence
  Description of Artificial Sequence: Synthetic coding sequence
atgaccgatggaaaactgtcaacaagcactaacggcgtggcctttatgggtatcctggacggaaggccagggaatccccttcagaacctccaacacgtcaatcttaaagcccctaggctactgtctgcccctgaatacggcccaaagctgaagctccgtgcgctggaagacagacacagtctgcaaagcgttgatagtgggatccccactctcgaaattggtaaccctgagcccgttccttgcagcgccgtgcacgtgaggagaaaacagagtgatagcgaccttatcccagaacgggcttttcagtccgcttgcgcactgccaagctgtgctcctccagcaccgtcttctaccgagagggagcagtccgtacgtaagtctagtactttccctcgcacagggtatgacagcgtcaagctgtattcccctaccagcaaggcattgacacgtagtgacgacgtgagtgtctgtagtgtttcttcccttggtaccgaactgagtacaacgctgagtgtgtcaaacgaggacatcctcgacctggtggtgacctctagttccagcgcaatagtgacgctcgaaaatgacgacgatcctcagttcacgaatgtcactctgagttccatcaaagagacgaggggcttgcaccagcaggattgtgtacacgaggccgaggaaggtagcaagcttaaaatactcgggccattttcaaatttcttcgcaaggaacctgcttgccaggaagcagagcgcaagactcgacaaacacaatgacctgggctggaagttgtttgggaaagcccctctgcgcgaaaatgcgcaaaaggattcgaagcgaatccagaaggagtacgaggataaagccggtcggccatccaagcccccatcaccgaagcagaatgtgagaaagaacttggacttcgagcccttgagcacgacagccctgatcctggaggaccggccagctaacttaccagccaagcccgctgaggaggcccagaagcacaggcagcagtatgaggagatggtcgtccaagccaaaaagcgcgagctcaaagaagcccagcgaaggaagaaacaactagaagagaggtgccgcgttgaagaaagcataggtaatgccgtgctgacttggaataatgagatactgcctaattgggaaacgatgtggtgttctaggaaggtccgagatttgtggtggcagggcatcccccctagcgttcgagggaaagtgtggagcttagccatcggtaatgaactcaatataacgcatgaactcttcgatatttgcctcgcccgtgccaaggaaaggtggcggtctctttccacaggcggatctgaagtggagaatgaagacgcaggtttctccgcagctgaccgtgaagcttccctcgaactcatcaagctggatatctcgcgaactttccccaatctgtgtatttttcagcaggggggtccctatcatgacatgctgcactcaattttgggcgcatatacctgttatcgtcccgacgttggatacgtccagggaatgtcctttattgccgcagtgctgattttaaacctcgacaccgcagacgcatttattgccttctccaatttgctgaacaagccgtgtcagatggccttttttcgggtggatcatgggctgatgctgacttactttgctgcattcgaggtgttctttgaagaaaacctccccaagttgtttgcccattttaagaaaaacaatctcaccccggatatctatctaattgattggatttttacactctacagtaagtctttgcccttagacctggcttgccgcatctgggatgtcttttgcagagatggagaagagttcctgttccggactgcgctgggaattctcaaactgttcgaagatatcttgactaagatggatttcatccatatggctcagttcttaaccagactgcctgaagacctcccagcagaagagctgttcgctagtatagccacaatacagatgcagagccggaacaaaaaatgggcccaggtgctcactgccctgcagaaagattccagagagatggaaaagggctcccccagtctccgccattag

SEQ ID NO: 60072 - DNA, 171 bp, Artificial Sequence
  Description of Artificial Sequence: Synthetic coding sequence
atgacagatgggaagctttcaacatccaccaacggagtggcctttatgggcatcctggacggaagaccaggcaatccattgcagaatctgcagcacgtgaacctgaaggccccacgcctgctgagcgcccctgaatacggcccaaagcttaagttgcgtgccttggaatag

SEQ ID NO: 60073 - DNA, 384 bp, Artificial Sequence
  Description of Artificial Sequence: Synthetic coding sequence
atgactgatggcaagctttcaacctctacaaatggggtggcgtttatgggcatacttgatggcagacccggaaatccgctccagaatcttcagcacgtcaatctgaaggcccctagacttcttagcgccccagaatatggcccaaagctcaaattaagagcgctggaagatagacactcattacagagtgtggactcaggtatccccaccttagagattggaaaccccgagccagtcccatgcagcgcagtgcacgtccgccgaaaacaatctgactctgacttgatccccgagcgagcctttcagtctgcatgcgctctccccagctgtgcgcctcctgcacctagctctacagagcgagagcaatccgtgcgtaagagctag

SEQ ID NO: 60074 - DNA, 1023 bp, Artificial Sequence
  Description of Artificial Sequence: Synthetic coding sequence
atgtggtgctccagaaaggtccgtgacctctggtggcaaggaataccaccatctgttcgcggtaaagtatggtccctggccatagggaatgaattgaatatcacgcatgaactgtttgacatttgcctagcacgagccaaggagcgctggagatcgctgagtacagggggatcagaggtcgaaaacgaggacgctggcttctcagcagcagaccgagaagctagcctcgagctcattaagctggacatctcccgaacgtttccgaatctgtgtatcttccagcaggtgttgatcttcgtagatttccgggtgggacttcagaaatcattccaaaaaagaaaagagagggagagtaccaagctgcagcagctgtggtcctggtgtcttggcggtccataccatgacatgctgcactctattcttggggcttacacctgctaccgcccagacgttgggtatgttcaaggcatgagctttatcgccgctgtgttaatcctcaatctggacaccgctgatgcttttatcgctttctccaacttgcttaataagccctgtcagatggcgttttttcgcgtggaccatggcctgatgctgacctactttgccgcattcgaggtgttttttgaggagaacttgccgaagctgtttgcccacttcaaaaaaaataacctcactccggacatctatctgattgattggatattcaccctctattccaaaagcctgcctctggacctggcttgccgcatatgggacgttttctgccgtgacggggaggagtttctttttagaacagccctgggcattctgaaattgttcgaagatattttgaccaaaatggactttatccacatggcacagttcctcaccagattgcctgaagacctgcctgcagaggagctgttcgcctcaatcgccacgatacagatgcagagtcggaataagaaatgggctcaggtgttgacggcgctgcagaaggattccagggaaatggaaaagggctcaccctcgctgcgacactag

SEQ ID NO: 60075 - DNA, 2082 bp, Artificial Sequence
  Description of Artificial Sequence: Synthetic coding sequence
atgaccgatggtaaactcagcacgagcactaacggagtagccttcatgggcattctggacgggcgtcctggaaacccgctgcagaatctgcagcacgtgaaccttaaggccccaagacttctatccgcaccagagtacggccctaaactgaagctccgggcacttgaggacaggcatagtctgcagagcgtggattccgggatccctactttagagataggaaaccctgagcccgttccttgtagtgcagtccacgtgcggcgtaaacagtccgattctgatctcattcctgaaagagcatttcagtcagcgtgcgccctcccaagctgcgcacccccagcgccttcctccaccgaaagggagcagtctgtcagaaaatcatctacattccctagaaccggatatgattccgtgaagctgtacagtccaacaagcaaggcgctgacaaggtctgatgacgtgagcgtgtgtagtgtgagtagcctgggcacagaactgtccaccacacttagcgtgagcaacgaagacattcttgacctggtcgtaacaagttcctcctccgctatagtcaccctcgagaatgatgatgaccctcaatttaccaacgtcaccctttcatccatcaaggaaaccaggggtctgcatcagcaggattgtgtgcacgaggcagaggagggttctaagctgaagatcctgggtcccttcagcaatttcttcgcacggaacctcctggcacgaaaacagagtgccagattagacaagcacaatgacctagggtggaagctatttgggaaggctcctctccgggaaaatgcgcagaaggatagcaagcgcatccagaaggaatatgaagataaagccggacgtccttctaaaccaccttctcccaagcagaatgtgcggaagaatctggatttcgaacctctgtctactactgccttgatcttagaagaccggccagctaatctcccagctaaacctgcggaggaggcccaaaagcataggcaacaatatgaggagatggtggtccaagccaaaaagagagaactgaaggaagctcagagaagaaagaaacagctggaagagcgatgtcgggtcgaagagagcattggaaacgcagtgctgacatggaataatgagatcctgccgaactgggagaccatgtggtgctcgaggaaggtgagagacctatggtggcaaggaatccctccttctgtccgcggtaaagtgtggtctcttgccatcggtaatgagcttaacatcacccacgagctatttgacatctgtctggcaagagcgaaggagcggtggagatcgttgtcaactgggggatctgaagttgagaatgaggatgctggatttagcgcggcagaccgggaagcgtccctggagctcatcaagcttgatatctctcgcactttccctaatctctgtatatttcagcaaggaggaccttatcatgacatgctgcactcaatattgggcgcttacacctgctatagaccagatgtaggttatgtccagggaatgagtttcatagcagctgtgttgatcctgaatttagacacagccgatgcatttattgccttctcgaatctgctaaacaaaccatgccagatggcttttttccgtgtcgatcacggcctgatgttgacctacttcgccgcttttgaagtatttttcgaggagaacctacccaaactcttcgcccactttaagaagaacaatctgaccccggacatatacctaatagactggatttttactctgtattctaaatcccttcctctggacctggcttgtcggatttgggatgttttttgccgtgacggggaggaattccttttcagaacagcgctcggcattctgaaactgtttgaagatattctgactaaaatggattttatacacatggctcaattcctgaccaggctcccagaagaccttccagccgaagagctgttcgcttcaatcgctacaatccagatgcagagtcgcaacaagaagtgggcccaggtgttgaccgcattacaaaaagactcaagagaaatggagaaaggctccccatcactgaggcactag

SEQ ID NO: 60076 - DNA, 1242 bp, Artificial Sequence
  Description of Artificial Sequence: Synthetic coding sequence
atggaatatgaggacaaggccggaaggccatcgaagccaccttcacccaagcagaacgtccgcaaaaacctggattttgaaccacttagcacaaccgcgttaatcctggaggaccggcctgccaatctgcctgctaagcctgctgaggaagctcagaagcatagacagcagtacgaagagatggtggtgcaggccaagaaacgcgaactgaaagaggcccagcgtcgaaagaagcagctggaggaaaggtgcagagtggaggaaagcatcgggaacgcggtcttgacctggaacaatgagatattgcctaattgggagaccatgtggtgttcacgcaaagtacgggacctatggtggcaggggattcctcccagcgtgcggggaaaggtctggtcacttgccattggaaacgagcttaacattacacacgagttgtttgatatctgcctggccagagcaaaagaacgctggcgcagtcttagcaccggaggtagcgaggtggaaaatgaggacgccggtttttccgccgctgacagagaggccagcctggaactgattaaattggacatcagtcgtaccttcccaaacctgtgcattttccagcagggtggcccatatcatgatatgttacacagtatattgggcgcttacacatgttataggccagacgtcggatacgtccaaggcatgtcattcatcgcagctgtgcttatactgaatttagacaccgctgatgcatttatcgcgttctcaaatcttcttaacaagccatgtcaaatggccttctttagagtcgaccacggcctgatgctcacgtactttgcagcttttgaagttttctttgaggaaaacctccctaagctattcgcccatttcaaaaagaacaatctgaccccagatatctatcttatcgactggattttcaccctgtacagtaaatctctcccccttgacctggcctgtagaatatgggacgttttctgcagagatggagaagagttcctcttccgtaccgctttgggtattctgaagctatttgaagacatcctgaccaagatggactttatccacatggcgcagtttctaacacgcctcccggaagacctccctgccgaagagctgtttgcgtccattgcaaccattcaaatgcagtctaggaataaaaaatgggcccaagtgctcaccgcgttgcagaaggacagcagggagatggaaaaaggaagtccgtccttaagacattag

SEQ ID NO: 60077 - DNA, 2304 bp, Artificial Sequence
  Description of Artificial Sequence: Synthetic coding sequence
atgagccttggacgtctgctccgtcgggcaagctcaaaggcctccgatcttctcaccctgacgcccggaggaagtggttctgggagcccctctgtcctggacggggaaatcatctattcaaagaacaacgtgtgcgtgcatccaccagagggcctgcagggactgggagagcatcaccctggatacttgtgtttgtacatggagaaggacgagatgctcggggcaacattaattctcgcctgggtacctaacagtcgtattcaacgtcaggatgaggaagcactcaggtacatcaccccggaaagttcacccgtgaggaaggcccctcgtcctcgcggtcgtaggacccgcagctcaggcgcttcgcatcagcccagcccgaccgaactgcggcctaccctcacgccaaaggacgaagatatactcgtggttgcccagtcagtgccggaccggatgctcgcatcacctgcgccagaggatgaggaaaaacttgctcaggggctaggagtggatggcgcacagcctgcttctcagccagcatgttccccatcaggcatccttagtaccgtcagcccccaggacgtaactgaagaaggtagggaaccgcgacccgaggccggagaagaagatggatccctggaactttctgcggagggggtctcgagagacagcagttttgattccgactctgacacttttagttcacccttctgtctgtcccctataagcgcagccctagccgagtcgcgcggaagtgtcttcctggagagtgattcttcgccaccaagctcgagtgatgctggtctgaggtttccggactcaaatggattgctccagacccccaggtgggatgagccccaacgcgtgtgtgctttagaacagatctgcggcgtgttccgagtggatttaggtcacatgagaagcctgaggctgttcttttctgatgaggcctgtaccagcggtcagttggtcgtggcttctagagagtctcaatataaagtgttccactttcatcatggtggactagataagctctctgatgttttccagcagtggaagtattgtacggagatgcaacttaaagaccagcaagtggcaccggataagacctgcatgcagttcagtataaggagaccaaagcttccatcttctgaaacccacccagaggagtctatgtataaacgactgggcgtctcggcatggcttaatcacctgaatgagctggggcaggtggaagaggagtacaagttgagaaaagctattttttttgggggtatagatgtcagtatcagaggggaagtatggcccttcctgctcaggtactactcacacgagtccacctccgaggagagagaggcactccgattacagaaacgcaaggaatactccgagattcagcaaaagcgactttctatgacacccgaagagcaccgcgctttctggagaaatgttcagtttacagtggataaagatgtggtaagaacagacagaaataaccagttctttcgaggtgaggacaatccaaacgtggagtctatgcgacggatcctccttaattacgccgtctacaaccctgccgtggggtacagtcagggtatgtccgacctggttgctcccattttggctgaagtgctggatgagtcagacaccttttggtgctttgtcgggctgatgcagaatactatcttcgtatcctcccctcgagatgaagacatggagaagcagctgttgtatctgcgggaactactgagactgacacacgtgcgcttttatcagcacctggtgtccctgggggaagatgggctgcagatgttattctgccaccgctggctgctcctgtgtttcaagcgtgagttccccgaggcagaggccctgcgcatctgggaggcttgctgggcacactaccaaacggactatttccacttattcatctgtgtggctatcgttgcaatctatggtgatgatgttatcgaacagcagttagcaaccgaccagatgctgctgcatttcggcaacctggcaatgcacatgaacggtgagctggtgctgcgcaaggcgcgaagcctcctgtaccaattccgtcttttacctcgcatcccatgttccctgcacgatctctgcaaactctgcggctccggtatgtgggactcaggctctatgccagccgtcgagtgtaccggccatcacccaggctctgaaagttgtccgtacggcggtactgtcgaaatgccttcccctaagtccctaagagaggggaaaaaagggcctaaaactcctcaggacggattcggttttcggagatag

SEQ ID NO: 60078 - DNA, 1218 bp, Artificial Sequence
  Description of Artificial Sequence: Synthetic coding sequence
atgaaggtggcacccgacaagacatgtatgcaattcagcattcgtcgcccaaaactgccatcgagcgaaacgcatcctgaggaatcaatgtataagcgacttggcgtgtccgcctggctcaaccacttaaatgaactcgggcaggtcgaggaggaatacaagctgaggaaggctatttttttcggcggaatagatgtttctatccggggagaagtctggccattccttctaagatattattctcatgagtctacaagcgaggagagagaagccctgcgtctgcagaagcggaaagagtatagtgaaattcagcaaaagcgcctgtcaatgacacctgaagagcacagggcattctggcgcaacgtccagttcaccgtcgacaaggacgttgtccggaccgaccgcaataatcagttttttcggggagaggacaacccaaacgtcgaaagtatgagaagaatcctgctgaactatgctgtttacaacccggctgtcggttactcacaggggatgtccgacctggtggctcctatcctggctgaggtgttggacgaatcagacactttttggtgcttcgtcggattaatgcaaaacactatctttgttagctcgcccagagacgaggatatggaaaaacaacttttatatttgagagaattgttacgcttgacacatgttcgcttctatcagcacttggtttccttgggcgaagacggactgcaaatgctattctgtcataggtggctattgctgtgcttcaagagagaattcccagaagccgaggccttgaggatttgggaggcatgctgggcacattatcagaccgactactttcacctttttatctgtgtagctatcgtggctatctatggagatgatgtcattgaacagcagttagcaacggaccaaatgttactgcacttcggaaatcttgcaatgcacatgaacggggaactcgtactgagaaaggctagatctctgctttaccagtttcgtctgctgcctaggataccttgttcactgcacgatttatgcaaactctgcggctcggggatgtgggattctggcagcatgccggcagtcgagtgcactggtcaccatcccggaagcgaatcttgcccatatggaggcaccgtagagatgccatcgcctaaaagcttacgcgaggggaaaaaaggacccaagacccctcaggatggcttcggattccgacgctag

SEQ ID NO: 60079 - DNA, 2154 bp, Artificial Sequence
  Description of Artificial Sequence: Synthetic coding sequence
atgggagacctcccgccttatcccgagagaccagcacagcagcctcctggacgcaggactagccaggcgtcacaacgacgccactcaagggatcaggcccaggcacttgcggcagatcctgaggagaggcagcaaattccaccagatgcacagcgcaacgcccctggctggagtcaaagaggaagtttatcacaacaggaaaacttgctgatgccacaggtctttcaagccgaagaggccagactgggcggtatggagtacccttctgtcaacaccggctttccaagcgagttccaaccgcagccgtacagtgatgaaagtcgcatgcaggtcgccgaactaacaacaagcctaatgctccagcggttgcagcaaggtcaatcttcgctcttccagcagttggatcccaccttccaggaacctcccgtcaatccgcttggccaattcaacttgtaccaaacagatcagttttctgaaggagcacaacatgggccatatatccgggatgaccccgctttgcagttccttccaagcgaactgggcttccctcactactctgcgcaggtgcctgaacctgagcctctggagcttgccgtacagaatgccaaggcatacctcttgcagacctccattaactgcgatttaagtctgtatgaacacctggtaaacttgctgaccaagatccttaaccaacgaccggaggatcccctgagcgtgctggagtcactgaacaggacaacacagtgggagtggttccatccaaagctggacacactgcgggatgacccagaaatgcaaccaacctacaagatggcagagaagcaaaaagccctgttcacccgctctggtggtggtactgaaggagaacaagaaatggaggaggaagtgggtgagacgccagtcccgaatatcatggagaccgcattctatttcgagcaggccggtgttgggctttccagcgatgaaagctttagaatcttccttgcgatgaaacagctcgtcgaacagcagcctatacacacctgcaggttttggggaaagatcctcggaatcaagcggtcctatctcgtcgcagaggtggaattccgagaaggagaagaggaagcagaagaagaagaggtcgaagagatgacagaaggtggcgaagtaatggaggctcacggagaagaggagggtgaggaggatgaggaaaaagccgtcgacattgtccctaagtctgtgtggaagccaccccctgtaatcccgaaagaggagtcgcgatccggggcaaacaaatacctgtattttgtgtgcaacgagcccggactgccgtggacccgtctcccgcatgtcacgccagcccaaatagtgaatgcaaggaagatcaaaaagttcttcacaggatatttggacactcctgtcgtgtcatacccaccatttcctggcaacgaagccaattatctgcgggcacagatcgcccgaatctctgccgcaacacaagtgtctccccttggcttctaccagttttccgaagaagagggcgatgaggaggaggagggaggggcaggcagagatagttatgaggagaacccagactttgaggggattcctgtgctggagcttgtcgacagcatggccaattgggtgcaccatacgcagcacatcctgcctcagggaagatgcacatgggtcaatcccctacagaagaccgaggaagaggaagacctgggagaggaagaagagaaagccgatgaaggccctgaggaagttgaacaggaagttgggccaccactgttgacccccctcagcgaagacgcggagattatgcatttggcaccttggactacccggctaagttgtagtttgtgcccacagtacagtgtcgcagttgtgcgctctaacctttggccaggcgcatacgcttatgctagtgggaagaagttcgaaaacatttatattggctggggccacaagtattccccagagtccttcaaccctgccctccccgctccaatccagcaggagtatccttcaggccctgagattatggaaatgagcgaccctacagtggaggaagaacaagccctaaaagctgctcaagaacaggctcttggagccactgaagaagaggaggagggcgaggaagaggaggagggagaagagaccgacgattag

SEQ ID NO: 60080 - DNA, 1848 bp, Artificial Sequence
  Description of Artificial Sequence: Synthetic coding sequence
atggaaggcgcaggttatagagataacgatgtccttttgcattgggcgccagttgaagaagcaggcgactctacacaaatccttttctctaaaaaggattcttcaggtggggactcctgtgcatcagaagaggaacccacctttgacccagactatgaacccgactgggccgtgatctccaccgtaaggccacagctgtgtcactctgaacccacacgcggagctgaaccgtcctgccctcagggctcttgggctttttccgtaagcctaggggaattgaaatccattaggaggtccaagcctggactctcctgggcttacctggtgcttgtgacccaggcagggggatcgctgcctgctctgcattttcatcgagggggtacgagggctctgttacgggttttgagccgatacctcctgttagctagctctccacaggactctcgcctatacttggtgtttccccacgacagcagtgctctgtctaattcatttcaccatcttcaactgtttgaccaggacagctccaacgtggtgagtcgattcttgcaggacccctactccacaacattttccagcttctccagagtcactaactttttccgaggcgcactgcaacctcagccagagggcgctgcgagtgatcttcctccccctccagatgatgagccagaacctggtttcgaagtaatttcttgtgtggagcttggcccacggccaaccgttgagcgcggaccacctgtgaccgaggaagagtgggcaaggcacgttggcccagagggccgtctccagcaagtccctgagttgaaaaatagaatcttctccggagggcttagtccttcactaaggagagaggcctggaagtttctgcttggctacctgagttgggaggggacagctgaagagcataaagcccatatcagaaaaaagactgacgagtatttccgcatgaaactacagtggaagtcagtctctcctgaacaggaaagacgaaattctttactgcacggctaccgctcgctgattgaacgagacgtaagcagaaccgataggacaaataaattttatgaaggccctgagaatcctggacttggcttgctgaatgatatattgctgacatattgcatgtatcacttcgacctgggttatgttcaggggatgtcggacttattatcccctatcttatacgttattcagaatgaggtggacgccttttggtgcttttgtggtttcatggagctggtgcagggtaattttgaggagtcccaggagactatgaaacggcagctgggtcgcctgctcttgcttctgcgcgtgttagaccccttgctttgcgatttcctggacagtcaggactcaggaagcctgtgtttctgcttccgctggctgttgatttggttcaagcgtgagtttccgttccccgacgttttgagactttgggaggttctctggactggtctcccaggccctaacctgcacctcctggtggcttgtgctatactcgatatggagcgcgacacgctgatgctgagcggattcggatctaacgaaatactcaaacacatcaacgagctgacaatgaaactctccgtggaggatgtgctcactcgtgccgaggccctgcatcgtcaattgacggcatgccccgagctgccccacaatgtgcaggagattctgggcctggccccaccggcagagccgcacagccccagccctaccgccagtcccctcccactctctccaacccgcgcacccccaactccccctccgtccacagataccgctccacagccagatagctccttggagatcttgccagaggaagaggatgagggagctgatagctag

SEQ ID NO: 60081 - DNA, 1581 bp, Artificial Sequence
  Description of Artificial Sequence: Synthetic coding sequence
atgctgcaggaggagtcggatctcagcttgatcattgctcagatagttcagaagctcaagggtagcaatctgtacagccaacttgaaaggcaggcatgggcgtctttacaacggccagaaattaagttggaaagcctaaaggaggacatcaaggaatttttcaagatttccggctgggaaaagaaactccagaatgcagtttattctgaactctctgtgtttcctttgcccagccaccccgcagcacctcctgagcatttaaaggaacccctggtctacatgcgcaaagcccaaggatcttgggaaaaacgtatccttaagagcctgaactcaatgtgcacggaactctccattcccctggctcggaagcggccagtgggagaacagaaggagttgctaaacaaatggaatgaaatgggcactgatgaacctgacctgtcactatttagacccgtatacgcccctaaagatttcctggaagtgctgattaatcttaggaatcccaactacgaaaatggagatagtctcagtttcaggacccacctgggcctcatccaggtcccccttaaagtgaaggacatccccgagctgaaagagtgcttcgtcgagctcggcttaaatatcggccagctgggaatcgacgacagcacccaagtgcctcccgaactgttcgaaaatgagcacgttcgtatcggccagaaagttctagctgaacaagattccgccgcagctcagcagtacataaggcagggttctccgaccgctctcagggctgagctgtgggcactaattctcaatatcagttcacagcctgaggatgtcctgtactacgagcagctgaagacaaatgttatccagcatgacctcctggtggattccctgatatataaggatgttaagctaaccgcctcaaatgacgattattattttgtctttgaggactacctctatcaggtgctcctctgcttttcaagggacaccagtgtgctaagccatttcgccttcaatagcgccagtccgccaaaatcatacattagggggaagttgggactggaagagtatgctgtcttttatccacccaatggggtgataccgttccacggatttagtatgtatgtggccccactgtgtttcctttatcacgagccctctaagctttaccagatttttcgggaaatgtatgttcggttttttttccgcttgcactcaatctcctctcatcccagcggcatcgtctctttatgcctgctgtttgagaccttactgcagacgtatttgccccaacttttttatcacctgcgagagatcggcgcacagcccctgcgtatctcattcaaatggatggtcagggcgttttccgggtatctcgcaactgatcaactattacttctgtgggatcgcatcttgggatacaacagccttgagatcctggcagttctggcagccgcagtgttcgccttccgggcagtcaacctgatggaagtgaccagtttagctgcagcggaggccgtgctggccgatttgtccaccctgaaagttatgccactgctccagatattcctctttgcaaccgtcacttag

SEQ ID NO: 60082 - DNA, 1386 bp, Artificial Sequence
  Description of Artificial Sequence: Synthetic coding sequence
atgctacaggaggagagcgatctcagtttgatcattgcccagatcgttcagaaattgaaaggctcaaacctgtacagtcaattggaacggcaggcctgggggtcatgggagaagagaatcttaaaatccttgaactctatgtgtaccgagctctccatccctttagcaagaaagaggccagtcggcgaacaaaaagaactgttaaacaaatggaacgagatgggaacagacgagccagatctgagtctgttccgcccagtgtacgctcctaaggacttcctggaagtgcttataaacctacggaatcctaattacgaaaacggtgactctttgtcatttcgtactcacctgggcctgatccaggttcccctgaaggtgaaagacattcccgagctgaaggagtgttttgtcgagttaggtctgaatatcggccaacttggaattgatgattcaacccaagtgccgcctgagcttttcgagaacgagcatgtaaggatagggcagaaggtgttggcggaacaggatagtgcagccgcacagcagtacatcaggcaggggtcgcctactgcgttgcgcgcagaactatgggctctgatcttgaatatatcatcacagcccgaggatgtgctatactatgagcagcttaagactaatgtcattcagcacgacctcctggttgactctttgatctacaaagacgtgaaacttaccgcctctaatgacgattattacttcgtgttcgaagactatctctatcaagtcctgctctgtttcagccgagacactagcgtgctgagccatttcgctttcaactccgcctcacctcctaagtcctatatccgtgggaagttgggactcgaggagtacgcagtgttctaccctcccaacggcgtgatcccttttcatggtttcagtatgtacgttgctcccctatgctttctgtaccacgaaccatccaagctctaccagatttttcgggaaatgtatgtgagattcttctttagactgcattccatatcgagccatccatcagggattgtgagcctctgcctgctgttcgagactttgttgcaaacttacctgcctcagctattttatcatttgcgggagatcggggctcaaccattaagaatttccttcaagtggatggtacgggctttctctgggtacttagccacagatcagcttcttctgttgtgggatcgaatactgggatataattcattagaaatcctggccgttctagcagcagctgtgttcgcgtttcgtgcagtgaacctgatggaagttacatcactcgccgctgccgaggcagtcctagcggacctttctaccctgaaggtgatgcctttattgcagatcttcctcttcgcaacagttacgtag

SEQ ID NO: 60083 - DNA, 1011 bp, Artificial Sequence
  Description of Artificial Sequence: Synthetic coding sequence
atgaccaccttatccccagagaatagcctcagcgccaggcagtctgccagtttcattctggtcaaacggaagcctcccatcgataaaacggagtgggattccttcttcgatgagagcgggcatctggcaaaaagcagggacttcatttgcgtgaatatcctggagcgtggactccaccctttcgttagaaccgaggcctggaaattcctgactggatacttctcctggcagagtagtcaagatgagcggctcacggtcgactccatgcgccgtaagaattacaaggccctctgccagatgtacgagaaaattcagcctctacttgagaatcttcaccgaaattttaccgagacacggaacaacatagccagagatatccagaaaatctacgacaaggatcctctgggcaacgtacttattgataaaaagcgactcgagaagatcctcctgctctcttacgtctgcaacacccaggctgaataccagcaaggattccatgagatgatgatgctctttcagctaatggttgagcacgaccacgagaccttctggctgttccagttttttctgcagaaaactgaacattcctgcgtgataaatattggggtcgccaagaatctcgatatgctgagtacactgatcaccttcctagatccggtttttgcagaacatctcaaagggaagggggctggcgctgttcagtcactgtttccgtggttctgcttctgttttcaacgggctttcaagagtttcgatgacgtgtggagactgtgggaagtgttgttgacaggcaagccttgtagaaatttccaagtgttagtcgcttacagcatgctccaaatggtgagggagcaagtgttgcaagagtccatgggaggagacgacattttgctagcctgtaataatctcatagatttagatgctgatgaacttatttctgccgcatgtgtggtctacgcggaactcatacagaaagatgtccctcagaccttgaaggatttctttctgtag

SEQ ID NO: 60084 - DNA, 903 bp, Artificial Sequence
  Description of Artificial Sequence: Synthetic coding sequence
atgaccaccctgtccccagaaaactccctgtctgccagacagtctgcatccttcattctaggcctgcacccatttgtaagaaccgaagcctggaaattcttgacaggatatttcagctggcagtcatctcaggacgagcgactgaccgtggactctatgcgacgcaagaactataaggcattgtgtcagatgtatgagaagattcagcccttgctggagaacctccatagaaactttacagagactcggaacaacattgcacgggatattcagaaaatctatgataaagacccactgggcaatgtccttatcgacaaaaagagactggaaaagatcctgttattgtcgtacgtctgtaatacccaggccgaataccagcaggggttccacgaaatgatgatgttgtttcagctcatggtggaacacgatcacgagactttctggcttttccagttttttctccaaaagactgagcactcttgcgtaattaacataggggtagcaaaaaatctggacatgctcagcacactgatcacctttctggatcctgtatttgccgagcacttgaaagggaaaggggctggggcagtgcagtcactcttcccctggttctgcttttgctttcagagggcatttaaatcctttgatgacgtgtggagactgtgggaggtgcttctcacaggaaaaccatgcaggaattttcaggtgctggttgcctactccatgctccagatggtgcgtgagcaggtgctgcaggaaagcatgggaggtgacgatatccttctggcatgcaacaacctcattgatcttgatgccgatgagctgatcagcgccgcttgtgtagtgtatgctgaactcatccagaaagacgtccctcagacactgaaggacttctttttgtag

SEQ ID NO: 60085 - DNA, 1554 bp, Artificial Sequence
  Description of Artificial Sequence: Synthetic coding sequence
atggcgtctgatggtgcccgaaaacagttctggaaacgctctaactcgaagctgcccggtagcatacaacacgtttatggcgcacaacatcctcccttcgaccctttattgcatgggacacttctccgttctacagccaagatgcccacaacaccggttaaggcaaaacgcgtgtctacgtttcaggaattcgaaagtaacaccagcgatgcttgggacgctggcgaagatgacgacgagctgctggcgatggcagcagagagcttaaactctgaagtggtgatggagaccgcaaaccgagtgcttcggaatcatagccagcgccaggggcgtcctacactccaggagggaccaggtttgcaacaaaaacctcggcctgaggcagagccaccctcgccaccttctggtgacctcaggctggtaaaatctgtgtctgagagtcatacttcctgtccggcagagagtgctagtgatgcggctccactccagagatcccaatcattacctcacagcgccactgtgacattagggggaacctccgaccccagtaccctgtcctcctcagccctgtcagaaagagaggcttcccgcctagacaagttcaaacaactgctcgccggtccaaataccgacctcgaggaactcagacgactctcgtggtcgggaatcccaaaacccgtaaggccaatgacctggaaactcctgagcgggtatcttccagccaatgtcgacagacggcctgcaacgctccagcgcaaacaaaaggaatatttcgcctttatcgaacactactacgattccagaaacgatgaggtgcaccaggatacttaccgacaaatacacattgatatcccgaggatgtcaccggaagcactcatcctgcagcccaaggtgacggagatattcgagcgtatcctctttatctgggccattcggcacccagcaagtggctacgtgcagggtattaatgacttggtcacccccttcttcgtggtgtttatttgtgagtacattgaagcagaggaagtggatacagtggatgtgagcggagtgcccgctgaggtgctttgcaatattgaagccgatacttattggtgcatgtccaagcttttggacgggatccaggacaactacaccttcgctcaacccggtatacagatgaaagtgaagatgctcgaagaactggtttctcgtattgacgaacaggttcatagacatctggatcagcacgaagtgcgctacctgcaattcgcttttagatggatgaataacctgctgatgcgcgaggtgccactgcggtgtactatcaggttatgggatacttaccagtctgagcccgacggtttcagccatttccatctctacgtttgcgctgccttcctcgtacgctggcgaaaagagattctggaggaaaaggacttccaggagctgcttctgttcctgcaaaacttgccgacagcgcattgggatgacgaagacatatccctcctgctggctgaagcttaccgtctcaagttcgcctttgcggacgcgcctaatcattataaaaagtag

SEQ ID NO: 60086 - DNA, 1320 bp, Artificial Sequence
  Description of Artificial Sequence: Synthetic coding sequence
atggccagcgacggcgctcggaagcagttctggaagagatctaatagcaagttaccaggcagccttctgcgcagtacagccaaaatgcccaccaccccggtgaaggccaaacgggtgtcaaccttccaagaatttgaatccaacacctctgatgcatgggatgctggagaagacgatgatgaactgctggctatggcagctgagtctctgaattccgaggtggtcatggaaaccgctaatcgtgtgctcagaaatcatagccagcgccagggtcgaccaaccctccaagaggggcctggactccaacagaaaccccgtccagaagctgaaccccctagcccaccctccggggacttgaggctcgtcaagagtgtctcagaatctcacacatcgtgtcccgctgaagaactgagacggctgagttggagtggtatcccaaagccagtgcggcctatgacttggaagctactctcgggatacttgccagccaacgtggataggcggcctgctacccttcagcgcaagcaaaaggagtattttgcgtttatcgaacattattacgactcaaggaacgatgaggtgcatcaggacacgtatcgacagatccatattgacatcccgcgaatgtctcctgaggcattgatccttcaaccaaaagtgaccgaaatattcgagcgaatcttattcatttgggctataagacacccggcttctgggtacgttcaaggcattaacgacctcgtcaccccttttttcgtggtatttatttgcgagtacatcgaggctgaggaggtggacaccgtggacgtgtcaggagttcctgctgaagttctctgtaatattgaggcagatacttattggtgcatgtctaagttactagacgggatccaggataactacacgtttgcccagccaggcattcagatgaaggtcaaaatgctggaagaactagtgagccgcattgatgagcaagtgcacaggcatttggatcaacatgaagtgcgttatcttcagttcgcctttcggtggatgaataaccttttaatgcgcgaggtgccgctgcggtgcaccatacggctgtgggacacctatcagagcgaacctgacggctttagccatttccacctgtatgtctgcgcagcattcctagtcaggtggagaaaggaaatcctggaggagaaagatttccaagagctgcttctgttcctccagaatctgcccacggcacactgggatgatgaggatatttccctactgttggccgaagcctaccggctcaagtttgcgttcgctgatgcaccgaaccactacaagaagtag

SEQ ID NO: 60087 - DNA, 975 bp, Artificial Sequence
  Description of Artificial Sequence: Synthetic coding sequence
atgccgacaacccctgtgaaagcaaagcgcgtctcaacctttcaagaatttgagtctaacacatccgatgcatgggatgctggcgaggatgacgacgagttattggcgatggctgccgagtcactgaattccgaggtcgttatggagacagcaaacagagtgctcagaaatcattcccagcgtcaaggcaggccaactctgcaagaaggacctggtcttcaacagaaaccacggcctgaggccgaaccaccttctccacctagtggggatctccggctggtgaagtcagtgagcgaaagccacactagttgtcctgctgaatccgccagtgatgccgctcccttacagcggagtcagagcctgccacatagcgctaccgtgacactgggaggtacatctgatccctccacgcttagttcttctgcgctgtctgaacgagaggcatctagactagataagttcaagcagctgttggccggaccaaatacggacctggaggaactccgcaggctctcgtggtcaggcattccgaagcctgtccgacctatgacctggaagctgttaagcggctacttgccggcaaacgtagacagacgtcccgcaacattgcagagaaaacagaaagagtattttgccttcattgaacattactatgactcaaggaacgatgaggtgcaccaagatacgtatcggcaaatccatatcgatataccgaggatgtcccctgaggccttgatcttgcagccaaaagtgacagagattttcgagcgcatcttgtttatctgggcaatccgccacccagccagcggatatgtccaggggatcaatgacctcgtaacaccattcttcgtcgtctttatttgtgagtacatcgcatttccgggatgtgggcgaccccaaattcccattctcgcagtcatatggagggatgaaccgtatccccgtaccgatgagcaaatcatcttaagacgttag

SEQ ID NO: 60088 - DNA, 1413 bp, Artificial Sequence
  Description of Artificial Sequence: Synthetic coding sequence
atgccaacgacacctgtcaaggctaagcgagtgagtactttccaggaattcgagtctaatacaagcgatgcatgggacgccggagaagatgacgacgaactgcttgcaatggccgctgaaagtttaaactccgaggtggttatggaaactgcgaatcgcgttttacggaaccattcgcagcgccaaggccgtcccactctgcaggaaggaccaggcctacagcagaagcccaggccggaagcagagccacccagtcccccttcaggggacttgcgactcgtgaaaagcgtgagcgaaagccacacctcgtgtcctgccgagagtgcgtcagatgccgctccgctgcagcgttctcaaagcctgccacatagtgctacagtgactctcggcggtacaagtgatcctagcactttaagttcctctgccctttcagaaagagaagcgtcccgcctggacaaatttaagcagctccttgcaggccctaacacagatctggaggaattacgccgtttgtcatggtctggcatcccaaagcctgtccgccctatgacatggaagcttctgagtggctacctgcctgctaatgtggatcgacgccctgccacgttgcagagaaagcaaaaggagtactttgcctttattgagcactattacgattccagaaacgacgaggtacaccaggacacatacagacagattcatattgacatacctaggatgagccctgaggccctgatcttgcagcccaaagtgaccgaaatctttgagaggatcctgtttatctgggccatccggcaccctgcctcgggctacgttcaagggataaatgatctcgtcactccgttctttgttgtgttcatctgtgaatacattgaggcagaagaagtcgatactgtcgacgtgtccggtgttcccgctgaggtgttgtgtaacatcgaagcagatacctactggtgcatgtccaaactgcttgacggcatccaggataattacacttttgcacagcccggtatccagatgaaggtgaagatgttggaagagctggtgagccgcatagacgagcaagtccataggcatctggaccagcatgaagtgaggtatctgcaatttgccttcaggtggatgaacaatctgcttatgcgagaggtccctctgagatgcaccattaggctatgggatacctaccaatcagaacccgatggcttttctcactttcacctgtacgtgtgcgccgcatttttggtgcgatggcggaaggagatcctcgaggaaaaagactttcaggaattgctcctgtttcttcaaaatctgcctaccgctcactgggatgacgaagatattagcctccttcttgcagaggcgtatcgcttgaagttcgctttcgcagacgctccgaatcattacaaaaaatag

SEQ ID NO: 60089 - DNA, 1377 bp, Artificial Sequence
  Description of Artificial Sequence: Synthetic coding sequence
atggcctccgacggcgcacgcaaacagttctggaagcggtccaattcaaagctgcccggatcaatccaacacgtttatggtgcccagcatcccccattcgatcctctcctgcacggaactctcctcagaagcacggcgaagatgccaactacaccagtcaaggccaagcgggtgtctacatttcaggagttcgagagcaacacttctgacgcttgggatgctggcgaagacgacgacgagttgctcgccatggctgctgaatccctgaatagcgaggtcgtaatggaaaccgcgaaccgggtgcttcgcaaccactcacaacgccagggaaggcctaccctacaggaggggcctggccttcagcagaagcctaggcctgaggccgagccgccttctccaccttcaggtgacctgagactcgtcaagtccgtttcggagtcgcacactagttgtcctgcggaagaactgagaaggttgtcatggtctggcattccgaaacccgtgcggccaatgacctggaaactcctttctggatacctgccagcgaatgtcgacagaaggccagcaaccctccagaggaagcagaaggagtactttgcttttatagaacactactatgactcacggaatgatgaggtccaccaggatacctatcgacagattcatatcgacattccaagaatgtccccagaggccctaattctgcaacctaaggtgaccgagatatttgagcgcatacttttcatttgggccatcagacaccccgcatccggctacgtccagggcattaatgatctcgtcacccctttttttgtggtttttatctgcgaatacatcgaggccgaagaagtggataccgtggatgtgagtggagtgccagccgaggttctctgtaatatcgaagccgacacctattggtgtatgagcaaactacttgacggcattcaggacaactacacctttgcccagccgggtatccagatgaaagtgaagatgcttgaggaacttgtgtcccggatcgatgaacaggttcatcggcatctggaccagcacgaagtgcgatatttacagttcgcctttcgatggatgaacaacctcctcatgagagaggtgccccttcgatgcacaattcggctgtgggacacgtatcagtccgaaccagatggattcagccacttccatctctacgtgtgtgctgctttcttagtccgctggaggaaggagatcctcgaagagaaggacttccaggagctgcttctttttctgcaaaatctcccgacagcacactgggacgatgaggacatttcactgctgttggctgaggcctacagactgaagttcgcctttgccgacgcacctaaccactataaaaagtag

SEQ ID NO: 60090 - DNA, 1518 bp, Artificial Sequence
  Description of Artificial Sequence: Synthetic coding sequence
atggcggcagagaattccaagcagttctggaaacgctcggctaagctccctgggagtattcagccagtatatggggctcagcacccaccacttgatccaaggctgaccaaaaatttcatcaaggaacggagcaaagtcaacacggttcccctgaaaaataagaaagcttcgtcgtttcacgagtttgccagaaacacttctgatgcgtgggacatcggcgacgatgaagaggaggacttctctagcccatcttttcaaaccctgaattcaaaagtggcactggctaccgctgctcaagtgctcgaaaatcactcaaagctcagagtgaaacctgagcgctcccagtccaccacctctgacgttcctgctaactacaaagtgatcaagagcagtagcgacgctcaactatccagaaattctagtgacacctgcttaagaaaccctctgcacaaacaacaatcccttcccttgcgccctatcattcccctcgtcgccaggatctcggaccagaatgcttctggcgctccccctatgactgtgcgtgaaaagacccgcttggaaaaatttagacaacttctcagttcacagaacacggaccttgatgaactgaggaagtgctcctggccaggagtacctagagaggtccgccctattacctggcggctgctgtccggttacctgcccgcaaatactgagcgccgtaaattaacactgcagcgcaagcgagaggagtactttggcttcatcgagcagtattacgattccagaaatgaggagcaccatcaggacacgtaccgccagatccatattgatatccccaggacaaacccactcatccctctttttcagcagcctctagtgcaggaaatctttgagcgtatcttgtttatatgggctattcgacatccagcaagcggctatgttcagggtattaacgatttggtgactccttttttcgtcgtctttctcagtgaatatgtggaggaggatgtggaaaacttcgatgtgaccaacctgtctcaagacatgttacggagtatcgaagcggactctttttggtgtatgagcaaactgctggacgggattcaggacaactacacttttgcacagccaggcatccaaaagaaagtgaaggcgctcgaagagttggtgtcaaggatcgacgagcaagtgcacaatcacttcagacggtacgaggtagagtacttgcagtttgcctttagatggatgaataaccttcttatgcgcgaacttccgttgagatgtactatccgcttgtgggacacttaccaatccgagccagaggggttctcccatttccacttgtacgtctgcgccgcattcctgatcaagtggaggaaagaaatcttggacgaggaggacttccaaggattactaatgctgctccaaaacctgccaaccatccactgggggaatgaagaaattggactgttgcttgcggaagcgtaccgcttgaaatatatgttcgccgatgcccctaatcactatcgtaggtag

SEQ ID NO: 60091 - DNA, 2055 bp, Artificial Sequence
  Description of Artificial Sequence: Synthetic coding sequence
atggcagagggcgaagacgtgccacccttgccaacttcctccggagacggttgggaaaaggacttggaagaagctttggaagcaggtggatgtgatttggagaccctccgtaacataattcagggcaggccactccctgccgacctgagagccaaggtctggaaaattgctctaaacgtggctggcaagggcgatagtctggcatcttgggatggcatcctggatttgcccgaacagaatacaattcataaagactgtctacagttcatagaccaactgtcagtccccgaggagaaagctgctgaactcctgctggacatcgagtctgtaatcacattctattgcaagtcgcgcaacattaagtatagcacaagtctgtcctggatccaccttttaaagcctctcgtgcatctgcagctgccacggagcgacttatataattgcttttacgcaataatgaataagtatattcctagggattgtagccagaaggggaggccatttcacctgtttaggctgcttattcagtaccacgaacctgagttgtgctcatatctggataccaaaaaaatcacacccgactcttacgcattgaattggttgggttcactctttgcctgctattgctccacagaagttacgcaggctatatgggacggctatttgcagcaggctgatcctttctttatctattttctcatgttaataatcctcgttaacgccaaggaagtgatcctgacacaggaaagcgatagcaaggaggaggtgatcaagttcctcgagaacactcccagcagcctgaacatcgaggacatcgaggaccttttctccctagcccagtactactgctcaaagaccccagcttcattccgaaaagataaccaccatctgtttggttccacactgctgggtatcaaggatgatgatgcagatttatcgcaggctctctgtctggccatttccgtatctgaaattttacaggctaaccagcttcagggagaaggagtcaggttcttcgtggtcgattgccgcccagccgagcagtacaatgccggacacttgagtaccgctttccaccttgattctgatttgatgctgcagaaccctagtgaattcgcccagtctgtcaaatcactgctcgaagcccagaagcaatccatcgagagtgggtctatagcgggtggcgagcacttgtgtttcatggggtcaggaagagaagaagaggacatgtacatgaacatggtcttagcccatttcctgcagaagaataaggagtacgtctccatcgcttcagggggatttatggcattgcagcagcatctagctgacatcaatgttgacgggccagaaaatgggtacggacactggattgcctctaccagcgggagtagaagcagcataaattcagttgacggagaatccccaaatggctccagcgaccgaggcatgaaatcactggtgaacaagatgacagtggccctcaaaacgaagtcagtgaacgttcgcgagaaggtcatttcctttattgaaaatactagcaccccagtggacaggcatgtgtccagctccgacagagttggcaaaccttacaggggagttaaaccggtgttcagtattggcgatgaggaagagtacgataccgacgaaatagattcatcttccatgtccgacgatgaccgaaaggaagttgtgaacattcagacatggattaataagcctgatgtgaagcaccatttcccttgcaaggaagtcaaagaatctggacacatgttcccctctcacctactggtgacggccacgcatatgtattgcctgcgagaaattgtctctagaaagggattagcgtatattcagtcacggcaggctctcaattctgtggtcaaaatcacgagtaagaagaaacaccctgaattgattacattcaaatatggcaattcttccgcaagtggaatcgagatcctggccatagagcgctacctcatacccaatgccggagatgctacgaaggccatcaagcaacaaatcatgaaggtactggacgccttagaatcctag

SEQ ID NO: 60092 - DNA, 2100 bp, Artificial Sequence
  Description of Artificial Sequence: Synthetic coding sequence
atggccgagggggaggatgtgcccccacttcctacgagctctggagatggctgggagaaagatctggaggaggccctggaggcgggaggatgtgacctcgagaccttgcggaatatcatccaaggaaggccactgccagcagacttgcgggctaaggtttggaagattgccttgaacgtcgcaggcaaaggggattctctcgccagctgggacggcattctagatctgcccgagcagaataccatccataaagattgcctgcaattcatagaccaactaagtgtcccggaggagaaggcggctgagttgctgttggacattgaatccgtaatcactttctactgcaagtctagaaatatcaaatattcgacctctctctcatggattcacttactgaaaccactggtgcacctgcagctgcctcgtagcgatctttataattgcttctacgctataatgaacaaatacattcccagagattgcagtcagaagggccgaccctttcatctctttcgcctgcttattcagtaccatgaacccgagctgtgttcatacttggatactaagaaaattacacccgattcctacgcactcaattggcttgggtcactctttgcatgctattgctctacggaggttacacaggcgatatgggatggctacctacaacaggctgatccttttttcatctactttctgatgctgatcattttagtgaatgcaaaggaggtgatactgacacaggagagcgactccaaggaagaggtgattaaatttcttgagaacaccccatcctctcttaacatagaggatatagaggacctatttagcctggcacaatattactgtagtaagacaccggctagttttcgcaaagataaccatcacctgttcggaagtaccctgttaggaattaaggacgacgatgcggatctaagtcaggcactgtgtctggccatttctgtgtcagagatccttcaggccaaccagctgcagggagagggagttcggttcttcgtggtggactgccgcccagcagaacagtacaacgccggtcatctttctaccgcattccatctcgacagtgacctgatgctccagaatccctcggaatttgcgcagtccgtcaagagcctgctggaagcccaaaagcagtccatcgagagcgggtcgatcgcaggcggagagcatttgtgctttatggggtctggcagggaggaggaagacatgtatatgaacatggtcttggcccattttctccagaaaaacaaggaatatgtgtccattgcctcaggcggtttcatggctctccagcaacatttagctgatatcaacgtcgatgggcctgagaatggttatggacactggattgcaagcactagcggtagtagaagtagcatcaacagtgtggacggcgagtcccccaacggctccagtgaccggggaatgaaatccctggttaataaaatgaccgtggcactgaaaacgaagtcagttaacgtcagggaaaaagttatcagtttcatcgaaaacacctcaacccccgtagaccgcatgtccttcaacctaccctggcctgaccggagctgcaccgaaagacacgtttcttcgagtgaccgggttgggaagccctaccgcggtgtcaagccagtcttcagcatcggggacgaagaggagtacgacaccgatgaaatcgactcctctagtatgtccgatgacgacagaaaagaagtagtaaacatccagacctggatcaataaaccagacgtgaagcaccactttccttgcaaagaagtgaaagagagcggtcatatgttcccctctcaccttctcgtcaccgccacccacatgtactgtctcagggaaatagtcagcagaaaaggcctggcctacatccagtcacggcaggccctgaattccgtggtcaaaataacctctaaaaaaaagcatccagagttaatcacctttaagtacggaaactcttcggctagtggcatcgagatcctcgccatcgaacgctacctaattccaaacgcaggagatgccaccaaggccatcaagcagcagattatgaaagtcctggatgcactagaatcttag

SEQ ID NO: 60093 - DNA, 1689 bp, Artificial Sequence
  Description of Artificial Sequence: Synthetic coding sequence
atgggatggtactttcggcttgctcggactgaacactactctcaaaggctgcctgcagtctactgggactgctcacaaaaaggaaggccgtttcatctgttcaggctcctcatacagtaccatgagcctgagttatgctcctatctggataccaagaagattacgcccgactcctacgcattgaattggctcggctctctttttgcttgctactgcagcaccgaagtcacccaagccatctgggacggatatctccagcaagccgatccattttttatttatttcctgatgctcattatcctggttaatgcaaaagaggtgatactgacacaggagagcgattctaaggaagaagttatcaaatttctggaaaataccccttcaagcctcaatattgaggacatagaagacttattctctctggcccagtattactgttctaaaacacccgcatctttccgaaaggataaccaccacctctttggcagtaccttgcttggaattaaggacgacgacgccgacctctctcaagctctgtgcctggcaatctccgtttcagaaatacttcaggcgaaccaactccagggtgagggcgtcagattctttgtcgtcgactgccggcctgccgagcagtataatgctgggcatttatccaccgcttttcacctggacagcgacctcatgctgcagaacccgtctgagttcgctcagtctgttaagtccctattggaagcacagaagcagagtatagagtctggctccattgcaggcggagagcacctctgttttatgggttcaggtcgagaggaggaggatatgtatatgaatatggtcctagcccactttctacagaagaataaggaatacgtcagcatagcatccggcggttttatggctcttcaacagcacctggctgatattaacgtggacggacccgagaacggctatgggcactggatcgcctcaacgagcgggtcccggtcttcaattaactcagtggatggtgagagtccaaacggcagttcggaccgaggaatgaagagccttgtaaataagatgacggtggccctaaaaacgaagtccgttaacgtccgggagaaagtgatttcgtttatcgagaacaccagcactcctgtagatcgcatgtctttcaaccttccttggccagaccgttcatgcactgagcgccacgtgagcagctcagacagggtgggcaaaccctaccgcggagtgaagccagtctttagtatcggggacgaagaagaatacgacactgacgagatagactcgagctccatgtcagatgatgataggaaggaggtggttaacatacagacatggattaacaagccagacgttaagcatcactttccatgcaaagaggtaaaggaaagcggacacatgttcccaagtcacctgcttgttaccgcaacccatatgtattgtttacgtgagattgtcagcagaaaagggctggcgtacatccaatcccgacaagctttaaatagtgtagttaagatcacttccaagaaaaagcaccctgagctgattacatttaagtacggtaactcatccgcatcggggatcgaaattctcgcgatagaaaggtatctgattccgaacgcaggcgatgccaccaaggccatcaaacaacagattatgaaagttctagacgcacttgagagctag

SEQ ID NO: 60094 - DNA, 753 bp, Artificial Sequence
  Description of Artificial Sequence: Synthetic coding sequence
atggaaatggatggcgatccatacaacctacctgcgcagggtcagggaaatattataatcactaaatatgaacagggccacagagcaggcgcagcagttgatcttggtcacgaacaagtggacgtgcgtaagtataccaataatctgggcatcgtgcatgaaatggagctgcctcatgtgtctgcactggaggtcaagcagcggaggaaggagagcaaacgcacgaataagtggcagaaaatgttagccgactggactaagtaccgctcaactaagaaattgtcccagagggtctataaagttattccactggcagtcaggggacgggcatggagcctcctcttggacatcgatcgcatcaagagccaaaaccccggaaagtacaaagttatgaaggagaagggcaagcggtcaagcagaatcatccactgcatccagcttgatgtatctcacacacttcaaaaacacatgatgtttattcaacgatttggcgtgaaacagcaggaactctgcgacatattggtcgcatacagtgcctataatcccgaagttggttaccatagggacttgtctagaataacagctattcttcttctctgcctaccggaagaagacgcattctgggccctgacacagctgctcgcaggagagcggcatagtctctggtattccacagcacagatactcccgggttccagaggctcttaccgcacacggtccagatgctgtacaagtccttcccagagatcctag

SEQ ID NO: 60095 - DNA, 633 bp, Artificial Sequence
  Description of Artificial Sequence: Synthetic coding sequence
atggaaatggacgaggaccctgacaaccttcccgctcagggccagggtaacattatcattaccaagtacgagcagggccatcgggctggcgctgcagtggatctgggccatgagcaggtcgacgtgaggaaatacactaataatctgggcatagtgcacgaaatggaactgcccagggtctctgccctggaggtgaagcaaaggcgcaaggagagcaagaggactaataagtggcagaaaatgctggctgactggaccaagtacaggtcaaccaagaaactctcacagagggtgtgtaaagtcattcctctggccgtgcgcggacgggctttgtcactcctgctagatatcgacaagattaagtcacagaaccctgggaaatataaggttatgaaggaaaaaggaaagcggtctagtagaattatccattgcattcagctcgatgttagccatacattgcagaaacacatgatgttcattcagagatttggagtgaaacagcaggagctgtgcgacatattggtggcctactccgcctacaatccagttagtatcccaggccagagatactcttggtacttgtgcccttacagtcaggcctgggtgagccttgggggtgtggccacgtcctag

SEQ ID NO: 60096 - DNA, 633 bp, Artificial Sequence
  Description of Artificial Sequence: Synthetic coding sequence
atggaaatggatgaggatccagacaacctgcccgctcaggggcaaggaaacataattatcaccaaatacgagcagggccatcgggcaggcgcagctgtcgacttagggcatgagcaggtggatgttcgtaaatatacaaataatctcggcatcgttcatgagatggaactgccaagggtatcagccctcgaggtgaagcagcggagaaaggaaagtaagcgtacaaataaatggcaaaagatgctggccgattggaccaagtataggtcaactaagaaactgtcccaacgtgtgtgcaaggtaattcctcttgctgtgaggggcagagctctttccctacttctggacatcgacaagatcaagtcacaaaatcccggaaagtacaaagtcatgaaggagaaagggaagcgaagcagtaggatcatccactgtatacagctggacgtgagtcacacgctgcagaagcacatgatgtttatccagagattcggagtgaagcagcaagagctgtgcgacatcttagtcgcgtattcagcgtataatcctgtgagcattcctggacagaggtactcctggtatctctgtccctattctcaggcgtgggtttccctgggtggggtggctacatcttag

SEQ ID NO: 60097 - DNA, 453 bp, Artificial Sequence
  Description of Artificial Sequence: Synthetic coding sequence
atgggtcacctagacaaggaagggctgtgcacacagggctctagtttcagctggttactgcgggttctaaacgacggaatttctcttggcctgaccccctgtctgtgggatatgtatctattggaaggagaacagatgctgatgctaatcacaagtattgcattcaaggtccaaagatcactgtatgaggaaactaataaagagacctggggccctgctacgcctcgggcacttaagggtaccggcagggcccgaccgatttgcgagtcgttgcactcctccctacaggccctcacggccagtgaatcatccaggggtccgtctctgctgcagacaccacccagagtgcctgggcagcaggctctgtctaggggagacaaagggatctcggtttccttgtcactgccttccctgccttctcgtcggggaaggtgtgggaggattatcggctag

SEQ ID NO: 60098 - DNA, 246 bp, Artificial Sequence
  Description of Artificial Sequence: Synthetic coding sequence
atgggtcacctcgataaagaaggcctgtgcacccaggggtccagcttcagttggctgttaagggtcttgaatgatggcatctctttgggtttgacgccttgcctttgggatatgtacttgttggagggcgaacagatgttgatgcttattacttctatagcttttaaggtccagcgacggccaagccgcgctcttgaagaaccagatccattcgtgagagcttccacaccaccatgtaaacgatag

SEQ ID NO: 60099 - DNA, 2892 bp, Artificial Sequence
  Description of Artificial Sequence: Synthetic coding sequence
atgcccggtgcaggtgcgcgagcggaagagggcggaggtggcggtgagggggcagcccagggagcagcagccgagcccggtgccggaccagcaagagaacctgcccgactttgcggttatttacagaagctcagcggcaagggaccactacgcggataccgatcacgctggttcgtcttcgacgccaggaggtgttacctgtactatttcaaatctccacaggatgccttgccactgggccatcttgatatagcggacgcttgtttcagttaccagggacccgacgaggccgctgagcccggaactgagccacccgcacactttcaggttcattcggcaggtgctgtgaccgtgctcaaagcgccaaacaggcagctaatgacatactggttgcaggagcttcagcagaagaggtgggaatattgcaatagcctggatatggtcaagtgggattcccgcacatctccaactcccggtgacttccccaaggggctggtcgcacgcgacaacaccgatctgatctatcctcacccaaacgccagcgccgagaaggctagaaacgtacttgctgtggagaccgtccccggagaattagtgggtgagcaggcagccaaccaaccggctcccggtcaccctaactctatcaacttttattccctgaaacaatggggcaacgaactgaaaaacagtatgtcaagctttaggcctgggcgagggcataatgactcgcgacggacagtgttttacacaaacgaagagtgggagctattagaccctacgcctaaggatctcgaggaaagtattgtccaggaggaaaagaaaaagcttactcctgagggaaataagggcgtgacaggatccggctttccattcgactttggtagaaacccttacaaggggaaaagaccgttgaaagacattattggcagctataagaaccgccactcatcaggcgatccatcatcagagggcacctctggttcagggtccgtgtcgatcaggaagcccgcatcagaaatgcagcttcaggtgcaatctcagcaggaggagcttgaacagttaaaaaaagacctttcatctcagaaagaactggtgcgactgctccagcaaactgttcgttcgagccagtatgataagtatttcacgtcaagtaggttgtgtgagggggtacccaaagacacgctcgaacttctgcaccagaaggatgaccagattctgggactcacgtcacagctggagcggttctccctggagaaagaatctctccagcaggaggttagaaccctcaagagcaaagtcggcgagttgaacgagcagttgggaatgctgatggagaccatccaagcaaaagacgaggtcattattaagcttagcgaaggggaaggcaacggtccccctcctactgtggccccttcttcaccttcagtggtccctgtggcgagggaccagcttgaactggatagactgaaggacaacctgcaggggtataaaacacaaaataaattcctgaacaaagaaatcctggaactcagtgcactccggagaaatgctgagaggcgcgagcgcgatctgatggccaaatactccagtctcgaggcgaaactgtgtcagatagaatctaagtatctgatactgctgcaggagatgaaaactcccgtgtgctcggaagaccagggcccaacccgagaagtgatcgcccaactgttggaagatgctttgcaggtggaaagtcaagagcagccggaacaagcttttgtcaaaccccatctagtgtccgaatacgacatttacggtttcagaacagtccccgaagatgacgaagaggagaaactagtagccaaggtgagagccctggacctgaagacgctgtacctgactgagaatcaggaagtgtctacaggggtcaaatgggagaattactttgcgagtacagtgaatcgcgagatgatgtgctcaccagagttaaagaatctgatccgagccggaatcccacatgagcatagatctaaagtttggaagtggtgcgttgacaggcacacacgtaagttcaaggacaacaccgagcctggacattttcaaacgctgttgcagaaggctctggagaagcaaaacccagccagtaagcagatcgagctggacctgctgcgcaccttgccaaacaacaaacattacagctgtcctacttcggaggggatccagaagctgagaaatgttctcctggccttttcgtggagaaatccggatattgggtactgccagggtttgaatcgtctggttgcggtggcactgctgtacctggagcaggaagacgcattttggtgcctcgtcacgatagtggaggtgtttatgccacgagactactacactaaaacactcctaggttctcaggtggatcagagggttttccgggatttgatgagcgagaagcttcccagattgcacggccactttgaacagtacaaagtcgactacactctgattactttcaactggttcctggtggtgttcgttgattctgtcgtgtccgacattctgttcaagatttgggacagttttctttacgagggccctaaagtgatattccgatttgcgttagccttgttcaagtacaaggaagaagagatcctcaaactccaggactctatgagcattttcaagtacctcagatatttcactcgcacaatcttggacgccagaaagctaatttctatttcttttggcgacctgaatccattcccactgcgacaaattagaaataggcgagcttatcacctggagaaagttaggctggagctcacagaactggaagctattcgcgaagacttcctacgggagcgggacaccagcccggacaagggagagctagtgtcggacgaggaagaggatacctag

SEQ ID NO: 60100 - DNA, 2745 bp, Artificial Sequence
  Description of Artificial Sequence: Synthetic coding sequence
atgcccggtgccggtgccagagctgaggaggggggtggcggaggggaaggggcagcccagggagccgctgccgaacctggggctggacctgcaagggaacctgcgagactttgtggttacctacaaaaactatctggcaaggggcctctgaggggatacagatcgaggtggttcgtgttcgatgctcgccgttgctatttatattactttaagagtcctcaggatgccctccctcttgggcatctcgacattgctgacgcgtgcttctcgtaccaagggcctgacgaggcggctgaacccggaactgaacctcctgcccactttcaggtgcactcagccggagccgtgactgtgcttaaggcgcctaacaggcaactcatgacatattggctgcaggaacttcaacagaaaagatgggagtattgcaatagcctggacatggttaaatgggattcgaggacctctcctacacctggcgactttccaaaagggcttgtggcccgagacaatactgatctgatctatccccacccaaacgcctctgctgagaaagcccgtaacgtgctcgcagtagagaccgtgcccggagaactcgtgggagaacaggccgcaaaccagcctgcacccggtcatcctaacagcatcaacttttacagtcttaaacagtgggggaacgaactaaagaactcaatgagttctttcaggccgggacggggacacaatgacagccggagaaccgtgttctacacgaacgaggaatgggaactgctggacccaactccaaaggacctagaagagtcaatcgttcaggaggagaaaaaaaaacttacccccgagggcaataagggagttacagggtcagggtttcccttcgatttcggcagaaacccatacaaggggaagcgcccattaaaagacatcatcggatcctacaagaacagacactcaagcggagaccccagctctgagggaacatcaggctcgggctctgtaagtatacggaaaccggctagtgagatgcagctgcaggtgcagagtcagcaggaggaattagaacagctcaagaaagatctcagttctcaaaaggaactggtccgactgcttcagcagacagtgcgaagctcccagtacgacaaatatttcacgtcctcccgtttgtgcgagggggtgcccaaagacacactagagcttcttcaccagaaggatgaccagattctcggtctgacctctcagctggagcggtttagccttgagaaggagtcgctgcagcaagaagttagaacgctgaaatccaaggtgggcgaactaaacgaacagctaggcatgctcatggaaaccatacaggcaaaagacgaggtgatcattaagctgagcgaaggcgaaggcaatggccctcctccgacagtcgccccatcatcacctagcgtggttcccgtggcccgtgaccagttggaactggataggcttaaggataacctgcagggctataagacccagaacaagttcctcaataaagaaatccttgagctgtcagctctgaggcgcaacgccgagcgtcgcgaacgcgaccttatggcaaagtattcatctctcgaggctaagctctgccagattgaatctaagtacctcatcttattgcaggaaatgaaaacccctgtgtgttccgaggatcaaggtcccacaagagaagtgattgcccagctcctagaggatgccctccaggtggagagtcaggagcagcccgagcaggcattcgtgaagcctcatctggtgtctgagtacgatatctacggcttcaggactgtgccagaggacgatgaggaagagaagctggtagcaaaagtaagggctctggacctgaagactctgtatctaaccgagaatcaggaagtgtccactggtgtgaagtgggaaaactacttcgccagcactgtgaaccgcgagatgatgtgttccccagagctcaagaacctgatcagagctggcattccccacgagcacagatcaaaggtgtggaagtggtgtgtggacaggcacactcgaaagtttaaagacaacactgagccaggtcattttcaaaccctcctgcagaaagctctggagaagcagaatcccgcttccaagcagatagagctggatttgttacgcacactacctaacaacaaacactattcatgccctaccagcgaaggcatccaaaaattgagaaacgtgttactggccttttcatggcgtaatcccgacattggatactgtcaaggcctcaacagactggtggcagttgccctgctctacctggaacaggaggatgcgttttggtgtttggtgacgatcgtcgaggtgtttatgcctagagattattataccaagacactcctgggatctcaagtggaccagagagttttccgcgacctgatgagcgagaagctacctcgattgcacgggcactttgagcagtacaaggtagattacacactcattacatttaattggtttctggtggtcttcgtggactcagttgtgtccgatatccttttcaaaatatgggacagttttctgtatgaggggccaaaggtgatcttcaggttcgccctcgctttgttcaaatacaaggaagaagaaattttaaagctgcaggattcgatgtccatctttaagtatctgcgctacttcacaaggactattctcgatgcgcgaagtggcaccgatgctccgaccacttggcgcaagtccggatggagttag

SEQ ID NO: 60101 - DNA, 768 bp, Artificial Sequence
  Description of Artificial Sequence: Synthetic coding sequence
atggtgcttgaactgaacgccagcgatgacagagggatcgatattattcggggaccaatcctttccttcgcctcaacccgcacaattttcaaaaagggcttcaagctcgtgattttggatgaagccgacgcaatgacccaggacgcccaaaacgctttgcgcagggtgatagagaaattcaccgaaaatacaaggttctgcttgatttgcaattatctctccaagattatcccggctctgcagtctagatgtacccggtttagatttggacccctcacgcccgaactgatggtgccacgcctggagcacgttgtcgaagaagaaaaggtggatattagcgaagacggcatgaaggctctggtgacacttagcagtggggatatgcggagagcactcaatattctgcagtccacgaacatggcatttggaaaggttacagaggaaactgtatatacatgcaccggccatcccctgaagtctgatattgccaatattttggactggatgttgaaccaggacttcaccaccgcttaccgcaacattactgagctcaaaaccctgaaaggactagccctgcacgacatcctgacagaaattcacttattcgttcaccgagttgactttccatctagtgtcaggatccacctcctcacaaaaatggccgacatagaataccgcctgagcgtgggtactaatgagaagattcagctatcaagcctgatcgcggcatttcaagttactagagatctgatagtggccgaagcctag

SEQ ID NO: 60102 - DNA, 1734 bp, Artificial Sequence
  Description of Artificial Sequence: Synthetic coding sequence
atgcgacaggacaagcttaccgggagcctcaggcgcggtggtcgctgcctgaaaagacaaggcggaggggtcgggacaattctttcaaacgtcctgaagaaacggagctgcatcagtagaaccgccccacggttgctgtgcacacttgaaccaggggtcgataccaagctgaaattcacactggaaccatcgctgggccagaatggctttcagcagtggtatgacgctctgaaggcggtggcaaggttaagcaccggcatcccaaaagaatggcggaggaaagaccttcatcgcacaggatgtagcagctactgtggacaagaggccgagcaagatagagtagttctcaagcgggttctgcttgcctatgcacggtggaacaagacagtgggctattgccagggcttcaacatcttagccgcactgattttggaggtgatggagggcaatgagggcgatgctctcaaaatcatgatttacctcatcgacaaggtccttcccgaaagctatttcgtgaataacctacgcgctcttagcgtagacatggccgtcttcagggatctactgcgaatgaagcttcctgagctgagccagcatctggacacattacaaaggaccgctaataaagagtcaggtggtggctacgaacccccattaacgaacgttttcactatgcaatggtttctaaccctctttgccacctgtctgccaaaccaaacagtgctcaaaatctgggattctgttttttttgagggcagcgagataatcctgagagtgtctctggccatttgggctaagctgggggagcagatagagtgctgcgagactgctgatgagttctactcaactatggggaggcttacccaagagatgttggaaaatgacctgctacaaagccacgaactgatgcagactgtgtactccatggccccattccccttcccacaattagccgagctccgggagaaatacacatacaacatcaccccctttcctgccaccgtgaaaccgaccagcgtctcgggaaggcatagtaaagcccgtgattccgacgaggaaaacgatcccgatgacgaagatgccgtggtgaatgcagtgggctgtctggggccttttagcggctttctagcccctgaacttcagaagtaccagaaacagatcaaggagcctaatgaggaacagtcattgaggtccaataatatcgcagaactgtcccccggagctatcaattcctgccggtccgagtaccatgcggctttcaactctatgatgatggagcgcatgactaccgatatcaatgcactcaagaggcagtactcaaggattaagaagaaacagcagcagcaggttcaccaagtgtacattagagctgacaaaggacccgtaacgtcaatcctgccatcccaggtgaactcttctcccgtgatcaaccacttattacttggcaaaaagatgaaaatgaccaaccgcgcagctaaaaacgctgtgatccatatccccggtcatacaggcggaaaaatttcccctgtgccatatgaagatcttaagaccaagctaaatagcccatggaggacccacatccgcgtgcacaagaagaatatgccgaggaccaagtcccaccccggatgcggtgataccgtggggctcatagatgagcaaaacgaagcctccaagacaaacggcctgggcgctgccgaggcttttcctagcggatgcaccgccggacaagggtag

SEQ ID NO: 60103 - DNA, 1914 bp, Artificial Sequence
  Description of Artificial Sequence: Synthetic coding sequence
atgcgccaagataaactcacaggctcactacgaagaggcggtcggtgtttgaagcgtcagggtggaggcgtgggcacgatcctgtccaacgtgctaaaaaagaggagctgcatcagcaggacagcaccccgattactgtgcaccctggaacctggcgtggacacaaaactgaagttcacattagagcccagcctcggacaaaacggcttccagcagtggtacgatgccctgaaagctgtcgcgcgactttctactggcatacctaaagagtggaggaggaaagtctggcttacgttagctgaccactacctgcacagtattgctatcgactgggacaagaccatgaggttcacttttaacgaacgatctaaccctgacgatgactcaatgggaattcagatcgtaaaggacctccatcgcacggggtgttcaagctactgcggccaggaagcagaacaggatcgggtggtgctgaagcgagtcttgctggcctacgccagatggaataaaacggttggctactgccaaggctttaacatactggctgcgttgatactggaggttatggaagggaacgagggggacgcactaaagatcatgatctatctcattgataaagtgctaccagaatcttatttcgtgaataatttgagagcactgtcagtagacatggctgtgttccgcgacctcttgcgtatgaaattgccagagctgagccagcaccttgacacccttcaacggactgcaaataaagaaagtggcggaggatatgaacctccattgaccaacgtcttcacgatgcagtggttcctgacgctgttcgccacatgtttacccaaccaaactgtgctcaagatttgggactccgtcttcttcgaaggcagcgaaatcatattacgagtgtctcttgccatttgggcgaagctgggagaacagattgagtgctgtgaaactgccgatgagttctacagcaccatgggacgattgactcaggaaatgctagaaaacgatctgctgcagagtcacgagttgatgcagactgtctattccatggcgccattccccttcccccagttggccgagctgagagaaaaatatacctataatatcaccccgttccccgctacagttaaaccaactagtgtgagtggcaggcactccaaagcgagagattcagacgaggagaatgatccagatgacgaagatgccgtcgtcaatgccgttgggtgtctgggcccattttcaggctttctagctcctgagctgcagaaatatcaaaaacagatcaaggaacccaacgaagaacagagtctgcgtagcaataatatcgcagaattgagccctggggcaattaactcctgtagatccgaatatcatgccgcttttaacagtatgatgatggagaggatgactactgatattaatgctcttaagcgtcagtacagcaggatcaagaagaagcaacaacaacaggtccatcaggtctacataagagcagataaagggcctgtgaccagcatactccccagtcaagtcaattccagtcccgtcataaaccacctgctgcttggaaaaaaaatgaagatgaccaatagagccgctaagaacgccgtaatccacattccaggacataccggtgggaaaattagcccagtcccttacgaggacttaaaaaccaagctaaattccccgtggcggacccatatacgggttcacaaaaagaacatgcctcgtaccaagtctcaccccggatgcggggatacagtgggtctcatcgacgaacaaaatgaggcttcaaaaaccaatggattgggcgctgcggaggcatttcccagcggctgtacagccactgccggacgggaaggaagcagcccggagggatcttcttcttataaaagtctgcagatgatatag

SEQ ID NO: 60104 - DNA, 2388 bp, Artificial Sequence
  Description of Artificial Sequence: Synthetic coding sequence
atgtaccactccttgtcagaaacgagacacccactgcaacccgaagagcaggaggtaggaattgatcccctctcctcctacagcaataaatccggtggcgactcaaataaaaacgggcgtcgcacctcttcaacattggattccgagggcacctttaactcatacagaaaagagtgggaagagctgtttgtcaataacaactatctggccaccatccggcagaaggggatcaatggccagctgcgctcatcccggttccgcagcatctgctggaagctattcctttgcgtcttgcctcaagacaagagccaatggatctctcgtatcgaagagctacgggcatggtactcaaacataaaagaaatccacattaccaatccacgaaaagtggtaggccagcaggacctgatgattaataaccccttatcccaggacgaggggtctctgtggaataagttcttccaagataaggagctcaggtccatgatcgagcaagacgttaagcggaccttccctgagatgcaatttttccagcaggaaaatgtgcgcaaaattcttacggatgtcctgttctgctatgcccgtgaaaacgaacagctcttatataaacagggaatgcacgagttacttgctccgattgtgtttgtgctgcactgtgatcaccaggctttcctgcacgcctcagaaagcgcacagcctagtgaggagatgaaaaccgtgctgaacccggagtaccttgaacatgatgcttacgccgtcttcagtcagctcatggagactgccgaaccatggttctcaacattcgaacacgatgggcaaaaaggtaaggaaacgctgatgacccccattcctttcgcccgtcctcaggacctcggccctactatagccattgtgactaaggtgaaccaaatccaggatcaccttctcaaaaaacacgacattgagctgtacatgcatctgaatcgtctggagatagcccctcaaatttatggcctcaggtgggttcgtttgttattcggcagggagtttcctctgcaggatctgcttgtcgtctgggatgccctgttcgccgatgggctgtccttaggactggtggattacattttcgtggctatgcttctctatattagagacgccctaatctcaagtaactatcagacatgtctgggtttgttgatgcactatccttttatcggagatgtccattctctgatcttgaaggcgctattcctgagggacccaaagcgcaaccctcgccctgttacttaccagtttcacccaaacctggattattacaaggctagaggcgcagacctcatgaataaaagtcggacaaacgccaagggggctcctttaaacattaataaggtcagcaattctctgatcaattttggcagaaaattaatcagccctgctatggcaccaggctccgctggcggaccagtgcccggtgggaacagctcaagctcctcctcggtcgtgatcccaaccagaacgagtgccgaagccccttcccaccacctccagcaacagcagcagcagcaaaggttgatgaagagcgaaagtatgccagtgcaactgaataagggcctgtcaagcaaaaatatctccagctccccttcagttgaatccctaccaggaggacgtgagtttacaggcagtccaccttccagcgcgacgaagaaagattcgttctttagcaacattagccgctcaaggtcacacagcaagacgatggggcgtaaggaaagtgaagaagagctggaagcccagatttcgtttctacaaggacaactgaatgacctggacgctatgtgtaaatattgtgctaaagtgatggacactcatctggtaaacattcaggatgtcatcctgcaggaaaatcttgagaaagaggatcagattctggttagcctggccggtctgaagcagataaaggatattctgaaaggaagcttacgcttcaaccagtcccagctggaagccgaggagaacgaacagattacaatcgctgataaccactattgtagttccgggcaaggccagggcagaggtcaggggcaatctgtgcagatgtccggcgcaatcaagcaggcctcatccgagacccccggatgtacagatagagggaattctgacgactttatcctgatttcaaaggacgacgacggatcgagtgccagaggcagtttctctggacaggcccaacctctacgcacactgagaagcacaagcggtaagagccaggcgccagtgtgttctcctctggtgttcagtgatcccctcatgggtccggcatcggccagttccagcaatcccagctcctctccggacgacgactcgtccaaagattctggctttaccattgtgtctcctctggacatatag

SEQ ID NO: 60105 - DNA, 552 bp, Artificial Sequence
  Description of Artificial Sequence: Synthetic coding sequence
atgtaccactcattgtccgagactcggcaccctcttcagcctgaggagcaagaggtggggatcgatcctttaagttcatactcaaacaagagcggaggtgactcaaacaagaacggaaggcggacctcttcgaccctggatagcgaaggcaccttcaactcttaccgtaaggaatgggaagaactcttcgtcaacaacaactacctggcgaccattcgccaaaagggtatcaacggacaattgcggtcttccaggtttcggagcatctgctggaaactcttcctgtgcgtgttacctcaggacaagtcgcaatggataagtcgcattgaggagttaagggcttggtactccaacatcaaagagattcacattaccaatcctcggaaggtggtgggacagcaggacttaatgatcaataatcctttgtcgcaggatgaaggaagcctgtggaataagttctttcaggacaaggaactgaggtcaatgatagaacaggacgttaaaagaactttccccgagatgcaatttttccagcaagagaacgtgaggtag

SEQ ID NO: 60106 - DNA, 2388 bp, Artificial Sequence
  Description of Artificial Sequence: Synthetic coding sequence
atgtaccacagcctctccgagacacggcaccctctgcagcccgaggagcaggaggtggggatcgacccacttagctcttattctaataagtccggaggcgactccaataaaaatgggcgtcggaccagttccacactagactccgagggcacatttaacagttatcgcaaagagtgggaagagctgtttgttaataacaactacctggcaaccatacgtcagaagggcattaacggacagttacgctcatcaaggtttcgttctatttgttggaagctatttctgtgtgtgctaccacaggacaagagccagtggatcagccgcattgaggaactccgcgcatggtactcaaatataaaggagattcacattaccaatcctcggaaggtcgtggggcaacaggatctcatgattaacaatccactgtcgcaagacgagggctctctctggaataaattttttcaagacaaagagctacgttcaatgatcgaacaggacgtgaaaaggacattccccgagatgcagttcttccagcaagaaaacgtgcggaagatcctgactgacgtactgttttgttacgcacgtgagaatgaacagctcctttacaaacagggcatgcatgaattgttggctcccatcgtcttcgtattgcactgtgatcaccaggctttcttacacgctagtgagagcgcccagccttctgaagaaatgaagactgtcctgaaccctgagtacctggaacatgatgcatatgccgtgttctctcaactgatggaaacagctgagccatggtttagcacattcgaacacgatggtcaaaagggcaaggagaccttgatgactcctattccatttgctcgccctcaggacctcggccctactatcgctatagttactaaagttaaccaaatccaggatcatttgctgaagaagcatgatatcgaactttacatgcacctaaatcggcttgagattgccccacagatttatggactgcggtgggtccggctgttgttcggaagagagtttccactccaggacttgttggtcgtgtgggacgctctgttcgccgacggcctgagcctcggactggtggactacatcttcgtggccatgctcctctatattagagacgcattaatctcctccaattatcagacttgcctgggccttcttatgcattatccctttataggagatgtccatagcctgatcctcaaagcgctgttcctccgcgaccctaaacgtaatccccgtccggttacctaccagttccacccaaacctggactattacaaagcaaggggagcggatctcatgaacaaatctcgaactaatgccaaaggcgctcccttgaatattaataaggtgtcgaatagcctgatcaatttcggtcgcaaacttatctcaccagccatggccccaggtagcgcaggaggaccagtccctggcggaaacagtagtagctccagtagcgtggtgattcccacccgcaccagtgccgaagctccatctcaccacctgcagcagcaacagcagcagcagaggttgatgaagagtgagtcaatgcctgtccagctcaacaaggggctctcaagcaaaaatatttccagcagccctagtgtggagagcttgcctggtggaagggaatttaccggatcgccgccatcttctgccactaaaaaggatagtttcttttccaacataagtcgcagccggtcccactccaaaacaatggggagaaaggagtcagaggaggaattggaggcacagattagcttcctgcagggtcagctcaacgacctggacgcaatgtgcaagtactgcgccaaagtgatggatacacatctggtgaatatccaggacgtaattttacaggaaaacttggaaaaggaggaccagatcctcgtatcccttgccggtctcaagcaaatcaaggatattctcaaagggagccttagattcaaccagagtcagctggaggccgaggagaatgagcagattacgattgccgataaccattactgctctagtggccaaggacagggcagaggacagggacagtcagtgcagatgagcggcgcaattaagcaagcctccagcgagactcccggatgtaccgatagaggcaatagtgacgattttattcttatctcaaaggacgatgacggtagcagcgccagaggctcattttctggccaggcacagccattgcgcaccctccgcagcacctctgggaaatctcaagctcctgtgtgtagccccctggttttcagtgaccccctgatgggacctgcttcggcttcctcctcgaatccaagttccagtcctgatgacgattcttcaaaagattcagggtttactatcgtcagtccgcttgatatatag

SEQ ID NO: 60107 - DNA, 267 bp, Artificial Sequence
  Description of Artificial Sequence: Synthetic coding sequence
atgtaccattccctgagcgagactaggcacccattgcagccagaagagcaagaggtgggaatagatccattgtcttcctatagtaataagagcggcggtgattctaataagaacggccgaaggaccagttccactctggatagtgaaggaactttcaatagctatcgtaaagagtgggaagagcttttcgtgaataacaattatttagccactatccgacagaaaggcatcaacggccaactcaggagtagtcgcttccggtcttag

SEQ ID NO: 60108 - DNA, 3423 bp, Artificial Sequence
  Description of Artificial Sequence: Synthetic coding sequence
atgtggttgaaacctgaggaagttttattaaagaatgcacttaagctgtgggtgacacagaaatctagctgttattttatcctgcaacgtagaagaggccatggtgagggcggaggacggttaaccggcaggctggtcggtgctctggatgctgtcttagattcaaacgcacgagtggctcctttccgaatcttattgcaggtaccgggttcccaagtttactctcccattgcttgcggagcaactttagaggagattaaccagcattgggattggctggagcaaaaccttttgcacacgctgtcagtctttgataacaaggacgatatagcctcttttgtgaagggcaaggtcaaagctctgattgccgaagaaacctcctcccgccttgccgagcaagaggaggaaccggagaagtttcgtgaggccttggtgaagttcgaggctcgcttcaacttccccgaggccgagaaattggttacatattacagctgttgttgctggaaggggcgtgtaccgaggcagggatggctatacctgtcaataaaccatttgtgtttttactcattcttcttaggcaaggaattaaagctggttgttccctgggtggacatacagaagcttgagcgtactagcaatgtgttcttaacggacacaattagaataaccacccagaacaaggaacgggatttttcaatgttcttaaacctggacgaagtgttcaaagttatggagcagctggccgacgttacactccggcgacttctcgataacgaagtgttcgatctggacccggacctccaggagccaagccagattaccaagcgcgacttggaggccagggcccaaaacgagttcttccgggcttttttccgcttgccacgaaaggaaaaattacatgcggtcgtggattgcagtctgtggaccccattctccagatgtcatacaaccgggagaatgtttgcttccgactcgtacatctgcttcgcctcccgtgaagacggatgctgcaaaatcattctgccactgcgcgaggtcgtgagtatcgaaaaaatggaagacacgagtcttctgcctcaccccatcatcgtctccataaggtctaaggtggcatttcaatttatcgaactgagagatcgcgactcattagtggaggctttactcgccagactaaagcaggtgcatgccaaccatcccgtccactacgataccagtgctgatgatgatatggcgtccttagtctttcattcgactagtatgtgttcagaccatcggtttggcgatctcgagatgatgtcaagccagaattcagaggaatcagaaaaggagaaatcccccctaatgcatcctgacgccctggtgaccgcatttcagcaatctggatctcagagtcctgattcccgcatgtcaagagaacaaattaagattagtctttggaacgatcatttcgtcgaatacgggagaacagtatgcatgttccggacggagaagattcgtaagttggtggccatgggaatacccgagtccctacgagggagattgtggctccttttctccgacgctgtcacagatctggctagtcacccaggatattatggtaatcttgtggaggaatccctgggtaagtgctgtcttgttacagaggagatagagcgggacctgcaccgtagcctgcccgagcaccccgcattccaaaatgaaaccggcatcgccgcactcaggcgtgtgttaactgcctatgcgcaccgtaatccaaagatcgggtactgccagagcatgaacatcctgacctccgtgttattgctctacacgaaggaggaagaggctttttggctgcttgtcgcagtgtgcgagagaatgctgccagattatttcaatcaccgggtgattggggctcaggtcgaccaaagtgtttttgaggagctaattaagggacaccttcctgaactggctgagcatatgaatgatttaagcgctctagcatctgtctccctatcctggtttcttactctgtttctttccataatgccactggagtccgctgtcaacgtggtggactgcttcttctatgacggaatcaaagccatcttccagctgggacttgcagtcctagaggctaatgctgaagatctgtgctcctccaaagacgacggacaggctctgatgatcctatcccgttttctcgaccatattaagaatgaggatagccccggacctcctgtggggtcccatcatgccttcttcagcgacgaccaagagccgtatccagtaacggacatttctgatttgattagagactcttatgagaaattcggagatcagagcgtcgaacagatcgagcaccttcggtacaagcaccggatcagagtgctgcaaggccacgaggacaccactaagcaaaatgtgctgagagtggtgatcccagaggtctctattctacctgaggacctggaagaactgtacgatctgttcaagcgggaacacatgatgtcatgttactgggagcagccaagaccaatggcttcaagacacgacccttccaggccttatgcagaacagtaccggattgatgctcgccagttcgcccatctgttccagctagtgagcccctggacctgcggcgcacacaccgagattctggctgagcgcaccttcagactgcttgacgataacatggaccaactcattgagtttaaagcgtttgtaagttgtcttgacattatgtacaatggcgaaatgaacgagaagattaagctactttaccgcctgcacattccaccggcactgaccgagaacgatagagacagccaatcacccctcaggaatcccctcttatctacctcccggccactggtgtttggcaagccgaacggggacgctgtcgattaccaaaagcagctcaagcaaatgattaaggacctggccaaagaaaaggataagaccgagaaggaattacccaaaatgagccagcgggagttcatacaattttgcaaaaccctgtattcaatgttccacgaagaccccgaagaaaacgatctgtatcaggcaatagcaacggtgacaactctactgctccagattggtgaggtcggccagcggggttcgtctagcggaagttgcagccaggagtgtggagaagaactgagagcctcggccccatcccctgaggattcagttttcgctgatactgggaaaacaccccaggattctcaggcattccctgaagctgctgaacgggactggaccgtctcgctggaacatatccttgccagcctgcttactgagcaatctttggttaattttttcgaaaagcctctcgacatgaaatcaaaacttgagaacgccaagatcaatcagtacaacttaaagacatttgaaatgtctcatcaaagccagtctgagctcaagctgtccaacctctag

SEQ ID NO: 60109 - DNA, 3468 bp, Artificial Sequence
  Description of Artificial Sequence: Synthetic coding sequence
atgtggctgaaacccgaagaggttctgctcaagaacgcgctcaagctgtgggtaacccagaagagttcctgttattttattctccaacgaaggaggggacacggtgaaggaggagggagactgaccggcaggctcgttggtgcactcgatgctgtgctggacagtaacgctagggtggcccctttccgcatattgctccaagtcccaggctcccaggtgtactcccctattgcttgtggcgaattactcaacggatccgatgtgtattgggcgatcgctaccggtgctactctagaggagattaaccagcactgggactggttggagcagaatctgctgcacactctttcagtattcgacaacaaagatgatatagcttctttcgtaaagggcaaggtgaaagcactcattgcggaggaaacatcttcaagattggccgagcaggaggaggaacccgagaaatttagagaggctctggtgaagtttgaggcccgatttaatttcccagaggccgagaagctggtaacctactactcttgttgctgctggaagggccgagtcccgaggcaaggatggctctacctcagtataaaccacctgtgcttctatagcttttttctcggaaaagaactgaagttggtcgtcccctgggtggatatccagaagctcgaacgcacctccaacgtgtttttaacggataccattcggattaccactcaaaataaggagcgggacttctctatgtttctgaatctggacgaagttttcaaagtcatggagcagctggccgacgtcacactgcgtcgcctacttgataacgaagtttttgacttggatcccgacttgcaggagccatctcagatcactaaacgcgaccttgaggccagagctcaaaatgaatttttccgggcattttttcgcctgccgagaaaggagaaattacacgccgttgtcgactgtagcctctggacacccttcagccgttgtcatactactggacgcatgtttgcgagtgattcatatatctgcttcgcgagtagagaggacggttgttgcaaaataattttacccctccgagaggttgttagtattgagaagatggaggacactagcctcttgcctcatcctataatcgtgtcaattcgaagcaaggtcgcatttcagttcatagagcttcgcgatcgcgacagccttgtcgaggccctgctggcacgtcttaaacaggttcatgcaaatcatcctgtccactatgacacatcagctgacgacgacatggcatctttagtgttccactccacttctatgtgttctgaccatagatttggggatctggagatgatgagctcacagaactcagaggagtctgagaaggagaagtctccactcatgcaccccgatgccctcgttaccgcattccaacaaagcgggtctcagtcccccgattctaggatgagcagggaacagatcaagatcagcctatggaacgaccatttcgtggaatacgggagaacagtgtgtatgtttagaactgagaagatccggaaactcgtcgcgatgggaataccagagagtctgagggggaggctgtggctactctttagtgacgccgtgaccgatcttgccagccaccctgggtattatgggaacctcgtcgaagagagcctggggaagtgctgcctggtgacagaggagatcgagcgagacctgcaccgatcattacctgaacaccctgcgttccaaaatgaaaccgggattgccgcactaagacgtgtgcttactgcttacgctcaccgtaacccaaaaatcggctactgccagtcaatgaacatccttacttcagtgctccttctgtataccaaggaagaggaggccttttggcttctggtggcagtctgtgagagaatgctgcctgattatttcaaccaccgcgtgataggagcacaggtagatcaatctgtgttcgaggagctgattaaaggccatctcccggagttagctgaacacatgaacgatctgagtgctctggcgtccgtgtccttatcatggttcttgaccctgttcctgagtatcatgcccctggagtcggcggtgaacgtggttgattgtttcttctatgatggaattaaggctattttccaactggggctggccgttctggaggcaaacgccgaggacctgtgcagctccaaggacgatggtcaggcattgatgatcttaagtcgctttttagatcatataaagaatgaagactcccctggacctcccgtgggatcccaccacgcctttttttcagatgatcaggagccttaccctgtcacggatataagtgatctgatcagagactcctatgagaaattcggggatcagtctgttgaacagatcgagcacctgaggtacaagcaccgcatcagggtcctgcaggggcacgaggacacaaccaaacaaaacgttctcagggttgttatcccagaagtgtccattctgcccgaggatctggaagagctgtatgatctctttaagcgcgagcatatgatgtcctgttactgggaacagccacggccaatggcgtcaaggcatgacccaagcagaccttatgccgaacaatatcgcattgacgcccgacagttcgcccacctctttcaattagtctccccatggacctgcggggcacataccgagatactcgcagagaggacattcagactcttggatgataacatggaccaactgattgaattcaaagcttttgtgagctgtctggatattatgtacaatggcgagatgaacgaaaaaataaagttgctgtacaggctgcatattcccccagccctcaccgagaatgatcgcgactcacagagccctctaaggaacccattgctaagtacctcacggccattggtgttcggtaagcccaacggagatgccgttgattatcagaaacaacttaaacagatgattaaagacctggcaaaagagaaagataagactgaaaaggaactgcccaagatgagccagcgagagtttattcagttttgcaagaccctgtatagcatgttccacgaggacccagaggagaatgacctgtatcaggccattgccacagttactactctccttctgcaaatcggagaggtgggccagaggggatcgagttccggttcgtgcagtcaggagtgcggcgaagaactacgagcctccgcccctagtcctgaggattcggtcttcgccgacaccggaaaaacccctcaggattcccaagcctttccagaggctgccgagcgggattggactgttagtctggagcacatcctggcatccctgctcaccgagcaaagcctagtgaatttcttcgaaaagcccctcgatatgaagtccaaactggagaacgcaaagatcaaccagtacaacctgaagacttttgaaatgagccaccagtcccagagcgagctcaagctatccaatctatag

SEQ ID NO: 60110 - DNA, 1899 bp, Artificial Sequence
  Description of Artificial Sequence: Synthetic coding sequence
atgtggttgaagcccgaggaggtgttgcttaagaatgctttgaagttgtggctgatggagcgctcaaatgactatttcgtactccagcgacgaaggggctatggtgaggaaggaggcggtggactcactggcctgctcgttggaactctggattcagtgttggattccactgctaaggtggccccttttagaattctgcatcagacacccgattctcaggtgtatttgtccatagcgtgcggcgcaaaccgagaagagatcaccaaacactgggattggttagaacaaaacataatgaaaaccctcagcgtgtttgattcaaacgaagatattactaatttcgtgcaaggtaagatcaggggcctgattgcggaggagggcaaacattgctttgccaaggaagacgatccagagaagttcagagaggccctactgaaattcgaaaaatgcttcggccttccagagaaggagaaactggtaacatactatagttgtagctactggaagggtcgcgtgccctgccagggatggctctacctatctactaatttcctgtctttctactcatttctgctgggctctgaaataaagctgattatcagttgggacgaagtctccaagctggagaaaacaagcaacgtgattcttaccgagtccatacatgtctgtagccaaggcgagaaccattacttcagtatgttcctccatataaaccagacctacctcctaatggaacagctggccaattatgcaataaggcgcctgttcgataaggagaccttcgataacgacccagtgctgtacaacccactacaaataactaagcggggtctcgaaaacagagctcacagtgaacagtttaatgcattcttccgcctccccaaaggggaatctctgaaggaggttcacgagtgcttcctgtgggtacctttctctcattttaacacacacggcaagatgtgcattagtgaaaattatatctgtttcgcctctcaagacggtaaccaatgttcggttatcattcctctgcgcgaagtactcgcgatcgataagacaaacgatagttctaaaagcgtgatcatcagcattaaggggaagactgcatttaggttccacgaggtgaaagacttcgagcagttggtagccaagctgcggcttcgttgtggtgccgcaagtactcaataccatgatatttctaccgaactcgccatcagtagtgagtctacggagccaagtgataacttcgaggtccagtcattgacttcccagagggaatgtagcaagaccgtgaatacagaagccttaatgaccgttttccatccccaaaatctggagactctaaacagcaagatgctgaaggagaagatgaaggagcaatcctggaaaattctcttcgccgaatgtggacggggagtgagtatgttccggaccaaaaaaacccgggacctggttgtcaggggcatccccgagactttacggggtgagttatggatgttgtttagcggagcagtgaacgacatggccaccaacccggattattatactgaagtggtagaacagagcctcggcacgtgtaatctggcaactgaggagattgaacgcgatctgcgccgatctttacctgagcaccccgcttttcaatctgacactggaatctcagccctaagacgcgtgctgaccgcatacgcctatcgcaatcccaagatcgggtactgtcaggccatgaacatcctgacctcagtgttattgctttatgctaaggaggaggaggccttctggctgctggtggccgtttgtgagcgcatgctgcccgactatttcaaccggcgaattatcggctcagacgacttcatgcctctggtgaggatccagggccagtgcgtaattggcgaaaaatag

SEQ ID NO: 60111 - DNA, 3363 bp, Artificial Sequence
  Description of Artificial Sequence: Synthetic coding sequence
atgtggcttaagcctgaggaggtactcctgaaaaatgccttaaaactatggctcatggagcgaagtaatgattattttgtcctccagagacggcgaggttatggcgaggagggcggaggcggtctaaccggactgctagttggcactctggacagcgttctagacagtactgccaaagttgcacctttccgcatcctgcatcagacacctgacagccaggtttatctgtcaatcgcatgcggagccaatcgggaagagattaccaaacactgggattggttggagcagaatatcatgaagactctgtcagtcttcgactctaatgaagacattactaattttgtacaggggaagattaggggacttatcgccgaggagggaaagcactgtttcgctaaggaggacgatcccgagaagtttagggaagccctgctgaaattcgaaaagtgttttgggcttcccgaaaaggagaagctggtcacctactactcgtgcagttactggaagggcagggttccctgccagggctggttgtatctaagcacaaattttctgagtttctacagctttcttctcggctctgagattaaacttatcatatcatgggatgaagtttccaaacttgagaaaacatctaatgtgatcctgaccgagagtattcatgtgtgtagtcagggagagaaccactatttcagcatgttcctacacattaaccagacatatctgcttatggaacagctggcaaactatgcaatccgccgtttatttgacaaagagacatttgacaacgacccggtcctgtacaacccactgcaaatcacaaaaaggggcctggagaatcgagcccactcagaacagtttaatgccttcttcaggctgcccaaaggggagagcctcaaagaagtccacgagtgctttctgtgggttcccttcagtcacttcaatacccatggaaaaatgtgcattagcgagaactacatctgttttgcgagccaggacggcaaccagtgcagtgtgataatccctttacgagaggtgctcgcaatcgataaaacaaatgactcaagcaaaagtgtcatcatcagcataaagggcaagacagcgttccggttccatgaggtgaaagactttgaacaacttgttgccaaactcagactgcgttgtggcgctgctagcacacagtaccacgacatttccacagagttagccatcagcagcgagagcactgagccctcagacaattttgaagtccaatcgctgacttctcagcgagagtgcagcaaaaccgtgaacacagaagccttgatgactgtgttccatccacagaatctcgagaccctaaatagcaaaatgctcaaagagaagatgaaagagcaatcctggaagatactttttgccgaatgtggaagaggagtctctatgttccgcactaaaaaaactcgcgatttagtcgtgcgcggaatccccgagactctccgaggcgagctctggatgctgttctccggtgccgttaacgacatggctacaaatccagactactacacagaggtggtagagcagtccttaggcacctgcaacttagcaaccgaggagatcgagcgcgatctccgtaggtccctgcctgagcacccggcattccagtcagataccggcatctccgcccttcggcgagtgctgacagcctacgcctatcgtaaccctaagattggctactgccaggctatgaatatcctgacttccgtactgttgctttacgccaaggaagaggaagccttttggctgctcgtggccgtttgtgaacgcatgctgccggattactttaaccgcaggataattggcgctctagtggatcaggccgtgttcgaagagctgattcgcgaccatcttccccagctgactgagcatatgaccgatatgacctttttcagctctgtctcactcagctggtttttgacgctgtttatttccgtccttcccatcgaatcggctgttaatgtcgtggattgtttcttctacgatggaataaaggcaatcttacagttggggctcgcgattctggattacaacctcgacaagcttttaacctgtaaggacgatgcggaggcagtaacagctctgaaccggttctttgacaatgtcacaaataaagatagcccgctgccatccaacgtacagcagggaagcaacgtttctgatgaaaaaacgtctcacaccagggtggatatcacggacctgatcagagaaagtaatgagaagtacgggaacattcgttacgaggacatacactccatgaggtgtagaaatcgtctgtacgtcattcagactctagaagagacaactaaacagaacgtcctcagagtcgtctcccaagacgtcaaactatcattgcaggagctggacgagctttacgtgatcttcaaaaaggagttgtttctgtcttgttactggtgtctggggtgtcctgtcttgaaacaccacgatccctctcttccgtacctggagcagtatcagatcgattgccagcaattccgggctctttaccatctactgtcaccgtgggcgcattctgccaataaagactctctcgccctgtggactttccgcctcctggatgagaatagcgattgcctgataaattttaaagaattctccagcgcaatcgatataatgtacaatgggagtttcaccgaaaagctcaaactgctgttcaaactgcacattcctcccgcatacaccgaggtcaagtctaaagatgcatcaaagggggacgagctgtctaaagaggagctcctctatttctcccagttacacgtgtccaaacccgcaaacgaaaaagaggccgaatctgctaaacattcaccagagaagggaaagggcaagatagacatccaagcctatttaagtcagtggcaggacgagctattcaaaaaagaggagaatatcaaagacctacctaggatgaatcaatcacagtttattcagttctctaagactctgtataatctgttccatgaggatcccgaagaggaaagcctgtatcaggcaatcgccgttgtgactagtctgttgttgcggatggaagaggtaggaaggaagctgcactcacccacttcctctgccaaaggcttctccgggaccgtgtgcggaagtgggggaccctctgaggagaaaactggatcccatttggagaaagatccctgttcttttcgcgaggagccgcagtggtcattcgcctttgaacagattctggccagcttgttgaacgagccagccttggtcagattttttgagaagcccatcgatgttaaggccaaactggaaaatgcacgcatatcacagctgcgttcaagaactaagatgtag

SEQ ID NO: 60112 - DNA, 654 bp, Artificial Sequence
  Description of Artificial Sequence: Synthetic coding sequence
ttcaaccggtttttcgacaacgttaccaataaagactcccccctgccaagcaacgtacagcaaggtagcaatgtatccgacgaaaagacaagtcatactagggtggatatcaccgatttaattcgagaatccaacgagttacgagttgtatcccaggacgtgaaactctctctgcaggagctcgacgagctgtacgttatctttaagaaggagctctttctgagttgctattggtgcctggggtgtcccgtgctgaagcaccatgatccatccctaccctatctggagcagtaccagatcgactgtcagcagttcagagcgctctatcacctcttatcaccgtgggcacattctgcaaacaaggactccctggccctttggacattccgtctcctagacgagaactccgactgtctcatcaacttcaaggagttttctagcgccatcgatattatgtataacggtagcttcaccgagaagcttaaactactttttaagctgcacatcccaccagcatatacggaggttaaaagtaaagacgcctctaaaggcgatgagctctcaaaggaagagcttctgtacttttcccagctccatgtgtccaaacccgctaacgagaaggaagctgagtccgccaagcattcgccagaatag

SEQ ID NO: 60113 - DNA, 3801 bp, Artificial Sequence
  Description of Artificial Sequence: Synthetic coding sequence
atgtgggtgaacccggaggaagttctcctggccaacgcactatggatcacagagcgcgctaacccttattttatcctccagcggagaaagggccacgccggagatgggggtggagggggtggactcgcgggattgctggtggggacacttgatgtggtgctcgatagtagcgcacgcgttgctccctacagaattttatatcagaccccagactccttagtgtactggacgatcgcctgtggaggcagtagaaaagaaattactgaacattgggagtggctggaacagaatctgctgcagactctgtccatctttgaaaatgaaaacgacatcacaaccttcgtgcggggaaaaatccagggcattatagccgaatacaataaaatcaacgacgtcaaagaggacgatgataccgagaaatttaaagaggcaattgtgaagttccaccggctgttcggcatgccagaagaggagaaattggtaaactactactcttgtagctactggaagggaaaggtgcccagacagggatggatgtatctcagcataaaccatctgtgcttctattcttttttaatgggcagagaggccaaactcgttattcggtgggtggacatcactcagctggagaagaatgcgacccttttgttgccagacgttattaaggtatcgactcggtcttctgaacatttttttagtgtctttctgaatatcaatgagacctttaagttgatggagcagctggccaatatagcaatgcgacagctgttggacaacgaagggtttgaacaggacaggagcctgcctaagctgaaacggaaatcccccaaaaaggtctccgcacttaaacgggatcttgatgctagggctaagtccgagaggtatagggccttattcagactacccaaggacgaaaagctggatgggcacactgattgtaccctgtggacgccgttcaataaaatgcatattctgggccagatgttcgtgagcacgaattatatttgtttcaccagtaaagaagaaaatctgtgtagtcttattatacccctcagggaggtgacgattgtggagaaagcagacagttcaagcgtcctgccatcccccctcagtatcagtacccgcaaccgcatgacattcctttttgccaacctcaaagatagagacttcctggtgcagagaattagtgatttcttgcaacaaactacgtctaagatatacagcgacaaagagtttgccggaagctacaatagttccgacgacgaagtctactcacgaccaagtagcctggtatcctcctccccccaaagaagcacttcctcggatgcagacggtgaacgacagttcaacttgaacggaaacagtgtcccgaccgcaacccagaccttaatgacaatgtatagacggcgttctcccgaggaatttaatccgaagctggctaaagaattcttgaaagagcaggcctggaagattcacttcgccgagtacggacagggaatttgcatgtacaggacagaaaagactagagagctggttctgaaaggcatcccagaatccatgcgtggggaactttggctgttgctatcgggcgcaatcaacgagaaggcaacacaccctgggtactacgaagacttagtggaaaagtccatggggaagtacaacctggcgactgaggaaattgagcgcgacctgcatcggagcctgcccgagcacccggctttccagaacgaaatgggaatcgcagctctgaggcgcgtgctcaccgcctacgccttccgcaaccccaacattggctactgccaggctatgaatatagtgacctctgtcctccttctgtatgctaaggaggaagaggctttctggcttctggtagctctctgtgagcgcatgctacccgactactacaatacaagggtggtcggagccctcgtcgaccaaggtgtgtttgaggaactggcgagagactatgtccctcagctctatgattgtatgcaagatcttggcgtgatctctacaatatctctctcatggttcctgacactgttcctctcagtgatgccgttcgagtcagcagtagttgtagtcgattgctttttctatgagggcatcaaggtgatatttcaacttgcactggctgttctcgacgctaacgtagacaagttgctgaactgcaaagacgacggggaggccatgacggttttggggagataccttgactccgtgacgaataaagactctacgcttccgccaatcccccacctccacagtctgctgtccgatgacgtggagccctatccggaagtcgacatctttaggttgattcgtacatcgtacgagaaattcggtaccattcgtgctgacctaatcgaacagatgcgcttcaaacaaagactgaaggtgattcagactctagaagacacaacaaagcggaacgtggtgagaaccatagtgactgagacaagtttcaccatcgatgaacttgaggaattgtatgctcttttcaaggcagaacatctcacttcctgctactggggaggcagctctaatgctctggataggcatgacccgagtctgccttatctggagcaataccggatagatttcgaacagttcaaagggatgttcgctctgctcttcccatgggcatgcggcacccacagtgacgttttagcatctcgactgttccagcttctcgatgaaaatggcgactccctgattaattttcgggagtttgtgtctggacttagcgcggcttgccacggtgacctgaccgaaaagttgaagctgctctataagatgcatgtgctccctgagccgtccagtgatcaagatgaacccgacagtgccttcgaagcgacccagtatttcttcgaggacatcacccccgaatgcacacacgtggtcggactggacagtaggagcaaacagggcgcagacgatggattcgtcaccgtgtccctgaagcccgacaaggggaaaagggccaatagtcaggagaataggaactacctgcgtctctggactcccgagaacaagagcaagtctaagaacgccaaggacctgccaaaactgaaccaggggcagttcattgaattgtgtaaaaccatgtataacatgttctccgaagaccctaacgagcaggagctgtaccatgcaaccgctgcagtgacatcactcctgctggagattggcgaagtcgggaagctatttgtcgcccaacccgctaaagagggtgggagtggcggttcggggccttcctgtcaccagggtattcccggtgtcctttttccgaagaaagggcctggccagccttatgtcgtggaatccgtagagcctctccccgcatccctggctcctgattccgaagaacattcgctcggcggtcagatggaggatatcaagcttgaggactcctctcctagggataacggcgcttgctcatctatgctgatctctgacgatgacaccaaggacgattccagcatgtcttcttatagtgtgctctctgcaggaagccatgaggaagataagctgcactgcgaagatatcggagaggataccgtgctcgtgcgttccgggcaggggaccgcagcgctgcctagatctacatccttggatagggattgggccattacctttgaacagtttctcgcgagtttattgacagagcctgctttggtcaagtactttgataagccggtttgtatgatggccagaatcaccagtgctaaaaacattaggatgatgggcaaaccgctcacctccgcttccgactatgagatctccgccatgtccggatag

SEQ ID NO: 60114 - DNA, 1848 bp, Artificial Sequence
  Description of Artificial Sequence: Synthetic coding sequence
atggaaagtatgttcgaggatgacatttcaatcttaacccaggaagccctgggccctagcgaagtatggctggacagccctggagacccctctctcggaggcgacatgtgctcggcctctcactttgccctgattacagcttacggcgacattaaagaacgtttgggaggactggagagggaaaatgccaccctgcggaggcgcctgaaggtgtatgaaatcaaataccccctgatttccgacttcggggaagagcatggctttagcctttacgagatcaaagatggatcactgctagaggttgagaaggtctccttacagcagcgactgaaccaattccaacacgaactccagaagaataaagagcaggaggaacaattaggcgagatgattcaggcgtacgaaaaactctgtgtcgagaagtcagaccttgaaacggaactgagggaaatgcgggcattagtcgagacacacctgcggcaaatatgcggcctggagcagcaactgagacagcaacaaggcctgcaggacgctgctttcagtaatctcagccccccaccagctcccgctccaccatgcacggatctggacctccactacttggctctaaggggtgggtctggactgtcccacgcagggtggccgggtagtacgccatcagtttcagacctcgagcgaaggaggctggaagaggctctcgaggccgctcagggcgaagcaaggggggctcagttacgagaagagcagctacaggcagaatgtgagcggcttcaaggcgagctgaagcaacttcaggagacccgagcccaggatctggcttcaaaccagtctgaacgcgacatggcttgggtgaagcgggtcggcgacgatcaggtgaatttggcattggcctacactgaactcactgaagagcttggccgactgcgagagctgtcctccttacagggccgtatacttaggacgctgctgcaggaacaggcccgatctggcggacagagacatagcccactaagtcagagacacagtcctgctccccagtgtccatcccccagtcctcccgctagggctgcaccaccatgccctccttgccagtcaccggtgccccaacgcagaagccccgttcccccatgcccatccccacagcagaggaggagtcccgcttcccccagctgcccgtccccagttccccaaagaagatctcccgtgcccccttcctgtcaaagtccatcacctcagcgtcggtcaccagtcccaccctcatgtccggcaccacaaccaaggccgccacctccacctccaccgggtgaacgcactctggctgagcgagcatacgctaagccaccgtctcatcacgtaaaggcgggttttcagggacgacggtcatattccgagctcgctgaaggagctgcttacgccggagcaagccctccctggctgcaggcggaagccgctacactaccaaagccacgggcatatggctccgaactgtatggtccaggccgtccattaagtcctcgtcgagcgtttgagggcattagattacggttcgaaaagcaacccagtgaggaagatgaatgggctgtgcctacctctcccccaagcccagaggtgggcacaatcagatgcgccagcttttgtgccggttttccaatccccgaatcccctgctgctacagcttacgcacacgccgagcatgcccagagttggccaagcatcaacctacttatggagacagtgggctcagacatccgaagttgccccttgtgtcagctggggttccccgtgggctacccagacgacgccctgattaaacacatcgactcccacctcgagaactcaaagatttag

SEQ ID NO: 60115 - DNA, 672 bp, Artificial Sequence
  Description of Artificial Sequence: Synthetic coding sequence
atggaatctatgtttgaggacgacattagcatccttacacaggaagcccttgggccaagcgaggtgtggctagattcccctggagacccaagtctgggtggcgacatgtgcagtgctagccacttcgcgctcattactgcctatggagacataaaggagcgtctgggcggtctggagagagaaaacgccaccctgcggcgaaggcttaaagtgtatgaaattaagtaccccctgatttcagacttcggggaagaacatggcttctccctgtatgaaattaaggacggttcactgctcgaggtggaaaaagtctcactgcagcagcggctgaaccagtttcagcacgagttacagaagaacaaagaacaagaggagcaactgggagaaatgatccaggcctatgaaaaactctgcgtggagaagtctgacctggaaactgaactgcgggaaatgagagctcttgttgaaacccacctcagacaaatttgtgggctagaacaacagctccggcaacagcaaggattgcaagatgccgctttttcaaacttgtcaccgccacggagagcacgggcagtgcttgccgtgcatcagttagcagacggcgatggcggacttcggcatcctcagttgccacccctccctgcgggttttccttgccgggtgcccggatag

SEQ ID NO: 60116 - DNA, 1062 bp, Artificial Sequence
  Description of Artificial Sequence: Synthetic coding sequence
atgctcgaaggccagctggaggcgagagagcccaaggagggcacacaccccgaagacccctgtccgggagccggagccgcaatggaaaaaacacctgccgctgctgaagtaccgagggaggattccaacgccggagagatgccctccctgcagcagcagatcacatcactgcatcaggagttaggcagacagcagtcactttgggctgatatacacagaaagctccagagtcacatggacgccctgaggaaacagaacagggagctgcgcgaggagctgagaggcctgcagagacaacagtgggaggcagggaagaaacccgctgcctcaccgcacgcaggtagggaatcacacacgctggcacttgagcctgccttcggaaagatttccccccttagtgctgacgaagagaccacccccaagtatgccggaagaaagagccaatctgccaccctactagggcagcgatggagctcaaaccatttagcgccaccgaaacccatgagcctaaagaccgaacgcatcaatagcggcaaaacacccccacaggaagaccgtgaaaagtcccctcccggtcgcagacaagatcgcagtcctgcccctacaggcaggcccacacccggagctgaaaggagggaggtttctgaggatggaaaaatcatgcacccatcatctaggagcttacagaactctggtggacgaaagtccccagttcaggcttcccaggcagcaacgctgcaggaacagaccgcagccgcaggtgtggctgaccgctcgtccagtgtgcttggcagtagtgagggcggtttcctgagtagggttcaggctgaagagttcgcctctagctcacctgactctgccgaaagacagaatctgcccgttaacccgccttcctcattagaaattgcccaggccatggatacaaagatgaaaaaagaagaagtccaagaagagaagagacatccgaacggaaaggcagacgattgtaggcggtctggctttcccagtgaattcccgggagctcttcacgcagccccatcccgtcaggacatgggaccatag

SEQ ID NO: 60117 - DNA, 1125 bp, Artificial Sequence
  Description of Artificial Sequence: Synthetic coding sequence
atgaaggtggacatggccaattttgccatctccagcattaggccccatcttatgcagcagagcgtggaatacgagcggaaaaaattccaggagatcctggagagacagccgaacagcctggattttgtgacgcagtggctggaggaagccagcgaagacctcatgactcaaaagtacaagcacgctttgccagtgggcggtatggccgcaggttctggagacatgccccgtttgagccctgtggccgtccagaactatgcatacctcaaactgttgaaatgggatcatctccagcggccttttccagagactgtattgatggaccagtcgaggttccacgagctccaacttcagctggagcaactgactatactcggcgctgtactgctggtaaccttcagcatggccgctcccggaatatctagtcaggccgacttcgcggaaaagctgaagatgatcgtgaaaatcttgctcacggacatgcacctgccctcattccacctcaaggacgtgttgaccactataggcgagaaggtgtgtctcgaggtaagttcctgccttagtttatgcggcagctctcccttcaccacagataaggaaacagtgctaaaaggacaaatacaggccgtcgcctcccccgatgaccctatcagacggattatggagtcccgcatactgacctttttagagacctaccttgcctccggccaccagaagcccctgccaacggttccaggagggctgtcgcccgttcagagggaattggaggaggtcgcaataaaatttgcgaggctggtgaattataataagatggtgttttgcccctactatgatgctattcttcgaaaacgttggataagtttcggcaacttcttcggctcgtcaaacaccgatatgtcaccctggaactgtagaacagattatccaatgtcactacacatccgctttcctaaaaaccacgttatagaggcgccaatgaccatccagttatgctttcaggagccttgtaataaggccctgtcactgcttaatatcccgctggaagcgaagggtatcctggacagatccttcctgcaacgccgtctgaagccttatagaatccgattctgctgcagggccctctag

SEQ ID NO: 60118 - DNA, 1530 bp, Artificial Sequence
  Description of Artificial Sequence: Synthetic coding sequence
atgtccgaaaacctcgataagtcaaatgtgaatgaagctggtaagtcaaaaagcaacgactctgaagaaggactagaggacgccgtagagggtgctgatgaggctctgcagaaagcaatcaagagtgattcctcctctcctcagagagttcaaagaccacactcaagcccccctcgtttcgttaccgttgaggagctccttgagactgctaggggagtgacgaacatggcactagctcatgagatagtggtgaacggggacttccagatcaagcccgtagagttgcccgaaaattcattgaagaaacgagtcaaggaaatagtgcacaaagcattttgggactgtctgtccgttcagctctctgaagaccctcccgcttatgaccacgccattaaactggtgggggagatcaaggaaacactcctctctttcctgctacccggtcataccaggctccggaatcaaatcaccgaggtcctggacctcgacctgatcaagcaggaagcagagaacggagctttggacatttctaagctggcagaattcatcatcggaatgatgggcacactgtgtgctcctgccagggacgaagaagtgaaaaaactgaaggatatcaaggagattgtgccactgtttagggagatcttttcagtgctcgacctcatgaaagtggatatggccaactttgctatctcctccattaggccgcatctgatgcagcagtccgtcgaatatgagcgaaagaagtttcaggagatactcgaacggcagcctaacagtttggatttcgtgacgcagtggttagaggaagcctccgaagaccttatgacacagaaatacaaacatgccttgccggtgggtgggatggctgcgggatccggcgacatgccgcgactgagtccagtcgcagtgcaaaattacgcgtatttaaagctcctcaaatgggatcatctgcagaggccttttccggaaactgtactaatggatcagtccaggtttcacgaactgcagctgcagctggagcagctaaccattctgggagccgtgcttttagtcactttctcaatggctgcgcctggaatttcctcccaggcggatttcgccgaaaagctcaagatgatcgtgaagatactgctcacagatatgcacctgcccagctttcatctgaaagacgtgttgacaacaatcggagagaaggtgtgtttggaggtctcctcatgtctgtctttgtgcggcagctcccccttcaccaccgacaaggagaccgttcttaaaggccagatccaggccgtggcgagccctgacgacccaatccggcgaatcatggagtccagaatcttaaccttcttggagacttacctggcaagtggacaccagaaaccactccctacagttcccggtggccttagccctgtgcaacgtgaactggaggaggtggccataaagttcgcgaggttggtgaattacaataaaatggtgttctgcccatactatgatgccattctgagtaagatcctggtacgcagctag

SEQ ID NO: 60119 - DNA, 1530 bp, Artificial Sequence
  Description of Artificial Sequence: Synthetic coding sequence
atgtcggagaatctcgacaaatctaacgtcaacgaggccggaaaaagtaagagtaatgattccgaggagggcttagaagatgccgtcgaaggcgctgacgaagccctccaaaaggccataaagtcagactctagcagccctcagagggttcaaagaccccactcctcgccaccgaggttcgtcactgtggaagagctgttagagactgccaggggcgtgacaaatatggcattggctcacgaaatagtagttaacggcgatttccagatcaagccagtggaattacccgaaaattcactcaagaaacgcgtaaaggagatagtacataaggctttttgggattgcttatccgtgcagttgtctgaagaccccccagcctacgatcacgctatcaaattggtcggcgaaattaaggagacactcctgtccttcctcctgccaggtcacactcgactgcgaaaccagattaccgaggtgctggacctcgacctgataaaacaggaagcagagaatggagcgctggacatctcaaagctcgctgaatttattataggcatgatgggcactttgtgtgctccagctcgcgacgaagaagtcaagaagttgaaggatattaaggaaatagtgcctttatttcgggaaatattttcagtgctggacttaatgaaagtggatatggcaaattttgccatatcctccatccgaccacacttaatgcagcagagcgttgagtacgaaagaaaaaagttccaagaaatcctggagcgccagcctaatagtcttgattttgtgacccaatggttagaggaagcaagcgaagacttgatgacccaaaagtataagcatgctttacctgtcggtggaatggctgccggatctggggacatgccgcgtctgtccccagtggccgttcagaactacgcgtacctcaaactgttgaaatgggaccatctccaaaggccattcccagagactgtgttaatggaccagtccaggtttcatgagttacaattacagctggaacagcttaccatcttaggtgctgtactcttggttacttttagcatggccgctcccggaatttcctcccaggcggatttcgctgaaaaactgaagatgattgtgaagatacttctcacggacatgcatttgccaagcttccatcttaaagacgttctgactaccatcggagaaaaggtgtgcctggaggtaagctcatgcctctctttgtgcggcagcagccctttcacaacagataaggagacagtcctaaagggacagattcaggccgtggcttcacccgacgaccccatccgtcggattatggaatctaggatcctaaccttcctggagacctacctggcctcagggcatcaaaagcctctgcccactgtacccggaggcctgtctcctgtgcagcgagaactggaagaagtggctatcaagttcgcccgactggtaaactataataagatggtgttctgcccatactatgacgcaatcctctctaagattcttgtgcgatcctag

SEQ ID NO: 60120 - DNA, 165 bp, Artificial Sequence
  Description of Artificial Sequence: Synthetic coding sequence
atgagtgagaatctggacaaatctaacgttaatgaggctggaaagtcaaagtccaatgatagcgaggaggggcttgaagatgcagtagagggggcagatgaggcactgcagaaagccattaagagcgattcaagcagcccacaacgtgtgcagcgtccccactag

SEQ ID NO: 60121 - DNA, 435 bp, Artificial Sequence
  Description of Artificial Sequence: Synthetic coding sequence
atgtctgagaatcttgataaaagtaatgtgaatgaagcaggtaagtctaaaagtaatgactcagaagagggactcgaggatgcagtggaaggcgcagatgaggccctccaaaaagccatcaaatcggactctagcagcccccagcgagttcagagaccccactcctcccctccccgtttcgtgactgtggaggaacttctcgagacagctaggggcgtcacaaacatggctttggcgcacgaaattgtggtgaatggtgattttcagatcaaacccgtagaactccccgagaatagccttaaaaaaagggtgaaggagatagtgcataaggcattttgggactgccttagtgtgcaactgagcgaggacccccctgcctacgaccacgcgataaagctcgtaggggagataaaagaaactttactaagcttctag

SEQ ID NO: 60122 - DNA, 1530 bp, Artificial Sequence
  Description of Artificial Sequence: Synthetic coding sequence
atgtctgagaatcttgacaaaagcaacgtaaatgaggccggaaagtctaagtccaacgacagcgaggagggcctggaggacgccgtggagggggctgacgaagcccttcagaaagcaattaagtccgactccagtagtccccaaagggttcagcgaccacattcctcaccaccccgtttcgtgacagtcgaggaacttctggagacagctagaggcgtcacaaacatggctctggctcatgaaatcgttgtcaatggcgatttccaaattaagcccgtcgaattacctgagaattctctgaagaagagggtcaaggagattgtgcataaggcattctgggattgtctgagcgtgcagctttccgaagacccacccgcatacgatcacgctattaagctggtcggtgagatcaaggaaaccctcctgtccttcctgctgccaggtcacacaaggctgcgtaaccaaatcactgaggtgctggatcttgatctgatcaagcaagaggcggaaaatggcgctctggatatttctaaactggccgaattcatcatcggcatgatgggcacgctgtgcgccccagcccgtgatgaggaggtcaagaagctgaaagacattaaggagattgtgccattgtttagggagattttttctgttcttgacctgatgaaagtggatatggcgaactttgcgatcagtagcataagaccccatctcatgcagcaatcagttgaatacgagaggaagaaatttcaggagatacttgagagacagcctaattctctggatttcgtgacacagtggctggaagaggcctctgaagatctgatgactcagaagtataagcatgccctgccagtcggaggcatggctgccggttcaggggacatgccacgactgtcccccgtagccgtacagaactatgcctacctgaagctcctaaagtgggatcatctgcagcgaccgtttcctgagacagtgttgatggaccagtccagattccacgagttgcaacttcagctggaacaacttacaatccttggagccgttttgttggttacattttcaatggcagcacccggtatttcctcacaggcggacttcgcggagaaactaaaaatgatcgttaaaatactgctgacggacatgcatctgccctcttttcatctgaaggacgtgttgaccaccataggagagaaagtgtgtcttgaagtgtcatcttgtctgagtctctgtggctcctctccgtttacaaccgataaagagaccgtacttaagggtcagattcaagcggtagctagtccggatgatcccatcagacggattatggagagcaggatattgacatttctggagacttacctagcttcaggacatcagaagcctctgcccactgtgcctggaggacttagcccagtgcagagggagctcgaagaagtggcgataaagttcgctaggctggtgaactataataagatggtgttctgtccctactacgacgccatcctgagcaaaatactcgtacgctcatag

SEQ ID NO: 60123 - DNA, 1560 bp, Artificial Sequence
  Description of Artificial Sequence: Synthetic coding sequence
atgccctttaacggcgagaagcaatgtgtgggggaggaccagccatccgacagcgactcctccagattctccgagtccatggcttctctttccgactacgaatgcagcaggcagtccttcgcatccgactctagttctaaatcctcaagccccgcaagtaccagcccgccaagagtagtcacctttgacgaagttatggccaccgcacgtaatctctctaatctgacactggcacatgaaatcgccgttaacgagaacttccaactgaaacaggaggccttgccggagaagtctctcgctggccgagttaagcacatcgtacatcaggcattctgggatgtcctagactcagagctgaacgctgatccgccagagttcgagcatgccatcaagctcttcgaagaaattagggaaatcttgctcagctttctaaccccaggaggaaatcgactccggaaccagatatgcgaggtcttggacactgacttgattcgacagcaggccgagcattccgccgtcgacattcaaggactcgctaattacgtgatctccacgatgggaaagctctgtgctccggttcgagacaatgacatccgggagctgaaagctactgggaatatcgttgaggtgcttcgccagatcttccatgtcctggatctcatgcagatggatatggctaattttacaatcatgagcttaagaccacatctgcaacgccagttagtggagtatgagaggaccaagtttcaggaaatcctcgaagagactccgtccgccctggatcaaacgaccgagtggataaaggaaagtgtcaatgaagagctcttttctctgtcagaatcggccttaacacctggcgcagaaaacacttctaagcctagcttgtctccgaccctcgtgctgaataactcttatctgaagctactgcagtgggactaccaaaagaaagagctgcctgagacactcatgaccgacggggctagactgcaggaattgactgagaagctgaatcagctgaagattatcgcatgcctcagccttattactaataatatggtcggtgccataaccggcggactgcccgagttagcttctcgcctcacacggatctcggccgtgcttcttgagggaatgaataaggagactttcaatttaaaagaagtccttaatagcatcggaattcagacttgcgtggaagtgaacaaaaccttgatggagcggggtctgcctactctcaatgccgagattcaggctaatctgattgggcagttcagcagtattgaggaggaggacaatcccatctggtccctaattgataaacgcatcaaactctatatgcggcgactgctgtgcctgccaagcccgcagaagtgcatgcccccaatgccaggtggcctggccgtcatccagcaggaactggaggccttaggatcacagtatgcaaatatcgtaaacctcaacaaacaggtctacggcccattttacgctaatatcctgaggaaactgctcttcaatgaagaggccatgggcaaggttgatgctagccctcctactaactag

SEQ ID NO: 60124 - DNA, 294 bp, Artificial Sequence
  Description of Artificial Sequence: Synthetic coding sequence
atgccatttaacggagaaaaacagtgcgtgggagaagaccaaccttctgattctgattccagtcgcttctctgaatcaatggcttctctgtctgattacgaatgtagccgccagtccttcgcttcggattcttccagcaagagctcttctcccgcttcaacgtcacctccgagggtcgtcactttcgacgaggtcatggccactgcaagaaacctatctaatcttactctggcgcacgagatcgctgtaaacgagaactttcagctaaagcaagaggctcttcctgaaaaatag

SEQ ID NO: 60125 - DNA, 57 bp, Artificial Sequence
  Description of Artificial Sequence: Synthetic coding sequence
atgccttttaacggggagaagcaatgtgtaggtgaggatcagccttctgattcttag

SEQ ID NO: 60126 - DNA, 399 bp, Artificial Sequence
  Description of Artificial Sequence: Synthetic coding sequence
atgccatttaacggggagaaacaatgcgttggcgaagaccagccaagcgactctgacagcagcagattttcagagagcatggccagcttgagcgattatgaatgtagcaggcaaagcttcgccagtgatagcagctccaaatccagctcccctgcctccacctccccaccgagggtggtgacatttgacgaggtcatggccaccgcaagaaatttgtccaatctcacactcgcccacgagatcgcggttaacgaaaacttccagctgaagcaggaagcacttcccgagaagagcctcgccggacgggtgaagcatatcgtgcaccaggccttctgggacgtgttagactccgagctgaacgccgaccccccagaattcgaacatgctattaagctttag

SEQ ID NO: 60127 - DNA, 705 bp, Artificial Sequence
  Description of Artificial Sequence: Synthetic coding sequence
atgcccttcaacggcgaaaagcagtgtgtcggcgaggaccagccatcagatagcgattctagcagattctcagaaagtatggcaagtctgagcgactacgaatgttctcgccagtcattcgccagcgactccagctctaagagctctagcccagcctccactagcccgcctagggtggtcacgttcgatgaggtaatggctacagctcggaatttatctaacctcactctcgcgcacgaaattgccgtgaacgaaaacttccagctgaaacaggaagcgcttcccgagaagtccctcgccggaagagtcaaacacattgtgcaccaggccttctgggatgtgcttgattccgaactgaatgccgaccctcctgagtttgaacatgcaataaagttgttcgaagagattcgggaaatactcctgtcttttctcacaccagggggaaacagactgcgcaaccagatttgcgaggtcttagacacggacctgatccgccagcaggctgagcatagcgcagttgatatccagggcttggcgaactacgtcatctccactatgggcaaattgtgtgcccctgtgagagacaacgatataagggaactgaaggcaaccggtaatatcgttgaggttctccggcagattttccacgtgcttgacctaatgcagatggacatggccaattttactataatgagcctgcgctag

SEQ ID NO: 60128 - DNA, 57 bp, Artificial Sequence
  Description of Artificial Sequence: Synthetic coding sequence
atgccttttaacggagagaaacagtgcgtgggcgaggaccagccaagtgattcgtag

SEQ ID NO: 60129 - DNA, 540 bp, Artificial Sequence
  Description of Artificial Sequence: Synthetic coding sequence
atgatgatgtccgataatgccaaaggtagggctgctcacagctggaaaaaacggggatccatatcaagcctgtctaaccacgaattctggagaaaggagatacacgggaggattaaagacagcatgagtaccgtgagctatatggaggagccttcccagcgggatgatattagtcggctgacagtgcagatggagaatacctatcagctcggcccacccaagcactttcccgtggtgaccgtgaatcacattctaaaagatgtcgtgacttcttacctacaggttgaagagtacgaacctgagttgtgtcgacaaatgacaaagaccatttccgaggtgataaaggctcaggtgaaggatctgatgattcctagatacaaactaattgttatcgttcatatcggtcagttaaataggcaatccatcctgatcggtagcaggtgcctgtgggatccaaagagtgacaccttttccagctacgtgttcaggaatagtagcctattcgccctcgccaacgtgtacgccgtctacctggagtag

SEQ ID NO: 60130 - DNA, 429 bp, Artificial Sequence
  Description of Artificial Sequence: Synthetic coding sequence
atggctacatccatcggagtaagctttagcgtcggggatggggttccagaagctgagaagaatgcgggagagcctgagaatacatatattctgagacctgtgtttcagcagaggttcaggccgagtgtggtgaaagactgcatccacgccgtgctcaaagaggaactcgccaacgcggaatactctccggaagagatgccacagctgaccaaacacctctctgaaaacattaaagacaagctcaaggagatgggattcgaccgctataaaatggtggtgcaggtggttatcggtgagcagaggggtgagggcgtgtttatggcttccagatgcttttgggacgcagataccgataactacactcacgatgttttcatgaatgattctctgttttgtgtcgtggcggctttcgggtgcttctactactag

SEQ ID NO: 60131 - DNA, 255 bp, Artificial Sequence
  Description of Artificial Sequence: Synthetic coding sequence
atggcgactagtattggggtttcattttctgttggcgacggggttccggaggctgaaaagaacgctggcgagcccgagaacacctacatcctacggccagtattccagcaaaggttccgcccaagcgtggttaaggattgtattcacgcggttctcaaggaggagctggctaatgcagagtactcaccggaagaaatgcctcaactcaccaagcacttatccgaaaacatcaaggacaagaaaaagaagaaatag

SEQ ID NO: 60132 - DNA, 1053 bp, Artificial Sequence
  Description of Artificial Sequence: Synthetic coding sequence
atgtccgccgcatgttgggaagagccttgggggttgcccggaggcttcgctaaacgagttctggtcactggaggcgcagggtttatcgccagccacatgattgtttcattggtggaagactaccctaattatatgatcataaacctcgataagctggactattgcgccagtctaaagaatcttgagacaatctccaacaaacagaattataaattcatccagggcgacatctgcgacagccactttgtcaagctgttgttcgagactgaaaagatcgatatcgtgctacacttcgccgcacagacccatgttgacctatcttttgtgagggccttcgaatttacatacgtgaatgtctatggaacacatgttctcgtgagtgccgcacacgaagcacgcgtggagaagttcatctacgtatcaaccgatgaagtctatggcggaagcctggataaggagttcgacgagtcttcgcctaagcaacccacaaatccttacgcaagctctaaagctgccgcagaatgttttgtccagtcgtactgggagcagtataagttccctgttgtgattactaggtcctcaaatgtctatgggcctcaccaatacccagagaaggtgattccgaagtttataagtcttctgcaacacaatagaaaatgttgcattcacggttcgggcctccagactcgaaattttctctacgctacagatgtggttgaggcatttctcactgttcttaaaaagggcaagcccggtgagatctacaatatcggaacaaatttcgagatgagcgtagtgcagctcgcaaaagaactgatccaactgatcaaagagactaatagcgagagtgagatggaaaattgggtggactacgttaacgatcggccaaccaacgacatgaggtatcccatgaagagcgaaaagattcatgggcttgggtggcggcctaaggtcccatggaaggaagggattaagaaaaccatcgagtggtaccgcgagaattttcacaactggaagaacgtggaaaaagcactggagccatttcccgtgtag

SEQ ID NO: 60133 - DNA, 4236 bp, Artificial Sequence
  Description of Artificial Sequence: Synthetic coding sequence
atggcgtccataagcgagcctgttaccttccgagagttttgtcccttatactaccttctaaacgccattccaacaaagatccaaaaggggtttcgctccatagtcgtctatttaaccgctctggacactaacggagactacatcgccgttgggtccagcattggcatgctatatttatattgtaggcatctcaaccagatgcgtaagtataactttgagggcaagactgagtctataacggtagttaaactcctgtcttgctttgatgatctggtggctgccggaactgcgtctgggcgtgtagctgtatttcagcttgtatcgtccctccccggtcgaaataaacagcttcggaggtttgatgtcacaggcatccacaagaacagcatcacagccctggcatggtctccaaacggtatgaaactgttttcaggggatgataaaggcaagatagtttacagtagtctcgacctggaccaaggcctctgcaatagccagctagttcttgaggaaccaagttccatcgttcagttagactacagtcagaaagtattgctcgtgtccacactgcagcggtccctcctgttctatactgaggagaaaagtgtccgccagatcggtactcaacctcgaaagtcaactgggaagttcggcgcttgctttattcctggcttatgcaagcaaagcgaccttacgttgtatgccagtagaccgggactgcggctgtggaaggcagatgtacacggtacagttcaggccactttcatcctgaaagacgctttcgccggtggtgtcaagccatttgagcttcacccaaggcttgagagccctaattctggaagctgtagcctccccgaacgccacctagggttagttagttgcttcttccaggaagggtgggtactcagctggaacgagtatagtatttatctgctggatacagtcaatcaggctaccgtagccggactggaaggttcaggggatattgtgtccgtttcatgcaccgagaatgagattttttttctgaaaggcgacagaaatattatacggattagcagtcgacctgaggggttaacctccacagtcagggacggactggaaatgtcaggctgttcggaacgcgtccatgtacaacaggccgaaaaattacccggagctaccgtgtccgaaactaggctcaggggaagttcaatggcctcctcagttgcttcagagcctcgctctcgcagcagcagcctgaactcaacagattcagggtcagggttactgcctcctgggctccaggccactcccgaattggggaaaggttcccagcccctttctcagcgatttaacgccataagctccgaagacttcgaccaggagctggtggttaaacctattaaagtgaaaagaaagaagaagaagaagaagacagagggtggctccaggtccacatgtcactccagtctggagtccaccccttgcagtgagtttccgggtgactctccacagtccttaaacacagatttactttcaatgacgagctcagtgctgggttcttctgtcgaccagctgagcgcggagtcccctgatcaagagtcatcatttaacggtgaggtaaacggtgtcccacaggaaaataccgatcccgaaactttcaacgtcctggaggtaagcggtagcatgccagactcccttgctgaagaggatgacattagaaccgagatgccccattgccaccatgcacacggcagggagctcctgaacggcgctcgggaagacgtgggcggatccgacgtcactggcctgggagacgaaccctgtcccgcagatgacggacctaacagcacccagctgccattccaggagcaagacagctcccctggcgctcacgacggcgaggatattcagccaattgggcctcagagtaccttttgtgaggtaccgttgctcaattctcttaccgtaccatcctccctcagctgggcaccgtctgctgagcaatggctcccgggaacccgggcagatgagggatcacctgttgagccctcacaagaacaggacatcctgacatccatggaggcaagcggacacctgtccacgaatctttggcacgccgttaccgatgacgataccggtcagaaagaaattcctattagtgagcgggtgttgggctcagtaggcggacagctcactccagtatctgccttagctgcctcaacacacaagccatggttagagcagccccctcgtgaccagaccttaacctcctccgatgaagaagatatatacgctcacggcctacctagctcttcatctgagaccagtgtcacagaactaggaccctcctgttctcagcaagatctcagcagactgggtgcagaagacgccggtctcctgaagccagaccagttcgcggagtcctggatgggatattcagggccaggctacgggattttgagcctggtcgtgagcgagaagtacatttggtgcctagattacaagggaggactgttctgttccgcattgcctggcgctgggttgcggtggcagaagtttgaagatgccgttcagcaagtggctgtttcccctagcggggctctgctgtggaagatcgagcagaagtccaaccgggctttcgcttgcggtaaggtgactatcaagggcaaaagacattggtacgaggctctgccccaagccgtgtttgtagccctgagcgatgacaccgcatggatcattagaacctccggcgacttgtacctgcagaccgggctctcagtggacagaccgtgcgcccgagctgttaaggtagactgcccgtatcctctgagtcagataaccgcccgaaataacgtggtatgggccctgacagagcaaagagcgctactctaccgagaaggggtcagctcattctgcccagagggagaacaatggaaatgcgatatcgtgtcggaacgacaggccttggagcctgtttgtataacattgggagaccagcaaactctgtgggccctggacatacacggaaatctctggttccggacagggatcattagtaagaagccccagggtgacgatgatcactggtggcaggtgtctatcaccgactacgttgtgtttgatcagtgttctctgtttcaaacaattattcatgcaactcactcagtggccacagccgctcaggccccagtggaaaaagttgcggataaactgcggatggctttttggtcccaacagcttcagtgtcagccaagtctgctgggcgtgaataacagtggagtatggatctcttccggcaagaacgaatttcacgtggccaaaggatcccttattggcacgtattggaaccatgtcgtccccagaggcaccgcaagcgcaaccaaatgggcattcgtgttggcctcggctgctccaaccaaggagggctccttcctgtggctctgtcagtcatccaaagacctttgctccgtcagcgcacagagcgcacagagccgtcctagcacagttcagctgccgcctgaggctgagatgagggcttacgcagcatgccaggacgccttatgggcactcgactctctggggcaagtcttcatcaggacactgtcgaaatcctgtcctactgggatgcactggacaaggctggacctaagtcagctcggggcagtgaaactcacttccctggcatgcggcaatcagcatatctgggcctgtgattccaggggtggcgtatatttcagggttggcacgcagccactgaacccttcactgatgctcccggcttggatcatgatcgaacctccggtgcaacctgccggagtgtcactggtgagcgtgcactcgagccctaacgatcagatgctgtgggtgttagactctcggtggaatgtccacgtaagaaccgggattacagaagaaatgcctgtcgggacagcttgggaacacgtgcctgggttgcaagcctgtcagctggccctgtccacacgaaccgtctgggcgagatgtcccaacggtgaccttgccaggaggtatggggttaccgataaaaaccccgcaggcgactattggaagaaaattcctgggtccgtcagctgcttcaccgtcaccgccagcgatgagctgtgggctgttggcccacctgggtatttgttacagaggctgactaaaactttctcgcactcccacggaacacagaaaagcagccaggccgcaatgccccacccagaggatctggaggatgaatgggaggtgatttag

SEQ ID NO: 60134 - DNA, 2202 bp, Artificial Sequence
  Description of Artificial Sequence: Synthetic coding sequence
atggccagtatctccgagccggtcaccttccgagagttctgcccactctactacctcctgaacgccattccgaccaagattcaaaagggatttaggagcattgtggtctatcttaccgcactggacactaacggggattacattgccgtgggcagctccattggcatgttatacttgtactgtcgccacttgaatcagatgcggaagtataacttcgagggcaaaactgagagcatcacagtggtaaaactgttatcatgcttcgacgacctggtggccgctgggaccgcctcaggcagagtggccgtctttcagctagtgtctagtttgcctggtagaaataagcagctgcgccgattcgacgttacaggcatccacaaaaactccattacagccctggcatggtcaccaaatggaatgaaactattctctggcgacgataagggtaaaattgtttacagcagcctcgatctagatcagggactatgtaactctcagttggtgctggaggagccgtccagtattgttcagctggattactcccagaaggttttgctggtgtcaacgctgcaacgcagtttgcttttttacactgaggagaagtcagttcggcaaatcggaacccagcctaggaaaagcactggtaagtttggcgcatgctttatccctgggctgtgtaaacagtcagatctgaccctgtacgcctctagacctggccttaggttgtggaaggccgatgtgcacggcaccgtgcaggctacattcatcctgaaggatgcttttgcaggaggggttaaaccctttgagctccaccccaggttagaatcccccaattccggaagctgcagtctgcccgagcgtcatctgggcctggtcagttgtttcttccaggaggggtgggtcctgagttggaatgaatacagtatataccttctcgatactgtcaaccaggccaccgtggcgggacttgagggatccggggacatcgtatcagttagctgcacagaaaatgagatcttcttcttgaaaggtgaccgcaacattattcggatctccagtcgacctgaaggcctcacctccaccgtcagggatggactcgagatgagcggttgtagcgaaagggtgcacgttcaacaagctgagaaactgcctggcgcaactgtgtccgagacccgactgagaggaagttccatggcttcaagtgttgcctcggagcccagatcacgctctagttcacttaactccacagactcaggatctggcctgttgccgcctggattgcaggccacccccgagcttggaaaaggctcacagcccttgtctcagaggttcaatgccatctcttcggaggatttcgatcaagagctggtcgtgaagcctatcaaggttaaacggaagaagaaaaaaaaaaagaccgaggggggtagccgctccacttgtcacagcagcctcgagtcaaccccgtgtagcgagttccccggtgattccccgcaaagccttaatacagacctgctctcaatgacgagtagtgtgctgggaagtagcgtcgatcagctgagcgcagagagcccggaccaggagtcatcttttaatggagaagttaacggtgtgccgcaggaaaacactgatcctgaaacctttaatgtgctcgaagttagcggctcaatgcctgacagcctcgctgaagaggatgatattcgcacagagatgccccattgccaccatgctcatgggagagagcttctgaacggcgcacgcgaggacgtggggggatcggacgtgaccggactcggcgacgagccttgcccagccgatgacggtcctaattccaccccccagcacaccactcatcttactagccaccactctaccccccaccatacaacccctcattgtacgataccacaccacataagtccacaccacagcacacctcatcacactactcaccacactccccatagaaccgctccacaccgtactgcaccctatctcgccaccagccatcacacaactccacatcatactagccttcccacacacggcgcaggttgtccacctcctggtgaacatacatccgccgaaactgtgaaacctgacgggtgtaagtggaacctagacgtgtgcacatgcgtacccggtagagatggtactggagggtgcatgggtcggggaggagctgagcaggggtccctcacttag

SEQ ID NO: 60135 - DNA, 3804 bp, Artificial Sequence
  Description of Artificial Sequence: Synthetic coding sequence
atggcaagcatcagtgagccagttaccttccgcgagttctgccccctgtactatcttctcaatgccattccaactaagatccaaaagggatttcgctcaattgtcgtgtatctcaccgcactggatacaaacggagactacattgcagtggggagctccattgggatgctgtacctgtattgtaggcacctcaaccagatgcggaagtataacttcgagggaaaaaccgagtctatcactgtcgtgaagctcttgagttgcttcgatgatcttgttgctgccggaacagcaagcggccgtgtggcagtgtttcaactggtgtcaagcttaccaggacgaaacaagcagctcagaagattcgacgtgaccgggatccacaaaaattcaattactgcattggcctggagtcccaatggcatgaaactgttctccggcgacgataaagggaagatcgtgtattccagcttggatctggatcaaggtctatgtaactctcagcttgtgcttgaggagcctagcagcatcgtgcagctggattactcacagaaagtattgctggtcagcacactgcaacgcagtcttctgttttacacagaagagaagagcgtgagacaaatcgggacacagcctcggaagagtactggaaaattcggcgcttgctttatccccggactttgtaagcagagtgatctcacactgtacgcctcccgtccagggttaagactgtggaaagctgatgtgcacgggacagtccaagctacattcattctcaaggatgcatttgccggaggcgtcaagcccttcgagctccatcccaggcttgagtccccaaactccggcagctgctccctgcctgaacgacacctggggcttgtttcttgcttcttccaggagggatgggtcttaagctggaacgagtactccatttacttgttggatactgtgaaccaggctaccgttgcaggcctcgaaggctctggcgatatcgttagtgtctcatgcaccgagaatgaaatttttttcttgaaaggtgaccgtaatattatcagaatcagctctaggcccgaggggctgacctcaacagtcagagacggattagaaatgtctggctgttcggagagagtccatgtacagcaggctgaaaaactgccaggcgctaccgtgagcgagacgcgcctgcgtggtagcagcatggcttcaagtgtggcatccgagccacgcagcaggagctcgtcccttaactctacagattccggtagcgggctgctgccacctggactgcaggctacaccggaacttggaaaaggatcccaacctctctcccagcgcttcaatgccatctctagcgaagatttcgatcaggagctcgttgtcaagcctataaaagtcaagagaaaaaagaaaaaaaagaaaacagagggcggatctcgaagcacctgtcattcatctctcgaaagcactccttgtagcgagtttcccggagacagtcctcagtccctcaatacagatctgcttagcatgacatcaagcgtgctaggcagttccgttgaccaattgagcgctgaatcccctgaccaagaatcctcatttaacggtgaggtgaacggcgtgccacaagagaacacggatcccgaaacattcaacgtcctggaggtgagcggctcaatgcctgactcactagcggaagaagacgacatcagaaccgaaatgccgcattgccatcacgcccacgggagagaactgctgaacggggcacgggaggacgttggtggatcagacgtgacaggtttgggggacgagccttgtcctgccgatgatgggcctaactctacgcagctgccttttcaggaacaagattcttcccctggcgctcacgacggagaagatatccagcccatcgggccacagtctaccttttgcgaagtgccattactaaactcactgactgtaccaagttcactgtcctgggccccttcagccgagcagtggctccccggaacgcgcgctgatgaaggctctcccgttgaaccttcgcaggaacaagatattctcactagcatggaggcgagcgggcacctttctactaatctctggcatgcggtgactgatgacgatacaggccagaaggaaattcccatctctgaacgagtgctgggaagtgtcggtgggcagctaacccctgttagcgccctcgccgcttccactcataagccttggctcgaacagcccccacgcgaccaaactctgacatcttcagacgaggaagatatttatgcacatgggctcccatcttccagtagcgagactagcgtaacagaactgggcccatcctgttcacagcaggacctcagccggctcggtgcggaggacgctggcctgctgaagcctgatcaattcgccgagagttggatgggctactcaggacccggttatggaattttgtctctagtagtcagcgagaaatacatctggtgtctggactataagggcggtctgttctgcagcgctttgccaggcgcaggactgcgctggcagaagttcgaggatgccgtgcagcaggtggctgtttccccctccggggctctgctgtggaaaattgaacaaaagtctaatagagccttcgcatgtgggaaggtaacaattaagggcaaaaggcactggtacgaagcgctgccccaggccgtttttgtggctttgtccgatgacacggcgtggatcatccggacctccggggatctgtatctacagactgggcttagcgtagataggccttgcgcccgtgctgttaaggttgattgcccctaccccctgagtcagatcacagcaagaaacaacgtggtctgggcacttactgaacagcgcgcactcctgtatcgggaaggtgttagtagtttctgccctgagggtgagcaatggaagtgcgacattgtgtctgagcgccaggctctggaacccgtgtgtattacattgggagaccagcagactctgtgggccctcgacatacatgggaatctctggtttcgcaccggcattatctctaagaagccacagggggatgacgaccattggtggcaagtatccattacagattacgtggtgtttgaccagtgcagcctgttccagacaattatccacgctacacactctgtggctactgcagcccaggctcccgtcgaaaaagtggcggataaactgcgaatggcgttttggtctcaacagttgcagtgccaaccctcactgctgggcgttaataacagcggcgtttggatcagtagcggcaagaacgagtttcacgtggcaaagggaagcttgattgggacttactggaaccatgtggtaccacggggaactgcaagcgcgactaaatgggcattcgtgctggcctccgcagccccaacaaaggaagggtcatttttatggctttgccaatcctccaaagatttgtgtagcgttagcgcccagtctgcccagtcaagaccatcaaccgtgcagctgcctccagaggctgagatgagagcatacgccgcatgccaagacgcgctctgggctttggactcgctcggccaggtgtttatacggacccttagcaaatcttgcccgactggaatgcattggacccgcttggacctatcccagcttggcgctgtgaagcttacaagcctggcctgtgggaatcaacatatctgggcatgcgatagtagggggggtgtttactttcgggttggcacacagcctttgaatcccagccttatgctccccgcttggataatgatagaacctcccgtgcaagtctcaaggtcttag

SEQ ID NO: 60136 - DNA, 453 bp, Artificial Sequence
  Description of Artificial Sequence: Synthetic coding sequence
atggactcaaggaagctgagtccaagagggaagaagcttgaaagccatctgagccaggaacatcggaggcctccgctgggtcttatagcagcctggggacaaccttcaattcagagctccgttcaacaggggttacagacccaggactgggtgtgtgagccacctgagaggcgtagacctggccgaaggtggtccgtgtccattgatgaacgtcgtcggctcgctacgttgggagggagagagcgaccaggggctgccggtacgcagctccactgccgggacgtggtgcagatggtagcgcaactggtgagtgaggacgtggataaggacgttctcctcccacaccccctcagaagtaccgagagcacaaacgcttttcaggccttcctcgcccgaagtgcccctttctggcacaacgctacctttgaggccagtcgcagcccacctagttag

SEQ ID NO: 60137 - DNA, 621 bp, Artificial Sequence
  Description of Artificial Sequence: Synthetic coding sequence
atggacagccagcaggaggacctgagatttcccggaatgtgggtcagtctatactttgggattctaggcctctgttcggtgatcacagggggatgtatcatcttccttcactggcgaaaaaatttgagacgagaggaacatgcacagcagtgggtggaggtcatgcgtgctgcaactttcacttatagtcctcttctctactggatcaataagcgcaggaggtacggaatgaacgctgcgatcaacactggccctgctcccgcagttacgaagacagaaactgaggtgcagaatccggatgtcctttgggatcttgacatcccggaggggaggagccacgctgaccaggattcaaacccaaaggcagaggcccctgcccctttgcagcccgctctgcaacttgctccgcagcaaccacaggcaagatctccttttccactccctattttccaagaggtacccttcgcaccacctctctgtaacctccctcccctgcttaaccactccgtgtcctatccattggccacttgccccgagaggaacgtcctatttcacagtctcctgaatctagctcaggaggatcatagctttaatgccaaaccctttccctctgaactttag

SEQ ID NO: 60138 - DNA, 1176 bp, Artificial Sequence
  Description of Artificial Sequence: Synthetic coding sequence
atggctgggcgttccctgtgtttgactagaagttccgtgccgggtactccatttcccccacccgtgcagcagccctctacacctggtccagacctgcttgcactggaagaagagtataagcgcctgaatgccgaactccaggctaagacggcagatgtggtacagcaagctaaagagatcatacgcgacagacaggaggtgaggtcaagaccagtgagtacccagatgaagtcttgtgacgacgaggatgactacagcttaagagggttgctgccaagtgagggtattgtacacctccactctgagacgaagccgaaaactaaaaatattgatcccgttaacaaggtgcagaataaactgcattcagccaataagggaaggaaaacaaatagtagcgtcaagcttaagtatagtgacgtccagaccgctgatgacgttgcaatcccggaagactttagcgacttttccttggctaagacaatcagcaaaattgaagggcagctggaggaggaaggattgcccgaatatatcgatgacattttcagcggcgtcagtaatgatattggcaccgaggctcagattaggtttttgaaggccaagctccatgttatgcaggaggaacttgataatgtggtctgcgagtgtaacaaaaaagaagacgagattcagaatcttaagagccaagtgaagaactttgaggaggatttcatgaggcagcaacgcactattaatatgcagcagtctcaggtggaaaagtacaagactctgtttgaggaagcaaataaaaagtatgacggcctccaacagcagctctcatccgtggaacgggaactcgagaataagagacgactgcaaaagcaggccgcatcttctcagtcggcgaccgaggtgagactgaaccgcgcactcgaggaggctgaaaaatataagctggaactgagcaaactgcggcagaacaacaaggacatagcaaacgaggagcataagaaaatagaagtgctcaaatcggaaaacaaaaagctcgagaagcaaaaaggagagctgatgattgggtttaaaaagcagctgaaacttatcgacgtcctcaagaggcagaagatgcacatcgaggccgctaagatgctttcatttaccgaagaagaattcatgaaagcactggagtggggcaatagttag

SEQ ID NO: 60139 - DNA, 951 bp, Artificial Sequence
  Description of Artificial Sequence: Synthetic coding sequence
atgaagtcctgtgacgatgaggatgactactctttgcggggactcttgccaagtgaaggaatcgtccacctgcacagcgaaacaaagcctaaaaccaagaatatcgatcctgtcaataaagtgcaaaacaaactacacagcgccaacaaggggcgaaagaccaatagcagcgtaaaattgaagtacagcgacgtccaaactgcagacgacgtcgccattcccgaggacttctccgatttctcactggcaaaaaccatttcaaaaatagaggggcagctggaggaggagggactgccagagtatattgatgatatattttccggagtttccaacgatattggcacggaggcccagatacgttttttaaaagccaaactgcacgttatgcaagaagaactggataatgtcgtgtgcgaatgtaacaaaaaggaggacgaaatccagaacctgaaatcccaggtaaagaattttgaggaagattttatgcgccagcagcgcacaattaacatgcaacaatctcaagtcgagaaatataagacactgttcgaagaagcaaataaaaagtacgatgggctgcaacaacaactgtcatcagtggaacgcgagctggagaacaagaggagactgcagaaacaggccgcttcatcacagtctgctaccgaggtgcgccttaaccgggcactggaggaagccgagaagtacaagctggagctgtccaagctgagacagaacaacaaagacatcgctaatgaggagcacaaaaagatcgaggtgctcaagagcgaaaataaaaagctagaaaaacaaaaaggcgaactgatgattggatttaagaaacagctgaagttgattgatgttctgaagcgccaaaaaatgcatattgaggccgcaaaaatgctgagcttcactgaggaggagttcatgaaagccctcgaatggggtaactcttag

SEQ ID NO: 60140 - DNA, 828 bp, Artificial Sequence
  Description of Artificial Sequence: Synthetic coding sequence
atgtctcaaaagcgacaaaccaagtttcaaaacgggaagagcaagacatctgagaatagctctgctaaacgggagaagggtatggtggtgaatagtaaggagatcagtgacgcggttggccaatctaagtttgttctggagaatctgcgccactacacagtccatcctaacctcgcccaatactacaagcccctaaaggccacggccctgcagaagttcctggcccagaatagaaaaaacacaagcttcatgctgaaggtgacacagtatgaccaggataagaccctgttgatcatgacaaacaacccacccccatgctctattacccagcaagataaagagtctgctagcaagtatttcagcaaagagttgttattgaaggtgatggaatctcaccatcagcacaagccgacggagaacctgtggctccctcgcatgccccagaagaagaagctgcgctcaaagctcaaacccattttcccactcatactcagtgatgatcctactagtaagcgtgaacagtggttccgcttcagcacagacaatgatttcaagtctgagggtaagtactcaaaggtttatgccttaaggactcagaagaagatgtaccctcagctcacatttgcccctgtccacgaaagagacatgagaaaagacgcctcaaagaaatcagcatccgagaggcccataagcaaagtcatccgagagcccctgacgctggcatctctgctggaggacatgccaacaagaacagctcctggggagagcgccttcaggaacggcagagcccctcagtggatcatcaaaaaagctaccgtcatcggatag

SEQ ID NO: 60141 - DNA, 927 bp, Artificial Sequence
  Description of Artificial Sequence: Synthetic coding sequence
atgcgtcccgaagggtccctcacataccgcgtgcctgaaagactgcgccagggcttctgcggcgtgggaagggctgcccaggcccttgtttgcgccagcgccaaggaaggcaccgcatttagaatggaagcagtacaagaaggcgcagcaggcgtcgaatctgaacaggccgcactcggagaggaagccgttctgctgctagacgacattatggccgaggttgaagtcgtggccgaagaggagggactggttgaacgcagggaagaggctcagagggcacagcaggccgtaccaggccctggacccatgacccccgagagcgctctcgaggaactgctagccgtgcaagttgagcttgagccagttaacgcccaggcccgtaaggcatttagcagacagcgggaaaaaatggagcgaaggagaaagcctcacctggatcggaggggtgcagttattcaaagcgtgcctgggttttgggccaatgtgatcgctaatcacccgcagatgagcgctctgattactgatgaggatgaggacatgctgtcatatatggtaagcctcgaggtggaagaggagaaacaccccgtgcatctgtgtaaaattatgttgttcttccgttctaacccctacttccagaacaaagtcatcacgaaggagtacttggttaacatcaccgagtaccgtgcctcccactccaccccgattgaatggtacccagactacgaagttgaagcctaccgcaggcgccaccacaatagttccctgaactttttcaattggttttctgatcataacttcgccggttctaataaaattgccgagatcctgtgcaaagatttgtggagaaatcccttgcaatactacaagcgaatgaaacccccagaggaagggactgagacatccggcgatagccagctgctgtcttag

SEQ ID NO: 60142 - DNA, 441 bp, Artificial Sequence
  Description of Artificial Sequence: Synthetic coding sequence
atgaggcctgaggggagcctcacttatagagtgccggagcggctgcggcaagggttttgcggcgtcgggcgagcggctcaagccctcgtcgaattggagccagtgaatgctcaggcgaggaaagcgttttctcgccagagggagaaaatggaacgcaggaggaaacctcacctggatcggaggggcgcagtcatccaatcggtccccggattttgggccaatgttatcgccaatcaccctcaaatgagtgcccttatcacagatgaagatgaggatatgctcagttatatggtgagtctcgaggtagaagaggagaagcatcccgtacacttgtgcaagatcatgctattttttcggtctaatccttatttccagaacaaagtcatcaccaaggagtatttagtgaacatcacagagtaccgtgccagtcacagtacctag

SEQ ID NO: 60143 - DNA, 885 bp, Artificial Sequence
  Description of Artificial Sequence: Synthetic coding sequence
atgagacccgaggggagcctcacctaccgagtgccagagcgcctgcgccagggattctgcggggttggacgggcagcccaggccttagtttgtgcatcagcaaaggaagggacagcctttaggatggaggcggtgcaggaaggagctgcaggggtggaaagcgagcaggctgctttgggtgaagaagccgtcctgctgctggatgacatcatggctgaggtggaagttgttgcagaggaagagggacttgtcgagcgcagagaggaagcacaaagagcacagcaggcagtcccgggtcccggaccgatgaccccggagagtgcgctggaggagcttctcgccgtccaggtggagttggaaccagtgaatgcccaggctcgaaaggcgttcagtagacagcgagagaagatggaacgcagaaggaagccccatctagatcgtagaggagcagtgattcagagcgtgcccggattctgggccaacgtgattgccaaccatccgcagatgtctgctttgatcacagatgaggatgaagatatgcttagttatatggtgtccctggaagtcgaagaggagaagcaccccgtgcatttgtgtaagatcatgttattcttcaggtcaaacccttacttccagaacaaagtcatcaccaaagaatatctagtgaacattactgagtatagagcctctcactctacacctattgaatggtatccggactatgaagttgaggcttatagacgtcgtcaccacaactcttcactcaactttttcaactggttttcagaccataattttgccggatccaacaaaatagcagaaagtccagacaggagctacgtccgaacttgcggcgcaataccttgtaacaccactcgaggctag

SEQ ID NO: 60144 - DNA, 927 bp, Artificial Sequence
  Description of Artificial Sequence: Synthetic coding sequence
atgcgtccagagggctcactcacttaccgtgtgccagagaggctgagacaggggagctgcggagtaggcagggcagcgcaggcactggtgtgcgcttcagccaaggagggcacagccttcaggatggaagccgtccaagaaggagccgcaggcgtcgagagtgaacaggccgctttaggagaagaggccgttctccttcttgacgatatcatggcagaggtggaagtagtagcggaggaagaaggactggtggagcggcgagaggaagcccagcgcgctcaacaggctgtgcctggaccaggccctatgactcccgagagcgctctcgaagagctgctggctgtgcaggtggagctcgagccagttaatgcccaagcaaggaaagccttctcaaggcagagagagaaaatggagcgaaggaggaaaccccatctggataggaggggagcagttattcagagtgtccctggcttctgggccaacgtaatagccaaccacccacaaatgtccgcgctgataaccgacgaagacgaggatatgttgagctacatggtttccctggaagtggaggaggagaagcaccgcgttcatctctgtaaaatcatgttgtttttcaggagcaacccctactttcaaaacaaggtcataacaaaggagtatttagttaatatcacagagtatcgggcttcacattccacgcctatcgagtggtatcccgattacgaggtagaagcctaccggcgaaggcatcacaatagttcgctcaactttttcaactggttcagcgaccacaactttgccggttccaataaaatcgcagagatcttgtgtaaagacctttggcggaatcctcttcagtactacaagcgtatgaaacctcctgaagaaggaacagagacctctggggattctcaactgctctcgtag

SEQ ID NO: 60145 - DNA, 795 bp, Artificial Sequence
  Description of Artificial Sequence: Synthetic coding sequence
atgcggccagaaggcagcttgacataccgagttcccgagcggctgcggcaaggcttctgcggggttggtcgggcagctcaggcactggtgtgtgcctccgccaaagagggcacagcttttagaatggaggctgtgcaggaaggtgccgcaggagtcgagtcagagcaagctgccctgggtgaagaggcagttctgctcctggatgatattatggctgaggtggaagtggtggccgaagtagaagtagtggccgaagaagaggggcttgtggaacgacgagaggaagctcagagagcccagcaggccgtgccaggtcccggaccaatgactcctgagagtgctctcgaggaactactggccgtgcaggtagagctggagcccgtcaatgctcaggcacggaaagccttcagccgccagagggaaaagatggaaaggagacgcaagccacacctggatagaaggggcgcagttattcagtctgtccccggtttctgggccaatgtgatcgccaatcaccctcagatgtcagctttgatcactgacgaggatgaggacatgctgtcttatatggtgagtctggaggttgaagaggagaaacatcctgtgcacctttgcaagattatgctcttcttcaggtctaatccctactttcaaaataaggtgatcaccaaagagtacctggtgaatatcaccggagaccgatggttgcccggatgggtggttgaggggaggtggtgggttgatcattgtcagcgagatcctgccccatttccacagaaattgctgtctttgtag

SEQ ID NO: 60146 - DNA, 516 bp, Artificial Sequence
  Description of Artificial Sequence: Synthetic coding sequence
atgagaccggagggctcattaacatatcgcgttccagaaagactccggcagggcttttgcggtgtgggcagagctgctcaagccctcgtggaacttgagccagttaacgcccaggccaggaaggctttctccagacagcgagagaaaatggaaaggagaagaaagccacacctggatagaagaggggcagtgatccaaagtgtgcccggtttctgggctaacgtgatcgccaaccatcctcagatgagcgctctgattaccgacgaggacgaggacatgctcagttatatggtaagcctcgaagtcgaggaggaaaaacaccctgtccacttatgcaagattatgctgttttttcgttcaaacccatactttcagaataaggtaataaccaaggaatatctggtgaacattaccggcgaccggtggctgcccggatgggtggtggagggccgatggtgggttgaccattgccagcgtgaccctgcgcctttcccccaaaagctcctgagtttatag

SEQ ID NO: 60147 - DNA, 927 bp, Artificial Sequence
  Description of Artificial Sequence: Synthetic coding sequence
atgcgccctgaggggagcttgacgtaccgcgtacccgagagactccgacagggattttgtggggttgggagggcagcacaggctctggtatgcgctagtgcaaaagaggggaccgcctttaggatggaagctgttcaggagggggcagcaggcgtggagtccgagcaggcggcattgggtgaagaagcagtgctgctgctggatgacataatggccgaagtcgaggtggttgccgaagaggaaggattagttgagagaagggaggaggcccagcgggctcagcaggctgtgcctggtcctggacctatgactccggagtctgctctagaggaactcctagctgtccaggttgaactggaaccagtgaacgcgcaggctcggaaagccttttctcgtcagcgagagaaaatggaaagaagaaggaaaccacatttggaccgtagaggggcagttatacagtctgttcccggtttctgggccaacgttatcgcgaaccatcctcaaatgagcgcactgatcaccgacgaggacgaagatatgctctcatacatggtgagtctagaggtggaggaggagaaacacccggtacacctgtgcaagataatgcttttttttcgctctaacccgtacttccagaataaggtgatcacaaaggagtacttagtgaatatcaccgaataccgggcttctcactccactcctattgaatggtaccctgactatgaggtggaggcttacaggcgacggcatcacaacagcagtttgaacttttttaactggttctcggaccacaactttgcgggatctaataagatcgcagaaatcctctgtaaagatctgtggcggaatcctctccaatattacaagcggatgaagccgcctgaagaaggaacagagacttccggcgacagtcagctgttgagttag

SEQ ID NO: 60148 - DNA, 927 bp, Artificial Sequence
  Description of Artificial Sequence: Synthetic coding sequence
atgcgccctgaaggtagtctcacttaccgcgtgcccgagcgcttaagacaggggttttgtggtgtagggagggccgcacaggcattggtgtgcgcgagtgccaaagaagggactgcatttcgcatggaagccgtacaggaaggcgctgctggcgttgaaagcgaacaagctgcgctgggtgaggaggctgtgttattgctggacgatattatggctgaggttgaggtcgtcgccgaggaagaaggcttggtcgaaagacgggaagaggcccagagagctcagcaagccgtgcctggtcctgggcctatgactcccgagtcagccctggaggaacttcttgcagtgcaagttgaactggagccagtgaacgcccaggccagaaaagcgttttcccggcaaagagagaagatggagaggcggcgaaaacctcacctggacaggagaggcgcagtgatccagtcagtgcccggattttgggcaaatgtaatcgcaaatcatccgcagatgagtgccctgatcacggatgaggatgaagacatgctgtcttatatggtgagtctggaggtggaggaggagaagcatcctgtgcatctctgcaagatcatgcttttcttccggtccaacccatactttcagaacaaagtgattaccaaggaatacttggtgaacattacggaatatcgcgctagccactccacacctatagagtggtatcccgattatgaagtagaggcctatagacgccgacaccataacagttctcttaatttcttcaattggtttagtgatcacaatttcgcagggtcgaacaagatcgccgaaatcctatgcaaagacctgtggcgaaacccactccagtactacaaaagaatgaagcccccagaagaggggactgagacctcaggagactcgcagctgctgtcgtag

SEQ ID NO: 60149 - DNA, 903 bp, Artificial Sequence
  Description of Artificial Sequence: Synthetic coding sequence
atgagaccagagggcagcctcacatatcgtgtaccggaaaggctgaggcagggtttctgtggagtcgggcgtgctgcccaggcacttgtctgcgcaagtgctaaagagggcaccgctttccggatggaagcggtacaggagggtgctgcaggcgtcgaatccgagcaggccgctcttggagaggaggctgtgctcctgttggatgatatcatggctgaggtcgaggtagtggccgaggtcgaggtggtggccgaagaggaaggcttagtcgagcggagagaggaagcacaaagagcccagcaggcagttcctggcccaggtcccatgactcccgaatcggcgttggaagaactgctggctgtacaggtggagctggagcccgtgaatgcccaggcaaggaaagcattttcacgccagcgggaaaaaatggagcgcaggagaaagccacatttagataggcggggtgcagtgatccaatccgtgcctggattttgggcgaacgtgatcgcaaaccacccccagatgtcggcgctgatcactgacgaagacgaggacatgctgtcctatatggtgagcctggaggtggaagaagaaaaacacccagtccacctgtgtaaaatcatgctatttttccgaagtaacccctactttcaaaataaagtcatcactaaggagtacctggtcaatatcacggagtaccgcgcatctcatagcactcccattgaatggtacccggattacgaggtggaagcttatcggagaaggcatcacaatagttccctcaacttttttaattggttctcagatcataattttgccggttctaataagatagccgagagccctgaccggtcttacgtgcggacttgtggtgccattccttgcaataccacccggggttag

SEQ ID NO: 60150 - DNA, 945 bp, Artificial Sequence
  Description of Artificial Sequence: Synthetic coding sequence
atgcgtccggagggaagcctgacctaccgcgtcccagaacgccttcggcagggattttgtggagtcgggagggctgcccaggcgctggtgtgtgctagtgccaaggagggtacagctttccgtatggaggccgtccaggaaggcgcagccggtgtggaatcagagcaggctgccctcggagaggaagcggttttattgcttgatgatatcatggctgaggttgaagtggtggccgaggtagaagtcgtcgccgaggaggaaggactggtcgagcgaagagaagaggcccaacgagcacagcaggctgtccctggaccaggcccaatgacccctgagtctgccctggaggagctgctggcggtgcaggtcgaactggaacctgttaatgctcaggcaaggaaggcgtttagtcgacagagagagaaaatggagcggcgaaggaagccacacctcgacaggcgtggggctgtcattcagagcgtccccggattttgggctaacgtaatcgcgaaccacccgcaaatgtcagcgctgattactgacgaggacgaggatatgctgtcctacatggtctcgctcgaggtggaagaggaaaagcaccccgtgcatttatgtaagattatgttattcttccgctccaatccctactttcagaataaagtgataaccaaggagtatctggtcaacataacagagtatcgggcatctcactccacaccgatcgagtggtatccggattacgaggtcgaagcatataggagacggcaccacaactcatccctgaacttcttcaattggttttccgatcataacttcgctgggagtaacaaaatcgcggaaatcctgtgcaaggacctgtggcgtaaccccctgcagtattataaacggatgaagcctccagaagaggggactgaaacctctggcgacagccagctcctgtcatag

SEQ ID NO: 60151 - DNA, 927 bp, Artificial Sequence
  Description of Artificial Sequence: Synthetic coding sequence
atgcgacctgagggctcactgacctattgggttcccgagagattgcgacaggggttttgcggagtcggtagggccgctcaagcactcgtttgcgcttctgctaaggaaggcactgccttccggatggaagctgtgcaggagggcgcagctggagtcgagtccgagcaagccgctctcggggaggaggctgtgctgctgttggacgatatcatggctgaggtggaagtagtggctgaggaagaagggctcgtggagcgcagggaagaggcacagagagcccagcaggctgtgccagggccaggacctatgacacccgaatccgccttggaagaactcctggccgtccaagtagaactcgaacctgtcaacgcccaggcccgtaaagccttcagccgtcagcgggagaagatggaacgtcggcgaaagccacacctggacaggagaggggctgtgattcaatcagtgccgggtttttgggccaacgtcattgccaatcaccctcaaatgagcgctctgattacagatgaggatgaggatatgctcagttatatggtcagcctggaggtagaggaggagaagcatcctgtccacctttgcaaaattatgttgtttttcaggtctaatccctattttcagaataaagtaatcacgaaagagtatctcgtcaacatcacagagtatagggccagccattcaacacctattgagtggtacctagactacgaggttgaagcgtatcggcgaagacatcataacagttccctgaacttcttcaattggttctccgatcacaatttcgccggatcaaacaaaattgcggagatattgtgcaaagatctatggcgcaaccctcttcaatattacaagaggatgaagccgcctgaagagggcactgaaaccagtggagacagccagctgctttcgtag

SEQ ID NO: 60152 - DNA, 942 bp, Artificial Sequence
  Description of Artificial Sequence: Synthetic coding sequence
atgcgaccagaaggaagcctaacttactgggtacctgagcgccttcggcaggggttttgtggcgttgggcgtgcagcccaagccctagtgtgcgcctctgcaaaagagggtaccgcatttagaatggaggctgtgcaggaaggcgcagccggtgtcgagtcagagcaggctgcactaggcgaagaggcagtattgctgctggatgatattatggccgaagtggaagtcgtggccgaagttgaggtggtagccgaggaggaagggctagtcgagagacgggaggaggcccagagggcccaacaagcagtgccaggccctggacccatgacacccgagtctgccttagaggaactcctcgccgtccaggtggaactggagccagtgaacgctcaggctcgaaaggccttctctagacagcgcgagaagatggagcggtcaaagccacacttggatcggaggggagctgtgatccagtccgttcctggcttctgggctaatgttattgcaaatcacccccagatgagtgcattgattaccgatgaggatgaagacatgctaagttacatggtgtctctggaggtggaagaggaaaaacaccccgttcatctatgtaaaatcatgctgttttttagatcaaacccatacttccagaacaaggtcattaccaaagagtatctagtgaacataactgaatatagagccagccatagcactcccatcgagtggtacccggactatgaagtggaagcgtacaggagacggcatcacaatagctctctcaattttttcaactggttcagcgaccataacttcgccggaagcaataagatcgcagaaatactttgtaaggatctgtggcggaatccgctgcagtactataaaagaatgaaaccccctgaagagggaaccgaaacgagcggggactcacaactgctgtcctag

SEQ ID NO: 60153 - DNA, 885 bp, Artificial Sequence
  Description of Artificial Sequence: Synthetic coding sequence
atgcgccctgaaggaagcttgacctattgggtgccggagcgcctccggcaaggcttctgtggagtgggaagagccgctcaagctctggtgtgtgccagtgccaaggagggaactgcatttcgaatggaagcagtccaggagggagctgcaggtgttgagtcagaacaggccgcactcggagaagaggcagttctgctgttggacgacatcatggcagaggtggaagtggtggccgaagaggaaggtctggtagagagacgagaggaggctcagcgggcacagcaggctgtgccagggccagggccaatgacgcctgagagtgccctggaagaactgttggccgtgcaggtcgagttggaacctgtgaatgcccaagcacggaaagccttcagtcgtcaacgagaaaaaatggagcgtcgtcggaaaccacacctagacagacgtggcgcagttatccagtccgtacctggcttttgggctaacgtgattgctaaccacccgcaaatgtccgctctgattacagacgaagacgaggacatgctgtcctacatggtttccctcgaagtagaggaggagaagcatcccgtccacctctgtaaaatcatgctgttttttcgttccaatccatacttccagaataaggtgatcacaaaagaatacctcgtgaacattactgagtatcgtgcatcccattcaacacccatcgagtggtatctcgactacgaggtggaggcctaccgccgtaggcaccataatagctccctgaatttcttcaattggttctccgaccacaatttcgctgggagcaataaaatcgccgagtctcctgaccgcagttatgtgaggacctgcggggcaatcccttgcaatacaacacgcggatag

SEQ ID NO: 60154 - DNA, 927 bp, Artificial Sequence
  Description of Artificial Sequence: Synthetic coding sequence
atgcgcccagagggctctcttacatactgggtgcccgaaaggctgagacaggggttctgtggcgtaggacgcgctgcccaggcactggtctgtgccagcgcaaaggaaggtacagcttttaggatggaggcagtccaagagggggcagctggcgtggaatctgagcaggcagcgttgggtgaagaggccgttctgttgctggatgatataatggccgaggtcgaagtcgtggccgaggaagaggggctcgtcgagcggcgtgaggaagcacagcgcgctcagcaggccgtgccagggcctggaccaatgacaccagagtccgccttggaggaactactcgctgtccaagttgagctggagcccgtcaatgctcaggccaggaaggctttctcccgccagcgcgagaagatggagagacgacgcaagccgcacctggacaggcggggagcagtgatccaatctgtaccaggtttttgggccaatgtcatcgctaatcacccacagatgagcgctctgatcacagacgaagacgaggatatgctttcatatatggtgagccttgaggtcgaggaagaaaagcatccagttcatctgtgtaaaatcatgctgttttttcggtctaacccttacttccagaacaaggtgattaccaaggagtacctggtgaatattacagaatatcgggctagtcactcaactcccatcgagtggtacccagactacgaagtggaggcatataggaggcgccaccataatagcagtctgaattttttcaactggttctcagatcataactttgccggtagcaacaagattgcggaaattctgtgtaaagatctgtggcgtaaccctctgcagtactacaagcgcatgaagcccccagaagagggcacagagacatcaggcgactcacagttgttgtcttag

SEQ ID NO: 60155 - DNA, 621 bp, Artificial Sequence
  Description of Artificial Sequence: Synthetic coding sequence
atgacacctgaatctgccctggaggagctcttggccgtgcaggtcgagctcgagcccgtgaatgcacaagccaggaaagctttctccaggcagagagagaaaatggaaagacggaggaagccccacctagataggaggggagccgttattcagagcgtcccaggattttgggcaaacgttatagccaaccatccccagatgtctgctctaataacagacgaggacgaggacatgctgagctacatggtgtcactggaagtggaggaagagaagcaccctgtacacttatgtaagattatgctcttcttccgatctaacccctatttccaaaataaggtcattacgaaagaatacctcgtgaacatcactgagtatagggcttcacactcaacccccatcgaatggtacctggactatgaggtggaagcatacagaagaaggcaccacaactcaagtttgaatttcttcaattggttctctgaccacaactttgccggaagcaacaaaatcgccgaaatactgtgtaaggatctgtggcggaatcccctccagtattacaagaggatgaagccacctgaggagggtaccgaaacctcaggcgagccactcgttggcacatag

SEQ ID NO: 60156 - DNA, 828 bp, Artificial Sequence
  Description of Artificial Sequence: Synthetic coding sequence
atgtcgcagaagaggcaaacgaagtttcagaacggaaagagcaagaccagtgaaaattcttctgcaaagagggagaagggcatggtggtgaactctaaagaaatttcagacgccgtcggccagtcaaagttcgttctggagaatctgaggcattatacggtgcatcctaatcttgcccagtactacaaaccgttgaaggccactgctctacaaaaatttctggcccaaaaccggaagaatacctcatttatgcttaaggtgacacagtatgaccaggataaaactctcttgattatgaccaataatcctccgccatgttctattacacagcaagacaaagagtccgctagtaagtactttagcaaggagcttctgctgaaggtaatggagagccatcaccaacacaagcccactgagaatttgtggttgccccgtatgccccagaaaaagaaactgcgaagtaaattaaagcccatatttcctctgatcctgagtgacgatccaacaagcaagcgcgagcagtggttccggttctccacagacaacgactttaaatcggagggaaagtactcaaaagtgtatgctctaaggacacagaaaaagatgtatcctcaattgaccttcgcacccgtgcacgaacgcgacatgcggaaagacgccagcaaaaagtctgccagcgaacggccaataagcaaggttattagagagccccttacccttgctagtcttctggaggacatgccaacaaggacggcacctggagagagcgcatttcggaatgggcgagcaccccagtggatcattaagaaggctaccgtgatcgggtag

SEQ ID NO: 60157 - DNA, 177 bp, Artificial Sequence
  Description of Artificial Sequence: Synthetic coding sequence
atgtcgcagaaacgacagacaaagtttcagaacggtaagtccaaaacctctgagaacagctccgccaagagggagaagggtatggttgtgaactctaaggagataagcgatgcagtggggcagtctaaatttgttctggagaacctgagacattacacggtccatcccaacctttag

SEQ ID NO: 60158 - DNA, 231 bp, Artificial Sequence
  Description of Artificial Sequence: Synthetic coding sequence
atgagccagaaacggcagactaaatttcagaacggcaagtcaaagactagcgaaaatagcagcgccaaaagggaaaagggaatggtcgtgaacagcaaggaaatttccgatgctgtaggccagtctaagtttgtcctggagaatttgaggcattacacagttcatcctaacctggcacagtactacaagccccttaaagctacagctctgcagaagtttctggcgcagtag

SEQ ID NO: 60159 - DNA, 828 bp, Artificial Sequence
  Description of Artificial Sequence: Synthetic coding sequence
atgtcccagaagaggcagaccaagttccaaaacggcaagtcaaagaccagcgaaaacagcagcgctaagcgagagaaggggatggtcgtcaattccaaagaaatcagcgacgccgtgggccagtcaaagtttgtgctggagaatctccgacactataccgtccacccaaatttggcacagtactataaacctctcaaggcgacagcgttgcagaagttcctcgcgcagaaccggaaaaatacatctttcatgctgaaggtaacacagtatgatcaggataaaactctgcttattatgactaacaacccacctccatgctctatcactcaacaagacaaggagtccgctagtaagtacttcagcaaagagcttctcctcaaggtgatggaaagccaccatcagcataagccaactgagaatctgtggctccctcggatgcctcaaaagaagaaactacggtctaaattaaaacccatattcccattgatattgagcgatgatcctacttccaagagagaacaatggtttcgattcagcacagataatgacttcaagtccgaggggaagtattcaaaggtgtacgctcttcgcacccagaagaaaatgtacccccagttaacgttcgcgccagtccacgagcgggacatgcgtaaagacgcctcgaagaaatccgcctctgagcggcctataagtaaagtgatccgcgagcctcttaccttagcgtcactcctggaggacatgccaacacgaacagcaccaggcgagagtgcctttagaaatgggagagcaccgcagtggattataaaaaaggccactgttataggctag

SEQ ID NO: 60160 - DNA, 1230 bp, Artificial Sequence
  Description of Artificial Sequence: Synthetic coding sequence
atggcactccgcccagaagatccttcaagcggctttcgtcacagcaacgtggtagcattcattaacgagaagatggcacgtcacacaaaagggcctgagttctacctagagaatatttcactgtcgtgggagaaggtagaggataaattgcgcgctatcctggaggacagcgaagtccccagcgaggtgaaagaagcctgcacctgggggagcctggcacttggcgtcaggtttgcccatcggcaagcgcagttgcagcgacacagggtaagatggctgcacggctttgccaagctccataagagcgctgcacaagctctggccagtgatctgaaaaagctgcgagagcagcaggaaaccgagcggaaagaggccgcatcacgcttgaggatggcacagacatccctcgttgaggtgcagaaagaacgggataaggaactcgtctcaccccacgagtgggagcagggggctgggtggcccggtctagccaccgcaggcggagtgtgtactgagggcgcagcggaagaagaggaggaggctgccgtggccgctgctggcgctgctgggggaaaaggcgcagaggaggaacagcgggatgtggaggttgtcgctgccccagttgaggctatggcgcctcctgtggaagcaggggcagctcccatggaaacccagtttccccacgtggaagcgcgagcggctagtatggaaacgaccgagaaacttgagaggattctactccagctccttggagatgcggatcaggagaaatacacctattggggccaaaaggagggagacctacgctctgtggagactgctacatcttactttagcggcacaacgaatccttggtccagggcaagttctgagccactaccagtgcagctccctgccagctactcgtatagttattccagccctttcagctctttcagcgacatcccgacgatctccccaccccaggccacagttacggctcccgttccccctcagttgccttctgactgggaggcgttcgatacttccctctggagcgatgggggtcctcaccggatagatcatcaggagcatcccagggatcgcagatactccgagccacatcagcagcggccacctgtttaccgcaggcctggtgattgggattgtccgtggtgcaacgcagtaaatttcagtcgaagggatacttgctttgactgcggcaagggaatttggctgcagaagccccattag

SEQ ID NO: 60161 - DNA, 2637 bp, Artificial Sequence
  Description of Artificial Sequence: Synthetic coding sequence
atgtacgagggaaagcacatacacttctcagaggtagacaataagccactgtgctcctacagccccaagttgtgtaagcagagaaggctgaatggctatgctttttgcatacgccatgtgctggaggataagacagccccattcaaacagtgcgaatacgttgccaaatacaattcccagcgttgcactaatcccatacccaagtccgaggacaggaggtactgtaattcccaccttcaagttcttggcttcattcctaagaaggagaggaaaaaaaagaacgatccaatcgacgaggtgaaagtgcggcaccagatggatactatggcgttttcgctcactgtgccaaccttagctcttaagatgcccaacggtctggacggaatgagcctcagccccccaggagcccgagtccctctccattatctagaaactgagctagaagaccccttcgcttttaacgaggaagatgacgacctgaaaaaaggtgccaccgtacgaaagaaactccagagcaaactcgcacaaaaccggcagcgtcagcgtgagaccgagatcttaaaggtcaggcaagaacacttcagcccaccacctgcacctagtcagcaacagccaccccagcagcactcccatttaagtcctctgagcacctctctaaaacctcccgcaccaccacaaggatctgtttgcaaaagccctcagcctcagaacaccagccttccaatgcagggggtggcacctactactcacaccatagcccaagccaggcagctctcacacaaacgtccattgcctctgctcccttcctccagggctcccaccgtagaccccccacgtactgacagaatccttatgaaggctacagctttttcccctcacttcagttgcatctctcggctgcaacggctggtgaaactttgcacccagaagcatcagctagacactgacttatttcctcacctgggcttagactggtccgaggagagcggggaagagcccgaagacagcgagcaagccagtccctaccaggtcgcgtggtctattagggaaaccctgcggtatcaacggcatgccagcgacgacgacgatgccgagtcccgcagtagcagggtcacccagttatgcacgtatttccagcagaaatacaaacatctttgtcggcttgaaagggcagagtcccgacagaagaaatgccgccatacgtttagaaaggctctgctccaggcagcaagcaaggaacctgagtgcaccggacagctcattcaggaactgcgcagagctgcctgttcaaggacgtccatcagtagaacaaagcttagagaagtggagccagcagcatgtagcgggaccgttaaaggtgagcagtgcgccaacaaagccttgcctttcacacggcactgcttccagcatattctgctgaaccatagccagcagctgttctcatcctgtacggcgaagttcgcggacgggcagcagtgtagtgtgcccgtcttcgacatcacacaccaaacccccctctgcgaagagcacgcaaaaaagatggataacttccttcggggagataactcacggaaggtccagcatcaacaacagaggaagccaagaaagaagacaaaacccccagccctgaccaaaaaacacaagaaaaagaggaggcgcggtccgcgtaggccacaaaagcctatcccgcctgcggtgccacaggggaacctctccatgccggctagtgtatcactgcctgttgaagcgagccacatacgtagcccctctacgccagagcttagcgccgatgagctgcccgacgacattgcgaatgaaatcaccgacatcccccatgacttggaattgaatcaggaagactttagtgacgtgctcccgaggctgcctgacgatttgcaggatttcgacttttttgagggcaagaatggagatcttctccccactaccgaggaagccgaagagctagaacgcgctctacaagctgttacttccttggaatgcctcagcacaattggagtgctggcacaaagcgacggcgtacccgtacaggagctaagcgataggggtataggcgtgttctctacaggcacgggcgcttcaggtattcagtccctaagcagggaagtaaacacagacctgggcgagttgctgaacggcagaatcgttcacgacaacttctcgagccttgagctcgacgagaatctcctgcggtcagcaactctgagtaatccccctaccccattggccggtcagatacagggccagttcagcgctccggctaacgtgggcttgacctcagcgacgttaatttcccagtccgctctgggcgagcgcgcttttccagggcaattccacggcttacacgacgggagccacgcgagtcagagaccacaccccgcacagttattgtcaaaagccgatgatctgattacaagccgtcagcagtactcgtctgatcatagccattcaagtccacatggctcccattatgatagtgaacacgtaccgtcaccatactcagatcacatcacaagcccacacactaccagctatagcggggacaacatggctgcaccggtttgttttagaggatatcatcgccctgcatccgtagcttggggtctgctgctaaactag

SEQ ID NO: 60162 - DNA, 4983 bp, Artificial Sequence
  Description of Artificial Sequence: Synthetic coding sequence
atggactccggtccagtatatcacggcgattcacggcagctcagtgccagcggcgtgccagtgaatggggcacgggaacccgcaggaccttcactgttaggcacagggggaccatggcgggtggatcaaaagccagactgggaggccgctcccggtcctgcacataccgcccgtctggaggatgcacatgacctggttgccttcagcgcagtggcagaagcagtctcttcctacggcgctctgagcactagactttatgagacttttaacagggagatgtcacgggaggcaggcaacaatagcaggggtccgcgtccgggtcctgaaggatgctccgcagggagcgaggacctggatactctacaaactgcgctagccctggcacgtcatggtatgaaaccccctaactgcaactgcgacgggcctgaatgtcctgactatttggaatggctggaaggaaaaatcaaaagcgtggtgatggagggcggagaggaacgtccgagactgccgggaccccttcctcccggagaggctggcctgcccgctcccagtacaagaccattactatcaagtgaggtgccacagattagccctcaagagggcctgccactatcccagtctgctctgtccatcgctaaggagaaaaatatatctttacagaccgcaatagccattgaggccttaactcagttgtccagtgccctgccgcagccatcgcattcaacaccccaggcctcttgtccacttccggaagctctgtcaccccctgcgcctttcagatccccacagtcctatcttcgtgctccgagttggccggtggtgccaccggaagaacatagcagctttgcgcctgactctagcgcctttccaccagcaacgccaagaactgagtttcccgaagcctggggcaccgacaccccgcctgcaacacctcgcagcagctggccgatgcctcgcccttcacctgatcccatggccgagctggagcagctgctgggttctgcctctgattacatccaatccgtctttaagcgtcctgaggccctcccaactaaaccgaaggtgaaggtggaggccccaagcagcagccccgctcctgccccatctccagtgttgcaaagggaggctcccacaccctcatccgagccagatactcatcaaaaggcacagaccgcgctccagcaacacctccaccacaagaggtcactgttcctggagcaggtgcatgacacaagctttcccgctccgagtgaaccatcagctcctggatggtggccacctcctagctcccccgtaccacggctgccggaccggccaccaaaagaaaagaaaaaaaagttacccacccctgcaggagggccagttgggacggagaaagctgcccctggaattaagccttcagtccggaagcctatccagattaagaaatctagacctagggaagctcagcccctctttccgccagtgcggcagattgttctcgaagggttgagatcgccagcttcccaggaagtccaggctcatccgccagcaccgctgccggcatctcagggcagtgccgtccccctccctcctgagccctctctggcactgtttgccccttcgccaagccgggacagcctattgccccctacccaagagatgcggagccccagtccaatgacagcactgcagccaggaagcaccgggcctttaccacctgcggacgacaaactcgaggaactcataagacaatttgaggccgaattcggcgattctttcggactgccaggtccaccatctgtcccaatccaagacccagagaatcagcagacttgcctgccagctccagaaagtcccttcgccacccggagcccaaagcagataaaaatcgagagctctggcgctgtcactgtcctgagcaccacctgtttccactccgaggaagggggacaagaggcaacaccaactaaggctgaaaatcctttgacgcccaccttatccggatttctggagtccccactcaagtatctggatacccctaccaaatcactactggatacacccgcaaagagagctcaagcagaattccccacttgcgattgcgtggagcagatagtggaaaaggatgaaggtccatattatacgcacttggggtccggacccactgtggcatccattagagagctgatggaggagagatatggggagaaaggcaaagcgatccgcatcgagaaagtgatctacacgggcaaggaggggaaatcctctcgcggttgtccaatagccaaatgggtgattcgcagacacacactggaagagaaactcctgtgcttagtacggcatcgggctgggcatcattgtcagaatgctgtgatcgtcattttgatcctggcatgggaagggatccctaggtccctcggcgataccctgtaccaggaactgacagacacactcagaaaatacggtaacccgacgtcacgtagatgtgggctgaatgatgacaggacgtgcgcttgtcagggcaaagatcccaatacctgcggcgcatccttctcttttggatgctcttggtcgatgtacttcaacggctgcaaatatgcccgaagtaagaccccccgaaaattccggttggccggagacaaccccaaagaagaagaggtgctgaggaaatccttccaggatctagccaccgaggtggctccactgtataaacggcttgctcctcaggcttaccaaaaccaagtgaccaacgaagaaatagcgatcgactgcaggctgggattgaaggagggtagacctttcgcaggcgtaacagcttgcatggacttctgcgcccacgcccacaaagaccaacataatctgtataatgggtgtacagtggtgtgtacactgacaaaggaagacaatcgatgtgtagggaaaatccctgaggatgagcagctgcacgttctgcccctgtataaaatggcaaataccgatgagtttggaagtgaggaaaatcagaacgcaaaagttggcagcggggcaatccaagtgctgactgcttttccgagggaggtgaggcgcctgcccgaaccagcaaaatcctgtcgacagaggcagctcgaggccagaaaagctgcagcggagaaaaagaaaatccagaaggagaaactctcaacacctgagaagatcaagcaagaggcccttgagcttgccggaatcacatccgaccccggtctgagtttgaaaggtggactgagccagcagggactgaaaccctctttaaaggtggaaccacagaatcatttctccagcttcaaatacagtgggaatgccgtggtggagagctatagcgttctgggtaattgcagacccagcgatccatactccatgaattctgtatactcgtaccattcctattatgctcagccatccctgacatccgtgaatggctttcattctaaatacgcacttccgtccttcagctactacggatttccttcatcaaaccccgtgttccctagccagttccttgggccaggcgcttgggggcactctggcagctcaggatcttttgaaaagaaacctgacctgcatgctctccacaacagcctatccccagcgtatgggggagcagagttcgccgagctgccaagtcaggcagtccccaccgacgcacatcatcccacacctcatcatcagcaaccggcttatcctggcccaaaagagtatctgcttcctaaggcacctcttctgcactccgtgtcacgggacccgagcccattcgctcagtcttcaaactgctacaacaggagtatcaaacaggagccggtggatcccctaacccaggccgagccagtaccgcgagatgccggaaagatgggtaaaacaccactctcagaggtttcacagaatgggggtccgtcccatctgtggggccagtactccggcggaccctctatgtcacctaagaggaccaatggcgtgggaggaagctggggcgtattctcttctggggaatcgcctgctattgtccccgacaagctgtcctcatttggagcctcatgtctggcaccttcccatttcaccgacggacaatgggggttgttccccggtgaggggcagcaggccgcttcccattcaggagggcgactccgagggaagccctggtcgccttgtaaattcggtaattccaccagcgcactagcaggccctagcctcacagaaaaaccttgggcactgggagcaggagactttaattccgcgctcaaggggtcgccaggattccaggacaaactctggaatcccatgaaaggagaagaaggccgtattccagccgctggtgctagccagttagaccgggcttggcagagcttcggactgccgcttgggtcctctgaaaagttgtttggggctctgaaatcagaagaaaagctttgggatccgttttcactggaagagggacccgctgaagagccgccttcaaagggagccgttaaagaggaaaaaggaggcggtggtgctgaggaggaggaagaggagctgtggtccgatagtgagcacaattttctagacgaaaacatcggcggagtggccgttgcacctgcccacggcagcattctgatcgaatgtgccagaagagagcttcatgccacgaccccactgaagaagcccaatagatgccacccaacgcgaatctccttagttttctatcagcacaaaaatttaaatcagcctaaccacggtctcgccctttgggaggctaagatgaaacagctggcagaacgggctcgagccagacaggaagaggccgcacgtctggggctgggccagcaggaagccaaactttacgggaagaaacgcaaatgggggggaactgtggtggccgagccccagcagaaagagaaaaaaggggtggtgcctacccggcaggctctcgctgttcctacggacagcgcagtaactgtgtcctcttatgcatacaccaaagtgactggaccctatagccggtggatttag

SEQ ID NO: 60163 - DNA, 759 bp, Artificial Sequence
  Description of Artificial Sequence: Synthetic coding sequence
atgactcacgacaaaagctggcgcaggtgctccatctctggttccactaagtgtaggtgcggaagccggatagccggaccaaatgcgctcgggtctggagggagccggagtagctcctcaagcagtaggagtatcctctcgagcagtatcctatcctcttcaatcccttcgagtagttcttccagtagctcccccagctcgagtccgtcaagcagttcaccttcttcttcccactctagttcaagcccttctagtagttccagcacgagctctcctagctcatcctcttcctccagtagcagcagcccctctagtagcaactcatcttcgtctagtagcagcagctcccctagcagctctagcagttcgagttctagttccccgagtagctctagttctagtccctcttcatcctcctcttctagctcctctagccccagttcctctagctcctccccttcaagctcatcctctagctcctctagttcatcatcttccccttcctcaagtagcccctcgtccagcggttcctctccctcgtcctccaactcctctccaagttcatcatccagttctccctcttcatcatcctcttctccatcaccacgatctagttcaccatcttcaagcagcagctcgacatcttccccgtccagctcttccccctctagctccagccctagcagtagctgcccgtccgccgctcttggtagaaggcctcagagtcctcagtctagccattgcgccccttttccatag

SEQ ID NO: 60164 - DNA, 759 bp, Artificial Sequence
  Description of Artificial Sequence: Synthetic coding sequence
atgacacacgataagtcttggcggagatgcagcatatctggaagcactaaatgtcggtgcgggagccggatcgcaggtcccaatgccttgggcagtggtggcagcagatctagttcttcatctagccgaagcattctctcaagctcgatcctgtccagttctatcccatcctcgagttcctcttcaagttctccgtcatcaagtccctcaagctcctcaccttcctcctcacactcttcatccagtccttcttcttcaagcagtaccagctcccccagcagttcctcatccagctcctccagtagtccaagcagctccaattcttccagcagttcaagcagctctagcccttcatcctcctcttcctcctcctcatcgtctcccagctcatccagttctagtccgtcctcgagttcctcctccagttcatcttctccgagttcttcgtcctctagcccttcttcctcctcatcatcgtcctcctcttctagcagtagtccttcttcaagttctccttcttcttccggttcctccccttccagctccaattcatccccgtcaagctcttcttcctccccaagttccagtagctcttccccctctccaaggagtagttccccctcctcctcctctagctccaccagctctccaagttcatcgagtccttcttcctcctcccctagctcttcgtgcccttccgctgccctaggtcgccgacctcagtcacctcagtcttcacactgtgctccattcccttag

SEQ ID NO: 60165 - DNA, 759 bp, Artificial Sequence
  Description of Artificial Sequence: Synthetic coding sequence
atgacacatgacaagtcctggaggagatgttctatctcgggaagtaccaaatgcagatgcggcagccggatagcgggtcctaatgccctagggtcgggtggatcaaggtcctccagtagttcttcccgttcgatcctctcgtcttccatcctgtcctcgtctataccaagctcgtcctctagtagcagtagtccttcctcatcgccaagtagcagctccccaagcagtagccactcctcctctagcccttcctctagtagctcaaccagcagcccttcttcctcgagcagcagtagttcaagcagtccttcctcatcaaattcctccagttctagctcatcttcatcacccagtagcagttcttcaagctcctcttcgtccccatcctcgtcctcatctagccctagttcctctagcagttcaagctcttcttcccccagcagctcctcttctagtcctagttcatcctcttcatcctcctccagtagttcctcttcaccctcaagttcgtctccaagcagcagcggatcatcgcccagcagttcgaactcaagcccctcaagctcttcgtcatcccctagcagcagcagcagttccccctctccccgttcaagcagcccgtctagtagttcctcttcaacgagttcaccaagcagcagtagcccatcaagctctagccccagtagctcttgtcccagtgctgccctgggacgcaggccacagagcccacagtcctcacactgtgcaccattcccttag

SEQ ID NO: 60166 - DNA, 156 bp, Artificial Sequence
  Description of Artificial Sequence: Synthetic coding sequence
atgacacacgataaaagctggagaaggtgttctatttcggggagcacgaaatgtagatgtgggtcgcgcatagcaggcccaaatgcgctcgggtccggaggttctcgatcttcctccagctcctcccgttccatattgtcctcaagcattctttag

SEQ ID NO: 60167 - DNA, 66 bp, Artificial Sequence
  Description of Artificial Sequence: Synthetic coding sequence
atgacacacgataaatcatggcggagatgctctatatcagggtctactaaatgtaggtgcggatag

SEQ ID NO: 60168 - DNA, 228 bp, Artificial Sequence
  Description of Artificial Sequence: Synthetic coding sequence
atgactcacgataagagttggcgcaggtgttccatctccggatctactaagtgcaggtgcggatctcgaatagctggccctaatgctctggggtccgggggtagccgctccagcagttcctcaagcagaagtatcctgagtagtagtatcctgagttcttctatccctagctccagctccagcagcagctctccctccagttctccatcctcaagtagcccatcttag

SEQ ID NO: 60169 - DNA, 132 bp, Artificial Sequence
  Description of Artificial Sequence: Synthetic coding sequence
atgacccacgataaatcctggcgtcgctgcagtatatctggtagcacgaaatgcaggtgtggtagcagaatcgccggacctaatgctctgggctctggcggatctcgcagttcttcctcctcgagtagatag

SEQ ID NO: 60170 - DNA, 117 bp, Artificial Sequence
  Description of Artificial Sequence: Synthetic coding sequence
atgacccatgacaaaagctggaggagatgctctatctctggatccacgaagtgtcgttgtggatcccgtatcgctgggccaaatgccctgggttctggtggctcccggtctagctag

SEQ ID NO: 60171 - DNA, 39 bp, Artificial Sequence
  Description of Artificial Sequence: Synthetic coding sequence
atgacacacgataaaagttggcgcaggtgcagcatctag

SEQ ID NO: 60172 - DNA, 63 bp, Artificial Sequence
  Description of Artificial Sequence: Synthetic coding sequence
atgacccatgacaagtcatggcgtcgctgtagtataagcgggagtactaagtgcaggtgctag

SEQ ID NO: 60173 - DNA, 453 bp, Artificial Sequence
  Description of Artificial Sequence: Synthetic coding sequence
atgacccacgacaagtcttggcggaggtgctccatcagcggctctaccaagtgtcgatgcggctcccgcattgccggacccaatgctctggggtcggggggatcccgttcttcctcgtctagttcacgaagtatactctcctcttcaattttgtccagctcgattccctcttcgtcctcttcaagtagttcaccaagctcttcacctagctcaagctctccaagcagttctcacagcagttccagcccctcttcctcaagtagcactagttcgccatccagctccagcagctctagttcttcttcaccgtcctccagcaactcttcttctagctccagttcttccagtccaagtagcagcagctctagctcaagtagctctcctagctcctcatcttccagcccaagcagctcgtcgagttcttcctctagtagcccttcaagctcctcctag

SEQ ID NO: 60174 - DNA, 747 bp, Artificial Sequence
  Description of Artificial Sequence: Synthetic coding sequence
atgctccgaaataataagaccatcatcatcaaatattttctgaatcttataaatggtgctttcctggtcctaggcttactgttcatgggcttcggagcatggctgctcctggatcggaacaactttctgactgctttcgatgaaaacaaccactttatcgtgccgatttctcaaattctgattgggatgggttccagcactgtgctgttttgcctccttggttacatcgggatccataacgaaattcgttggttgctcatcgtttacgctgtgctgatcacatggactttcgccgtgcaggtagtgttgagcgcatttataattactaagaaagaggaggtgcagcaactgtggcacgacaagatagatttcgtgattagtgagtacggatccaaggacaagcccgaggacattacaaagtggaccatccttaatgccttacagaagacactgcagtgctgtgggcaacataattatacagactggataaagaacaaaaataaggagaacagcggccaggtgccctgcagctgcactaagtcaacccttcgcaagtggttttgcgatgaaccactgaatgcgacctacctcgaaggctgcgagaacaaaatttcagcctggtataacgtgaatgtcttgacactaatcggaattaatttcggcttgctgaccagcgaagtctttcaagttagtctgaccgtgtgcttttttaaaaatatcaagaacataatacacgcagagatgtag

SEQ ID NO: 60175 - DNA, 267 bp, Artificial Sequence
  Description of Artificial Sequence: Synthetic coding sequence
atgctgcgcaataacaaaaccatcattatcaaatattttctgaacttgatcaacggtgccttccttgttctcggactcttattcatggggtttggggcttggctcctcctagataggaacaacttcctgacagctttcgacgagaacaatcacttcattgtaccaatctcccagatcctgatcggtatggggagttctacagtcctcttctgcttgctcggatatataggcattcataacgagattcgctggctgcttattgtgtag

SEQ ID NO: 60176 - DNA, 7127 bp, Artificial Sequence
  Description of Artificial Sequence: Synthetic coding sequence
atgcatatcctattccagaaggggatgttgaagagagtcaaaaagttgctggatttgttagtgaagttcgacattaatttcaacctgaagaacaaggaaggaaaagatgctcgacacaggatcaaaaaaaatgactcacttttgcttgcatggaataaggcgttgatggaaaacaggcgacgcagcagacaagacagcgcagcccatctgggaaaattatccaaatccactgcaccaggacacacgtctcaactgaagtcccaaggcagcttcaagtccgtaccttgcggcgctactgcacgcaccctcccagagggctccgccgtgcctgactcctgggaaacactccccggaacacaggttacccggaaggagcctggcgctttgcgcccttgcagtctgagggattgtctgatgcaggatatcaccgtgcttatccagcaggtcgaggttgatccgagctttcctgaagactgtctccagtcctcggagccccttgaggctggcgctggaaaagagggtaagaaagacgataaacccacattaggcgcaggagcacccgactgctctgaggttggagagggtcacgcacaagtaggacttggcgcactacagctggtccctgacgacaataggggcaaagagggtaatgatgaccaggacgattggagcacacaggaaatcgaagcgtgcctccaagattttgacaacatgacttgggagatagaatgcacttcagagatgctgaagaagctgagttcgaaggttatgaccaaggtgatcaaaaagaagatcattctggcaatccagcagttaggtaacggcgaatggacacagggattgcagaagcgcttaaaacacctaaagggcagcattcaacttttcgaagcaaagctggataaaggggctaggatgctgtgggaactggccattgatttctcaccacggtgcagtgagaatcctgagaaaatcatagcgactgagcagaatacctgtgccatggaaaaatccgggaggatttatacagagattatcagaatttgggacatcgtgctggaccattgcaaactcgccgactctattaaggccatttgcaatgcctacaaccggggactgagttgcgtactgagaaaaaaactgaaggggattaataagggccaagtgtccgccaatatgaaaattcagaaacggatcccacgttgctacgtcgaggacacggaggccgagaaaggaagggaacacgtgaatcctgagtacttcccacctgcgtccgcagttgaaacagagtacaatatcatgaaattccactccttcagcacgaacatggccttcaatattctcaatgacaccacagccaccgttgaatatccttttagagtgggcgagctggaatacgctgtgatcgacctgaacccgaggcccctcgaacctatcatactcatcggccgaagcgggaccggtaagaccacatgttgcctttatcgcttgtggaagaagtttcatgtctattgggagaaggccgagcaggctggttctcccctcttggccaaacaggtgtggttaaaaaggcggctcgaggtagagcccggaaaagaaagccctgggggtgaagaggaagaagaggaggaagacgaggaggaagaagatagtattgaagtagagactgtggagtccatcgacgagcaggagtacgaggcctgtgccggtggggcaggagtggagccagcgggagacggccaggctgccgaagtatgcgcgccagagcacccccaccagctagaacacctgcaccagatctttgtgactaagaatcacgtgctgtgtcaggaggtccaacggaacttcatcgaactctccaaatccactaaggctacttcacactacaagccgttggaccctaatatccacaagctgcaggacttaagggacgagaattttcccttgtttgtaacttctaagcaactgctcctgctgctcgacgccagcctacctaagcccttttttttaaggaacgaagacggctcactgaagaggaccattattgggtggagcgcgcaggaagagagtactatccccagttggcaggaggatgaggaagaggccgaggtcgacggcgattactcagaggaggataaagccgtcgagatgagaactggagatagtgacccacgcgtgtatgtgacctttgaggtgtttaagaatgagatttggcctaagatgaccaaaggcaggacagcttacaatccagctctgatctggaaggagatcaaaagtttcttgaaggggtctttcgaagcattgtcatgtccccacggaagactgacagaggaggtgtacaagaagttggggcgtaaaaggtgtccaaatttcaaagaggatcgtagcgaaatttactccctgttttccttataccagcagatacggtctcagaaaggatacttcgacgaggaagacgtgctttacaacatatctcgacggctgagcaaactacgggttttgccatggagcattcacgaactttacggagatgagattcaagactttactcaagccgaattagccttgttgatgaaatgcatcaatgatcccaatagcatgtttttgaccggggacaccgcacagtcgattatgaagggtgtagcttttaggtttagcgacttgaggagcctgtttcattatgcctcccgaaacactatcgacaaacagtgtgctgtgaggaagcccaagaaaattcaccaactgtatcagaactatagatcccactctggtatcctgaacctggcaagtggagtggtagatcttctacagttttattttcccgagagctttgaccgactcccacgggattctggcctcttcgacggccctaagcccactgtgctggaatcgtgttctgtgtctgacctcgccatccttctccgcggtaacaaacggaaaacacagccaatagaattcggagctcaccaggtcattttggtggctaacgaaactgccaaggaaaaaattccagaagaactcgggctcgccctggtgctcacaatctatgaagctaaaggactcgaatttgacgatgtgctgctttacaacttttttacagatagtgaagcctacaaagaatggaagatcatttcatccttcacaccgacctcgactgacagtagggaagagaaccggccacttgtggaagtccccctagacaagcctggctctagtcagggacgatccctgatggtcaatcctgagatgtataagctgctaaatggcgaactgaaacagttgtacaccgccatcacgagggcccgtgttaacctgtggatcttcgacgagaacagggaaaaacgagcaccagcatttaaatacttcattaggagagatttcgtgcaggtggtcaagaccgacgagaacaaagactttgatgactcaatgttcgtcaagacctctactcccgctgaatggattgctcagggagactattacgccaagcaccaatgctggaaggtcgcagccaaatgttatcagaaaggaggcgcttttgaaaaagagaagctcgcacttgcccatgatacagctctatcaatgaagagcaagaaagtgtcccctaaagagaaacagctggaatacctggaactcgccaagacatatctggagtgcaaagagcctacactgtcactgaaatgtctgtcttacgccaaagaatttcaattatccgctcagctgtgtgaacgcttgggaaagatcagggacgcggcttatttctacaaacgtagccaatgctataaagatgcttttagatgttttgagcagattcaggaatttgatctcgccctgaagatgtactgccaggaagagctgtttgaagaagctgccatcgccgttgaaaaatacgaggagatgctgaagaccaagacactcccaatctctaagctgagctatagtgcctcccaattctatctggaagctgcagccaaatacctctcagccaataagatgaaagagatgatggcagtgttatcaaaattggatatagaagatcagctcgtgtttctcaagtctcggaagcggctggcagaggccgcagaccttttaaacagggagggacgtagagaggaagctgcccttctgatgaaacagcatggctgcctgctcgaagctgcacggcttactgccgataaagatttccaggccagctgtcttttgggtgcagccaggttgaacgtcgccagagactccgatatagaacatacgaaagacattttacgtgaggcccttgatatttgctaccagactggtcagcttagtggcattgccgaggcacactttttacagggggtcatcctcagggattttcagaagctgagggacgcttttttcaaatttgataccctgaatcacagcgcgggtgttgttgaagccttgtacgaggccgcaagccaatgcgaagctgaacctgagaagatactgggattggcacccggtggcctcgagattctattgtccttagtgcgcgcacttaaacgagtgaccaataatgctgagaaagagatggtgaaatcttgtttcgagttcttcgggatttcccaggtggatgcaaaatactgtcagattgcgcaaaatgatccaggtcccattctgaggatcatctttgatctggacctgaacctgcgagagaagaagaccaaagatcactttctgatcatgaccgaccaggtgaagctggctctcaacaaacaccttcttggcagactttgccaaatcactcgcagtctactgggaaaaacgtacagaggcgtgtgcatgcgattcatcgtcggactgaagtgcgaggacgagaactgcgaacatttccaccgcccactccgaagatgtgaggccaaatgcttggtgcaaagtaaaatgaaccttgtggcgatcaatggactccttctggaggccaaaaaagtctttcccaagattctggccgaagagctcaaagagatcgactacatcctatctacagacatgtatggcctgtgcaagagcatactcgatgtcctgtttcccaagcattttcaccagcgagtactgagcgaaaaccccatggcttgcaaggagattctgaaacccaactacaaatcttttcggttctacagattcgccttgaaagaatacatccacttcctttttgagaacgaaagcgcacgtaatagaagagaatctacagatctctggctgtcagcaatgcaggcttttctcttgtctagcaactatcccgaggagttcgaaaagcttctacaccaggaggaggacaactacaatagggaactgaaagccctcgagagtgagaaagacgagcggggacggggtcgaggttctcggataaaaggaatcgagggcaagttcggtatgctggccccaaatagagacgacgagaatatggataagactcacctgtgcttcatccgccttctcgaaaactgtatagaccagttctatgtgtatcgcaacccggaggactacaagcgactgttcttcagatttatgaatgttcttattaagcgatgtaaggagcccctcatcccatcgatcgggaataccgtggccctgctggaatttcagtttatacactgcggcgtcgtcctcgcgaggctttggaagaacgtaatcctgtgcctgcctaagagctatatcgccctgcttcactattgggaattcttgttctccaagaaggacaaagagctgggtgacgtcttctctatcatacaggaatacaagccaaaggacgttactcgggcaatccaggattttagatttcacctgagttaccttgccaaggtgttgtgcgggtatgagaatgttaactttaatgttctactagatgctttcagcgagatagattacgtggtctcaggggaggctgaacgaactctggtactgtgtttggttatgctggttaacgccgaggagattcttcagccatactgtaaacccctactgtatcggcattttagggagatagagtctaggcttcagctgatgagtatggattgtcccggtcaggtgcccgaacgcctcttgaaagtcgtaaaacgggtcctggtggcagtgaacgtcaagtctgtcgccgaagcactgcaagacctgttatttgagagagacgaagagtatcttatggattgtgactggcgctgggatcctgtccatacaaaaggaagcattgtacgcggattgtattatgaggaagtacggctcaatagattactctgtctcgaccccgtggattattttgctgagcctgagtgcgagttcggccaggatgagatggatgagctcgccctggaggatagggatcatgttctggctacaattttgtcacagaaacagcgtaaggcctctattcagaggaaactgcgcagagcctgccttgtcgttagtctatgcattagctggcgaaggcgtgtgggcacccagatggagcgagtgagggaggaagcacgagaacctcgggcaggcaacttcaagaaggccgatgtagacaggacacaatgcgatctgtgcggcgtcaagtttaccaggggacctgaaaactactttagccctagtaaggcgttcgaaggggctgcatcagaagttgccgtgctgtcccgtgcagagctcgaaagagaggagtgccaggaaagaaactccgaatcatacgaacagcatatccacctggaacaccaccagaggcagcaggtggcttaccagaaatacagtgagttctttcacgagaaggtcgacccagcaatcgatgagggcaagttggtcgtgcaggacattgagcagtctgtgtggattcatagccatgtcggctccaaggaacattcccacatgttgcagaaggtccaggaacacatcaagcgcgtctccgatatggttgaggacctttaccggcgaaaagcatgggccggagccgaagaagcaatgaccagattagtcaatatcctaatcttatccgtgcgggacgcgagagattggttaatgaagaccgaaacacgcttaaaaaaggaaggaattgtgcaggaggatgactacgaaaacgaggtcgaagatttcggcgaacttaggccccgtcgaaggtctcgaaagtgcggaaaacagagaaagtatta

SEQ ID NO: 60177 - DNA, 7127 bp, Artificial Sequence
  Description of Artificial Sequence: Synthetic coding sequence
atgcacatccttttccagaaggggatgcttaaacgggttaaaaagctgctggacctgcttgtgaaattcgatattaattttaatctgaagaacaaagaaggcaaagacgctcgccacaggatcaagaaaaacgattccctgctcctggcctggaataaggcactaatggagaaccgccgacgttctagacaagattcggccgctcacctgggtaaactgtccaaatcaacagctcctggccatacaagtcagctcaaatcccaggggtccttcaagagtgtgccctgcggggctaccgccaggactctgcctgagggatccgcggtgcctgactcctgggagacgctacccggtacccaggtaacccggaaagaaccaggcgcactgcgaccatgctcactccgggattgcttaatgcaagatattacagtgctcattcagcaggttgaggttgatcccagcttccctgaagattgtctgcaatcatcggagccattagaggccggtgctggaaaagaaggaaagaaggatgataaacccaccctgggggctggggctccggattgtagtgaggtcggagaagggcacgcacaggttggtttgggcgcactgcagttggtccccgatgacaatagaggcaaggaggggaatgatgatcaagatgattggagtacacaggagatcgaggcttgcttgcaggattttgataatatgacctgggagattgagtgtacctcagaaatgttgaagaaactcagctctaaggtgatgacaaaagtgatcaagaagaagattatccttgccatacagcagctggggaacggagaatggactcaggggttacagaagcgtctgaaacacttgaaggggtctatccagttattcgaagctaaactggacaaaggggctaggatgctgtgggagctggcaatcgattttagtcccaggtgctccgagaatcccgaaaagattatcgccaccgagcagaatacctgcgctatggaaaagagtggacggatatatacggagatcattcgtatttgggacatagtgctggatcactgcaaacttgcggattcaattaaggccatctgtaacgcctacaatcgtggactgagctgcgtcttgcgaaagaagctcaagggcattaacaaggggcaggtttccgccaacatgaagatccagaaacgtataccaagatgctatgttgaggacactgaagcggagaaaggccgagaacacgtgaatcctgagtattttccgcctgcgtccgccgttgagactgagtacaatatcatgaagtttcactcttttagcacaaacatggccttcaatatcctgaatgatacaacagcaactgtcgagtatccatttagagtgggcgaactcgaatatgcagtgattgatttgaacccacggcctcttgaaccgatcatccttatagggaggtccggaacaggtaagactacctgttgtctgtaccggctgtggaaaaaattccacgtttactgggagaaggccgagcaggcaggcagcccactgctggcaaagcaagtgtggctgaaacggagactcgaagtcgaacctgggaaggaaagcccgggaggagaggaggaagaggaggaagaggacgaggaagaggaagatagcatcgaagtggagaccgtcgagtccatcgacgagcaggagtacgaagcctgtgcagggggagcgggagtagaacccgcaggcgatggacaggccgctgaggtctgtgcccctgagcaccctcaccagctggagcatctgcaccaaatcttcgttactaagaatcacgtcttatgtcaggaggttcaacggaattttatagagctatctaagagcacaaaggcaacaagtcactacaagcccctggaccctaacatccataagctgcaggatctccgcgatgaaaacttccccttgttcgtgactagtaagcagctgttactcctgctggatgcctcattgcctaagcctttttttcttcggaacgaagatggcagtttgaagagaaccattattgggtggagcgcgcaagaggagtccaccataccctcttggcaagaagatgaagaagaggctgaagttgacggtgattacagtgaagaggataaggctgtggagatgaggaccggtgactccgatccaagagtatatgtgactttcgaggtctttaagaatgaaatctggcctaagatgaccaaaggaagaaccgcctataacccagcattgatctggaaagaaattaagagctttctgaagggaagttttgaggcgctttcatgtccccacggcaggctgaccgaggaagtgtacaaaaagctcgggagaaagagatgtccaaactttaaggaggatcggtcagagatctactccttattctccctgtaccagcaaatccggtcccagaaggggtattttgacgaagaggatgtcctttacaatatcagtcggaggctgtcgaagctcagggtcctcccgtggtccatacatgaactatatggggacgaaatccaggattttacccaagctgaactcgctcttctgatgaagtgcattaatgacccaaacagcatgttcttgaccggagacaccgctcaaagtattatgaaaggggttgcttttcgcttctccgacctgcggtcactcttccactacgcgagtaggaacacaattgacaaacaatgcgcagttcggaaacctaagaaaatccaccagctgtaccagaattaccggagccatagcggcatcctaaatctggcttccggggttgtcgatctgcttcagttctatttccctgaatccttcgaccgccttccgagagactccgggctgttcgacggtccaaaacccacggtgctggagtcatgcagtgtttccgatcttgcgattttgctcagagggaataaacgcaaaactcagccaatagaatttggtgcacaccaggtgatcttggtagccaatgaaacggccaaagagaagatcccggaggagcttgggctggccctggtcctgacgatttatgaagccaagggcctcgaattcgacgacgtgttgctttacaattttttcactgattccgaggcgtataaggaatggaagatcatcagctccttcaccccaacctctaccgactctagggaagaaaaccggcctctggttgaagtacccctcgacaagccgggatcatcccaaggtcgcagcctgatggtaaatccggagatgtacaaactcctcaatggggagctaaaacagctttacactgccattactcgggctagagtgaacctgtggatcttcgatgagaatcgtgagaaaagagcccctgccttcaagtattttatcaggagagattttgtgcaggttgtgaaaactgacgaaaacaaagattttgatgactctatgttcgtgaaaacatctactcctgccgaatggattgcacaaggggattattatgcaaagcaccagtgttggaaggttgccgctaagtgctatcaaaaggggggagcgttcgaaaaggaaaagctcgctttggcccacgataccgctctgtccatgaaaagtaagaaggtgtcgccaaaggaaaaacagttggaatacctcgagctggccaagacctacctggaatgtaaggagcccaccctgtcactaaagtgtctatcttatgccaaggagttccagctcagtgcgcagctctgtgagagactggggaaaatcagagatgccgcttacttctataaacgcagtcaatgctacaaagatgcctttagatgcttcgagcagattcaggagtttgacctagccctgaaaatgtactgtcaggaggaactgttcgaggaagccgcaatcgcagtggagaagtacgaagagatgttaaagacaaaaacgcttcctatctcaaaactcagctactccgcttcccagttttatctcgaggccgctgccaagtatctgtccgctaataagatgaaggagatgatggccgtcctctcgaagctggacatcgaggaccagctcgtctttttgaagtcacggaagagactcgctgaggccgctgatttattgaaccgcgaggggaggcgggaggaagcagcccttttaatgaaacagcatggttgtctcctggaggcggctcgcctcaccgcagataaggattttcaggcttcatgtctgctcggcgctgcgcgtttaaacgtagctagagactccgatattgaacatacaaaagacattctgagggaagcgcttgacatctgttatcagactggccaactttccggtatcgcggaagcccacttcctacaaggcgttatcctccgtgatttccaaaaacttcgggacgcattcttcaagttcgacactctgaaccacagtgcgggtgtggtcgaggcactttacgaagctgcatcccagtgcgaggccgaaccagagaaaattcttggactggcaccaggtggactagaaatcctcctgagcctcgtgagggccctgaagagagtaacaaataacgccgagaaggagatggtgaaaagctgctttgagtttttcggaatctcacaggtggatgcaaaatattgccagattgctcagaacgatcctggaccgatactacggattattttcgatctggatcttaatctgagagaaaagaaaacaaaggaccactttctcatcatgaccgaccaggtgaaactcgccctgaataaacatctcctcggcaggctgtgtcagatcacacgttctctcctgggcaagacttatcgtggagtttgcatgaggttcatcgtcggcctgaaatgcgaagacgaaaattgcgaacattttcatcgaccactcaggagatgtgaggccaaatgcctggtgcaaagcaagatgaatctcgttgccattaacggactactgttggaagcgaaaaaagtgtttcccaagatcctggctgaagaactgaaagagatcgactacatactgagcacagatatgtatggactttgcaagtccatcctggatgtcctgtttccaaagcatttccaccagcgtgtgctttcggaaaaccctatggcatgcaaggagattctcaagcctaactacaaatcatttcgattctacaggttcgccctgaaggaatacatccacttcctctttgagaacgagagtgccaggaatcggagggaatctaccgatttatggctcagcgcaatgcaagctttcctcctgagctctaattacccagaagagttcgagaagctgcttcatcaggaggaggacaattataaccgtgaactcaaggcccttgaatccgaaaaagatgagcgcggtagagggaggggaagtaggataaagggtatcgagggcaaatttggcatgctcgcccctaatcgagatgacgaaaatatggacaagacacatctgtgtttcatacgcctgctggagaactgtatcgatcaattttacgtgtacagaaatccagaggattacaagcgactctttttccgttttatgaacgtgcttatcaagcgctgcaaggagccactgattcccagcatagggaataccgtcgccttgctcgagtttcaattcatccattgtggagtggtgctagctcgactgtggaaaaacgtgattttgtgcctgccgaaatcatacatcgcacttctgcattactgggagttcttgttttcgaaaaaagacaaggagctcggcgacgtattcagcatcatccaagagtacaagcccaaagatgttaccagggctattcaagactttaggtttcacctaagctacctggccaaggtgttgtgcggatatgaaaacgtgaacttcaatgttctcctcgatgcattctccgaaattgactacgtagtatccggtgaggccgagcgcacactagtcctatgtttagtcatgctggtaaatgcagaggagatcctacagccctactgtaagccattgctctatcgccactttagggaaattgaatctagactgcaacttatgtccatggactgccctggccaagtgcctgagcgcttgctaaaggtcgtcaaacgtgtgttggttgctgttaatgtaaagtccgtggccgaggccctccaggatttgctctttgagcgggatgaagagtacctgatggattgtgactggcgctgggaccctgtgcacacaaaggggtccattgtgcgcggactatattatgaggaggttagactgaaccgcctcctgtgtctggacccagtggattatttcgccgagccagagtgcgagttcggtcaggacgaaatggatgaattggcactggaggatcgcgaccacgtacttgccaccatcctgtctcagaaacagcgcaaggccagcattcagcgcaagctgcgccgagcgtgtctcgtcgtgagtctttgcatttcctggaggcgtagggtggggacacagatggagagggtcagggaagaggcaagagagccacgcgctggaaattttaagaaggccgacgtcgataggacacaatgcgacctctgcggcgtgaagttcactcggggacccgaaaactatttctccccctcaaaagccttcgagggcgcagcaagtgaggtagccgtactcagccgcgctgagctggaaagagaagaatgccaggagcgcaactctgaatcgtatgaacaacatatccaccttgaacaccaccagagacagcaggtggcgtaccaaaaatactctgagttctttcacgagaaggtggatccggcaattgatgaaggcaaactggttgtgcaggacatagaacagtctgtgtggattcacagccacgtgggcagtaaagagcattctcacatgctgcaaaaggttcaggagcacatcaagcgcgtgtccgacatggtcgaggatctgtatcgacggaaagcatgggccggagcagaagaggcaatgactcggcttgtgaatatcttgatcctgtctgtgagggacgctagagattggctgatgaaaactgagacacggctcaagaaagaaggaatcgtccaagaggatgattacgaaaacgaggtcgaggactttggggaactgcgacccagaagaaggagccgaaagtgtggaaaacagcgcaaatacta

SEQ ID NO: 60178 - DNA, 8777 bp, Artificial Sequence
  Description of Artificial Sequence: Synthetic coding sequence
atgtgggaccccagagcagcacgcgtcccgcctagggacttggcggtgttactttgtaacaaatcaaacgctttttttagtcttgggaagtggaacgaggcattcgtcgcagccaaggagtgtctgcaatgggatcctacttatgtgaagggctactatcgcgctggctattccctcctgcggctgcatcagccatacgaggccgctcgtatgttttttgaaggactgagactggtgcaaagatcgcaagaccaagctcctgttgctgactttctggtaggcgtgtttacaacaatgtcgagcgacagcatcgtgcttcagtcttttttaccctgcttcgaccatatctttacaaccggttttcctacagaagtgtggcagtctgtcatcgagaagttagccaaaaaaggcttgtggcacagctttttgttacttagtgcaaaaaaggatcgcctgccgagaaacattcacgtccccgaactgtcattgaaaagccttttcgagaagtatgtgttcatagggctgtacgaaaagatggaacaggtgcctaagctggtgcagtggcttatttctatcggagcttctgtggaaactatcggcccataccccctgcacgctctgatgagactgtgcattcaggcaagggaaaatcatcttttccggtggttgatggaccataagcctgagtggaaaggcaggataaaccaaaaggacggtgatggctgcacagtgctgcatgtggtggccgcacatagcccaggatacctggtgaaaagacaaacagaagatgtgcagatgctgctacgattcggcgcagaccccaccctcctggaccgacagtcacggtccgtggtggatgtgttgaagagaaacaaaaactttaaggccatagaaaaaattaattctcacctcgagaagctggccacttgctccaaggatctctctggatttagcaatggagacggaccaacctcagagaacgacattttcaggaaagtgttggagcagctcgtcaaatatatgaactcaggcaaccgacttctccacaagaattttctgaagcaagaagtagtacagcgatttctcagattattatctaccctgcaagaaatcccgccagacttggtgtgtgatatcaatcaggactgcgcaactaccgtgttcaaatttttactcgaaaagcaaagatggcctgaggttctcctgctgctaacacgcaaggtgtccggggagccccctttaggcgattgtctcatcaaagattgcaacttcagtgatctggatatctgtacgattattcctcatctgagcacatgggaccagaggaaaaagcagcttcttggctgccttattgactctggcgcacttccagatggccttcaagaatctcaggagaggccagttgtaacatgcctgaagcacgaagacttcgagctggctttcctgttgttgactaagggggcagatcccagagcaattagtctgaccgaaggcgatacgcctctccacgctgcgctccacatcttccttgaaataaaggccgatatcggtttttcttttctaagtcatctcctcgaccttttctggtctaatccgaccgaattcgattatcttaaccctaatgtgcaggatagcaacggcaacacactgatgcacattctatttcaaaaaggcatgctcaagcgggtaaagaaattgctggacttgctcgttaagtttgacattaactttaatctcaagaataaagaggggaaagatgcccgacacaggatcaagaaaaacgactcgcttctcctcgcatggaacaaggccctcatggagaacagacgaagatcccggcaagactcagccgcacacctgggcaagctttctaaaagcactgcaccgggtcatactagccagctcaagtcccaaggatctttcaagtccgtgccttgcggcgctacagctcgtacgctccctgagggctcagctgtgcccgactcctgggaaactcttcccggaacccaagttacccgaaaggaaccgggtgcgctgcgcccttgttccctccgggactgcctgatgcaggacattaccgttctcatccagcaggttgaagtcgatccatctttccccgaagactgccttcaatcatcggagcccctcgaagctggagccggaaaagaaggcaagaaggatgacaaaccaaccttgggggcaggggcacctgactgctcggaagtgggcgaagggcatgcacaggttgggttaggagctctccaactcgtgcctgacgacaataggggcaaggaagggaacgacgaccaggatgactggagcactcaggaaattgaggcatgcctgcaggactttgataatatgacttgggaaattgagtgtacgagcgagatgctgaagaagctgtcatctaaggtgatgactaaagtgattaagaagaagatcatcttggcaatacagcagctcggtaatggtgagtggactcagggactgcaaaagaggcttaagcatttgaaggggtctatacaattattcgaggccaagctcgataaaggcgcaagaatgttgtgggaactggcgattgacttcagtcccagatgctctgaaaaccccgagaagattatcgctacggagcagaatacttgtgcgatggagaaaagcggccgtatttatactgagataatcaggatatgggatatagtgcttgaccactgcaagctggccgacagcatcaaagccatctgtaatgcatataaccgtggtctctcgtgtgtgttgcgcaagaaactgaagggcataaacaagggacaagtgtctgccaacatgaaaatccagaagcggattcccaggtgttacgtggaggatacagaagccgagaaagggagggagcacgtgaatccggaatacttccccccagcatccgcagtcgaaacagagtataatataatgaaatttcactccttctccactaatatggccttcaacatcctcaacgacaccacggcaaccgtcgaatacccctttcgggtgggcgagctggagtacgcagtcatagacctgaacccacgccctcttgaacccatcattcttattgggaggtccgggacggggaaaacaacttgttgtctttaccgcctttggaaaaaatttcacgtttactgggaaaaagccgaacaggctggttcgcccctcctcgccaagcaggtgtggctcaagcggagactggaagtagagcctggaaaagaaagccccggtggcgaagaggaagaggaagaggaagacgaggaagaagaagactccattgaagttgagaccgtggagtcgatagatgaacaagagtacgaagcctgtgccggaggcgcaggcgtcgagcctgctggagatggccaagcggcagaagtctgcgcccctgaacacccacatcaactagagcaccttcaccaaatctttgtgacgaaaaaccacgtcctctgccaggaggtacaacggaacttcatagagctcagtaaatctaccaaagcaacttctcactataaacctctggatcccaatattcacaaattgcaagacctgcgcgacgagaattttccattatttgtgaccagcaagcagctactgcttctcctagatgcctctctgcccaagcccttcttcctccggaacgaagacggatccctgaagcgaacgatcatcggctggagtgctcaggaggaatcaacaatcccctcttggcaagaagacgaagaggaagccgaggttgacggcgattacagcgaggaagacaaagcagtcgagatgaggaccggggattccgacccgagagtctatgttaccttcgaagtgtttaagaacgagatttggcccaaaatgacgaaaggaaggacggcgtataacccagcactaatctggaaagagatcaagagctttctgaaaggatcgtttgaggcactgtcttgtccccatgggaggctgacagaggaggtgtataaaaagcttggtaggaagcgctgccctaacttcaaggaggatagaagtgagatctattctcttttcagcctgtatcaacagattcgaagccagaaggggtacttcgacgaggaggacgtgttatataatatttcgcggaggcttagcaaattgagagtcttgccttggtcaattcacgagttgtacggcgatgagatacaggacttcacccaagctgagctggctctcttaatgaagtgcataaatgatcccaactctatgtttttgacaggggacacagcccagtctattatgaaaggggtggcgttcagattctccgatctgagatctttatttcactatgccagccgcaatacaattgacaaacagtgtgcagtaagaaagccaaagaaaatccatcagctttaccagaattatagaagtcacagtggtattttgaacttagcttctggagtggtggacctgctgcagttttatttcccagagtcctttgaccgactacctagagatagcggtctgtttgacggaccaaagccaaccgtcctggagtcctgttcagtgtccgatctcgcaatactgcttagaggcaacaagcggaagacccagcctatcgagttcggagctcaccaagtaattctggtggcgaatgagacggctaaagagaagataccagaggagctcggattggctctggttctgacgatctatgaagctaagggactagagttcgatgacgtgctactctataatttctttacagactctgaggcttacaaagaatggaagattatttcatcctttactcctacctctacagatagccgcgaggagaaccgaccacttgtggaggtgcctcttgacaaacccggatccagccaagggagaagcctaatggttaacccagaaatgtacaaactgttgaatggcgagcttaagcagttatacacagccatcacgagagctagagtgaacctctggatctttgatgaaaaccgagagaaaagagctccagcttttaaatacttcataagacgggatttcgtgcaagtggtcaagaccgacgaaaataaggacttcgacgacagtatgttcgtcaagacatccactcccgctgagtggattgctcagggggattactacgccaagcaccaatgttggaaggtagccgcaaaatgctaccagaaagggggtgccttcgaaaaagagaaactcgcgcttgcccatgacactgctctatccatgaaaagtaagaaggtgagtcctaaagagaagcagctggagtacttggaattagcgaaaacctatcttgaatgcaaagagcctacactgagccttaagtgccttagctacgccaaggagttccagttgagcgctcaactgtgcgaacgattgggtaaaattcgagacgccgcttatttttacaagagaagtcagtgttacaaggatgccttcaggtgcttcgaacagatacaagagttcgatctggcattaaaaatgtattgtcaggaggaattatttgaagaggccgcaatcgctgttgagaagtacgaagagatgctgaagaccaaaaccctgcccatctctaaactctcatactccgcctcccagttttatttggaagctgcggcaaagtatctttctgcaaataagatgaaggagatgatggccgtgctttcaaagctggatattgaggatcagctggtgtttctgaaaagccggaaaagactcgccgaggccgcagatcttctgaatcgagaaggacggcgagaggaggcagcactgctgatgaagcagcacggctgtcttctcgaagccgcacgcctgacagcagataaagattttcaggcaagttgcctgcttggagccgctcgactcaatgtcgcaagggacagcgacatcgaacacaccaaagacattctgagggaggcactggacatctgctaccagactgggcagcttagtgggattgccgaggctcattttcttcagggagtgatcctgcgggactttcaaaagctcagagacgccttttttaaatttgacacccttaaccactcagccggagttgttgaagcactctacgaagccgcttcgcagtgtgaagccgagccagaaaagattctgggcctggctcccggtggtctcgagattctactgtccctcgtaagggctctcaagcgggtcaccaataatgctgagaaggaaatggtgaagtcgtgttttgagttctttggcataagccaagttgacgctaaatattgccaaatcgcccagaacgaccctggaccaattttgcgaattatcttcgatctcgacctgaacctgcgcgaaaagaagaccaaagaccacttcctgataatgacagaccaagtgaagctcgctctcaataaacacctgcttgggaggttgtgccaaatcaccagaagtctgctgggaaaaacatacagaggagtctgcatgagattcatcgtgggcctgaagtgtgaagatgagaattgtgagcatttccacaggccccttcgccgttgcgaggctaaatgtctcgtgcaatccaaaatgaatttagtggcgatcaatgggctgcttctggaggctaaaaaggtgttccctaaaatcctcgctgaagagcttaaagaaatcgattacatactgtctaccgatatgtacgggttatgtaagagtatccttgacgtgctgtttccaaaacatttccaccagagagtactcagtgaaaaccccatggcctgtaaggagatccttaagccaaattacaaaagcttccggttttacagattcgccctcaaggagtacatacactttctctttgagaatgagtcggctcgaaatcggagagaatccaccgatctgtggctttccgccatgcaggcctttctgctgagctccaattaccccgaggaattcgagaagcttttacaccaggaggaggataactacaatcgcgaacttaaagccctcgagtctgagaaggatgagcgagggaggggacgtggatctaggatcaagggaattgaggggaagttcggaatgctggctccaaatcgagacgacgagaacatggacaagacgcacttatgttttatcaggcttctagaaaattgtatcgatcagttctatgtctacaggaatccagaagactataaacgcttgttcttccgttttatgaacgttctgattaaacgatgcaaggagccactcataccgtcgatcgggaataccgtggcactgcttgagtttcagttcatccactgcggtgtggtgctcgcaaggctgtggaagaacgtaatcctatgcctcccaaaatcctacattgcactgcttcattactgggaattcttgttttccaagaaagacaaagagctgggcgacgtgttcagtattatccaggaatataagcctaaagacgtgacacgggctatccaggatttccgcttccacttgtcttacctcgccaaggtattgtgcggctatgaaaacgtgaattttaacgtgttattggatgcgttctctgaaatcgattatgtggtgagcggagaggcagaaagaactctagtgttgtgtctagtaatgctggtcaatgcagaggagatcttgcagccatattgcaagcccctattgtatagacatttccgagagatcgagtccaggctgcagctgatgtcaatggactgcccaggacaggttccagagaggttgctgaaggtcgtcaaacgagtgctggtcgccgtcaatgtgaaatcagtggcggaagctctccaagacttgctgttcgagcgagatgaggagtatctcatggactgcgattggcggtgggaccctgtacatactaagggctcaattgtgagaggtctctactacgaggaggttagattgaataggctcctttgtctggaccctgtagattacttcgctgaaccggaatgcgagtttggacaggatgagatggatgaactggcccttgaggatagagaccatgtgctggcgaccatcctgagccagaagcagagaaaggcctctattcagcgcaaactccggagagcctgcctcgttgtctctctttgcatctcttggaggcggagggtcggaactcagatggagcgggttagagaggaggctcgcgaaccccgtgccggaaactttaaaaaggctgatgtggacaggacacagtgcgacctttgcggcgtgaagtttacacggggaccagaaaactatttttccccaagcaaggcctttgagggtgctgcctctgaggtcgctgtgctgagtcgcgcagagttggaacgggaggagtgtcaggagaggaactcggagtcctatgagcaacacattcatctcgagcaccatcagcgtcaacaggtcgcctatcagaagtacagcgaattctttcacgagaaagtggaccccgctatagacgaggggaagctggttgttcaggatatcgagcagagtgtgtggattcattcccacgtggggtccaaggagcactcccacatgctccagaaggtccaagagcatattaagagggtgtctgatatggtggaggacctttacaggaggaaggcctgggctggagcagaggaggcaatgacaaggctggtcaacattttgattctttcagtgagagacgcaagggattggctgatgaaaacagaaacgcgtcttaagaaagaaggcattgtccaggaagatgattacgagaatgaggttgaggattttggagagctcaggccacgtcggcgtagccggaaatgcggaaagcaacggaagtatta

SEQ ID NO: 60179 - DNA, 2583 bp, Artificial Sequence
  Description of Artificial Sequence: Synthetic coding sequence
atggcacctgctggctgctgttgttgttgctgcttttggggtggcgctgtcgctgcagccggagcagcacggagagttctcctgttgcttctgctcggtgttttgtccgccggtctaaggcccggagccctggctaccgaacactactctccactttcgctgctgaagcaagagctacagcacagacagcagcaggaagccccagctggtggtggagggtgctctccgcagtcaggtgactggggcgaccagtatagcgctgaatgcggcgaatcttcatttttaaactttcatgactccgactgcgaacccaaaggcagttccccctgcgactcgctcctttccttaaacacagaaaaaatcttaagtcaggctaaatcaatcgccgagcaaaaacggtttccatttgccacggacaacgatagtacgaacgaggagctggctattgcctatgtgttgattggcagcggactgtatgatgaggccattcggcacttctccactatgctgcaggaagagccagacttggtgtccgccatttacgggaggggcatcgcatatggtaaaaaaggtctgcacgacatcaaaaatgcagagctcgcattgtttgaactgtcacgcgtcatcacactcgaacctgacagacctgaggtgttcgaacaacgggcagaaatcctgtctccactgggaaggattaacgaagcagtcaacgatttaaccaaggctattcagctccagccatcagcgcgactctaccgccatagaggaacgctatattttatctctgaagactatgcgactgcccatgaagatttccagcagtcactagagttgaataagaaccagccaatcgcaatgctgtataaaggcttaactttctttcacagaggactgctgaaggaagcaattgagtcattcaaggaagccctgaaacagaaagtagattttattgacgcctataagagtctcggccaggcttacagagagttgggcaactttgaggctgctaccgaaagcttccagaaagccctcctccttaatcagaaccacgtccagactctccaactgcggggtatgatgctgtaccaccacggctctctccaggaggccctcaagaattttaagcggtgtctccagctcgaaccgtacaatgaagtgtgccaatacatgaaaggactcagccatgtcgccatgggacagttttacgaaggtatcaaggcccaaaccaaagtgatgctcaacgaccctctgccaggacagaaggcttcacccgaatatctgaaagtcaagtacctgagagagtatagccgataccttcatgcgcacctcgatacgcctctgaccgaatacaatattgacgtcgatctgccgggatctttcaaggatcattgggctaagaatctgccttttctcattgaggattacgaggagcagcctgggctgcaaccacacattaaagacgttctgcaccaaaattttgaaagttataaacccgaagtccaggagctcatctgtgttgcagacaggctgggcagcctgatgcaatatgaaacaccgggatttctcccaaacaaacgtattcatagggccatgggactggccgctctcgaggtgatgcaggctgtgcaaagaacgtggactaatagcaaagtccgcatgaatgggaagacgagattaatgcagtggagagacatgttcgatatcgccgtgaaatggagaaggatcgccgatcccgaccagccagtgctgtggttagaccagatgccggctagaagtctgagcagggggtttaacaaccacattaatctgattcgaggccaagtgattaatatgcggtaccttgagtactttgagaaaattctgcatttcatcaaggatcgcattctggtgtaccacggggctaataatccaaagggtctcctggaagtccgcgaggccctggaaaaggtccacaaagttgaagacttgttacccatcatgaagcaatttaacactaaaaccaaagatggatttacagtgaacaccaaagtgccgagcctgaaggatcagggcaaagagtatgacggttttaccataaccatcaccggggacaaagttgggaatatcctgttctctgtagaaacgcagaccacggaggaaagaacgcagctgtaccacgccgaaatcgatgcactgtataaggatttaactgccaagggcaaagtactcatcctctccagtgaatttggggaagccgatgctgtctgcaacttgatcctcagtctggtgtactatttttataatctgatgccactctcacgcggtagcagcgtgattgcatattctgtaattgtgggcgcacttatggcttccggtaaggaggtcgccggaaagattcccaagggaaaactcgtggattttgaggccatgacagccccaggctctgaggccttttctaaagtagcaaagagctggatgaatctaaagtccatatccccaagctataagacgctgcccagtgtgtcggagacctttcctaccctccgatcgatgatagaggtactgaatactgactcctcgccaagatgcctcaaaaagctttag

SEQ ID NO: 60180 - DNA, 2421 bp, Artificial Sequence
  Description of Artificial Sequence: Synthetic coding sequence
atggctcccgcaggctgctgttgctgctgctgtttttgggggggagctgtcgccgcagccggagccgcacggagggtgctgttactgctgctcctgggcgtgctaagcgctggcctacgtcccggagctctcgctacagaacactactcccccctgagtcttcttaaacaggagctgcagcaccgccaacaacaagaagctcccgcaggcggagggggttgttctccacagtcgggtgattggggcgaccaatacagcgccgagtgcggagaaagctccttcctgaattttcacgacagcgactgcgaaccaaaagggtccagcccttgcgacagcttactatctctgaacactgagaaaatactgagccaggcaaaaagtatagccgagcagaagagatttccgttcgctaccgataacgattccacaaatgaagagctggctatcgcgtacgtattaatcgggagtggcctgtatgatgaggcaatccgccatttcagtacaatgcttcaaattttgagccccctgggaaggattaatgaggctgtgaacgatcttaccaaagcaatccagcttcagcctagtgccagactctacagacacagaggaacattatacttcatttccgaggattacgctacggctcacgaggacttccagcagtctctggaattgaataaaaaccagcccatcgcaatgctgtacaaggggttaacctttttccaccgcggactactgaaagaggctatcgagtcattcaaggaagctctgaaacaaaaggtcgactttatcgatgcatacaaatctttgggccaggcctatcgcgagctgggcaattttgaggccgcaaccgagtcattccagaaggcgctactcctgaatcagaatcatgtgcagaccctgcaactccgcggtatgatgctctaccaccatgggtctctccaggaagctctgaagaatttcaagaggtgcttgcagcttgaaccctacaacgaagtttgtcagtacatgaagggcttgagccacgtggctatggggcagttctacgagggcattaaggctcagactaaagtaatgctgaatgacccattgcctgggcagaaggcctcccccgagtatctgaaggtcaagtacctgagggaatactcgcgatatctgcacgctcatcttgacacacccctgaccgagtacaatatcgacgttgatttaccgggtagttttaaagaccattgggcaaagaacctgccattccttattgaggactacgaagagcagcctgggctgcagcctcatattaaggacgttctacatcagaacttcgaatcttataaacccgaagtccaagaattaatatgtgtcgcagataggcttgggagcctcatgcagtatgagacccctggattcttgcccaacaagcggattcatcgcgcaatgggactagcggcactcgaggtgatgcaggcagtccagcggacatggactaatagcaaagtgcggatgaatggaaaaacccgtctaatgcagtggcgtgatatgtttgacattgccgtgaaatggcgtcgcattgccgacccagaccagcccgtcttgtggctggatcaaatgcccgcacgatccctatcacggggatttaacaaccacatcaatcttatccggggtcaggtgattaatatgagataccttgaatactttgagaagatcttacatttcatcaaggacaggattttggtgtaccacggcgctaacaatccaaaagggttactggaggtgcgggaggctttggaaaaagtgcacaaagttgaggatctcctccctattatgaagtttaataccaaaaccaaagacggcttcacggttaacacaaaagtgcctagcttgaaggaccagggaaaggaatatgatggtttcacaatcacaattacgggcgacaaagtgggcaatatcttatttagtgtggaaacgcaaacaacagaggaacggacacagctgtatcacgcggagatcgacgctttgtacaaggatctcacagccaaaggaaaggtcctgattctcagttctgagtttggtgaagctgacgctgtgtgcaacttgatcctttcccttgtgtactatttttacaacctcatgcccctctcccggggatcatccgtcatcgcctacagtgttatagtgggcgcactaatggcttctggcaaagaagtggccggaaagatccccaaagggaaactggttgactttgaggccatgactgcacctgggtccgaagcattttccaaagtcgccaagtcttggatgaacctgaaaagcatctccccctcgtataagaccctaccctcggtctctgagacgttcccaaccctcaggtccatgattgaagtccttaacacagactcctctcctcggtgtctgaagaaactgtag

SEQ ID NO: 60181 - DNA, 2424 bp, Artificial Sequence
  Description of Artificial Sequence: Synthetic coding sequence
atggcacccgctggatgttgttgttgttgttgcttttggggcggtgccgtcgctgctgcaggagctgcccgacgggtcttgctgctcctactgctgggggtgctctccgccggacttcggcctggagccctcgccactgaacattacagcccactgagtctgcttaagcaggaactgcagcatcgacagcagcaagaagccccagcgggaggagggggatgctcaccgcaatcgggtgattggggcgatcagtatagcgcagagtgtggtgaatcttcctttctgaactttcacgattctgactgcgaaccaaaaggctcgtcaccttgcgacagtctgctgtctctaaacacagagaaaatcctctctcaggcaaagtcaatcgccgagcagaaacgcttcccattcgctacagataatgattcgaccaacgaagaattagccatcgcttacgtcttgattggcagcggactgtatgacgaagcgatccgtcatttctcaactatgctgcaaatcctcagcccattaggcaggatcaacgaggccgtgaatgatctgaccaaggccatacagctgcagcccagtgcccgattgtataggcaccgcggtactctctactttatctccgaagactacgctaccgctcatgaggatttccagcaatctttggaactgaacaagaatcagcccatcgccatgttgtataagggcctaacatttttccatagaggcctactgaaggaggccattgagtcattcaaggaggccctaaaacagaaggtcgacttcatcgacgcctacaagtctcttgggcaggcctaccgtgaactggggaatttcgaggccgctaccgagtcgtttcagaaagctttgctcctgaatcagaatcatgttcagactctccagttgcggggaatgatgctttaccatcacggctctctgcaggaagctctgaagaacttcaagcgctgcttacagcttgaaccttataacgaggtctgtcagtatatgaaagggctcagtcacgtggctatgggccagttttacgagggaataaaggcccagacaaaagtgatgctgaacgacccactgcccggtcagaaagcctctccggagtatcttaaggtgaagtatctgagagagtatagtagataccttcacgcccatttggatactccacttaccgaatataacatagatgtggatttacccggatcctttaaggaccactgggccaaaaacctgcctttcctgatagaagactacgaggaacagcccggactacaaccacacatcaaagatgtgctgcaccagaactttgaaagctataaaccagaggtgcaggagttgatctgcgtggccgatcgtctcggcagtctgatgcagtacgaaacccccggattcctgccaaacaagcgaattcatcgcgcaatgggcctggcagctctggaggtgatgcaggcagtgcagcggacctggaccaacagcaaagtccgcatgaatggcaagacaaggcttatgcaatggcgggacatgtttgatatagcagttaagtggagacggattgccgatccagaccagccggtgttgtggctcgatcagatgcccgctcggtccttgtcacggggttttaataatcacatcaatctcattcgtggccaggtgatcaatatgcggtatttggagtattttgaaaaaattctgcacttcataaaagacaggatcctggtctaccatggagcaaacaatcctaaagggctccttgaggtcagggaagcactggaaaaggtacacaaagtggaagatcttctgcctatcatgaagcagtttaacacgaaaactaaagatggcttcacagttaatactaaagtgccatccctgaaggatcaaggaaaggaatatgatggatttactatcaccattacaggcgacaaggtgggaaacatcctcttttcagtggagacgcagacgacggaggaacgcacacaactctaccacgccgagatagatgcgctgtacaaggacctaaccgccaaaggaaaggtgcttatcttgagctcggaatttggtgaagctgacgctgtctgtaatctgatcctctcactggtgtactatttttacaatctcatgcccctcagtagaggttcctccgtcatagcctatagcgttatagttggggctttaatggcctctggaaaggaggtcgccggaaaaatccctaaaggcaagctcgtcgattttgaagcgatgaccgcccctggctccgaagccttcagcaaagtcgccaaatcctggatgaacctgaaatctattagcccttcttataaaacgcttcccagcgtgtctgagaccttccccactctgaggagtatgattgaagtcttgaacacggactctagcccgcgttgcttgaaaaaactctag

SEQ ID NO: 60182 - DNA, 2313 bp, Artificial Sequence
  Description of Artificial Sequence: Synthetic coding sequence
atggacagagatctgctccggcagtctcttaactgccatggaagctccttgttgagtttgctgcggtccgagcagcaggacaatcctcactttagatctctgctcggtagtgctgccgagccagcccgaggccctccgcctcagcatcccctccagggacgcaaggagaagagagtggacaacatcgagatacaaaaattcattagcaagaaggcagacctgctcttcgccttgagctggaagtccgacgctcctgcaactagcgaaatcaatgaggatagtgaagaccattacgcaattatgcccccacttgagcagtttatggagatccccagcatggacagacgcgaactgttttttcgagacatcgaaaggggtgacatcgtgattggtagaattagcagtattagggagtttgggttcttcatggttttgatatgcctaggaagtggcattatgcgggatattgcacatctggaaattactgccctgtgcccacttcgggacgtgccgagccattcaaatcatggagacccactgagttactaccagacgggcgatataatccgggctgggattaaagacattgaccgatatcacgagaaactcgctgtctcgctttactccagttcccttccacctcacctgtctgggatcaagctgggggtcataagcagcgaggaactgcccttatactacagacggagtgttgagctaaacagcaatagcttggaaagctacgagaacgtgatgcaatcttctttgggttttgttaacccaggcgttgtggagtttctgctggagaaactgggtatcgacgaatcgaatccgccttctctgatgcggggactccagtccaagaacttcagcgaggatgacttcgcaagtgctctaagaaaaaaacagtctgctagttgggcattaaagtgcgtgaagatcggcgttgactacttcaaggttggcaggcacgttgatgccatgaatgagtataataaggcgctggaaatcgataagcagaatgtggaggcactagtggctagaggcgctctttacgcgacaaaaggatccctcaataaggccatagaagattttgaactggcattagaaaattgtccgacacacaggaatgcaaggaagtatctttgtcaaactctagtagagcgcggaggtcagcttgaagaggaggagaagttcctgaacgcagagagctattacaagaaggcccttgctctagacgagacctttaaggatgcagaggacgcactccaaaagttgcacaagtatatgcaaaaaagtcttgaactcagagagaagcaggccgaaaaggaggagaagcagaagacaaaaaagatcgagacgagcgctgagaagcttagaaagttgctaaaagaagagaagaggctgaaaaagaaaagacggaaatccacttcatctagtagcgttagcagtgccgatgaaagcgtctcgagttcatccagtagttctagttccggacataaaaggcacaagaagcacaagcgtaatcgcagtgaaagctcaaggtctagcaggcgacactcgtcccgagcatcctcgaatcagatagatcagaaccggaaggacgagtgttaccctgtgcccgcaaatacctctgcctctttcctgaaccacaagcaggaagtggagaaactgcttgggaaacaggataggctgcaatacgaaaagacccagataaaagagaaggacagatgccctctaagtagcagcagcctggaaatccccgacgattttggtgggaggtctgaggatccccgtgatttctacaactcttataaaactcaagccggatcctcaaagactgagaagccttacaaatcagagagacacttcagcagccgcagaaactcatcggactccttttgtcgtaacagcgaggacaagatttacgggtacaggcggttcgagaaggatattgagggcagaaaagagcactacaggcggtgggaacccggatctgtccggcacagtacttctcccgcttcctcagaatactcctggaaaagtgtggagaaatacaaaaaatacgcccactccggctccagggatttttctaggcacgagcagcggtatcggcttaacacgaatcaaggagagtatgagcgcgaggacaactatggtgaggatataaaaaccgaagtgcccgaggaagacgcccttagttccaaggaacattcggaaagttccgtgaaaaaaaacctgccccagaatttgcttaatatcttcaatcaaatcgccgagttcgaaaaggagaaaggaaacaaatcaaaaaactag

SEQ ID NO: 60183 - DNA, 1962 bp, Artificial Sequence
  Description of Artificial Sequence: Synthetic coding sequence
atggatcgtgacctgcttcgtcaaagccttaattgccacggaagcagtctgcttagtctgctgcgctccgaacaacaggacaaccctcacttccgatcccttttgggcagtgccgcagaacccgcacggggaccaccgcctcagcaccccttgcaggggcgaaaagaaaagagggtggacaatatagagatacagaaatttatctccaaaaaggctgacctactgttcgcactcagctggaagtcagatgccccagcgacttccgagatcaacgaggattctgaggaccactacgcaattatgcctcccctggaacagtttatggaaataccaagcatggacaggcgagaactgttcttccgggatatcgagcggggagatattgtgatcggacgtatcagcagtattcgtgaattcgggtttttcatggtgcttatttgcttggggtccgggattatgagggacattgcccatctcgagatcactgcgctgtgtccactgcgagacgtgccaagccactctaatcacggcgaccctctgagctactatcagactggcgatatcataagggcgggtattaaagatattgacagataccacgaaaagctggccgtgtccctttacagttccagtctccctccccacctgagcggaattaaacttggtgtcatatcatcagaagaactgcctctgtactatcgccgatcagtcgagttgaacagcaatagcttggagagttacgaaaatgttatgcagtcttcactgggctttgtaaaccccggagtggtggaatttttgttagagaagctcggtattgacgaatctaaccccccatccctcatgcgtggtctccagtctaagaatttctccgaggacgatttcgcctcggcgctgagaaagaagcaatcagccagctgggctctaaagtgcgttaagatcggggtggactacttcaaggtcggcagacatgtagatgccatgaatgaatataacaaggccctggaaattgataagcagaatgtggaggccctcgtcgcgcgaggagccctgtacgccacaaaaggctccctgaataaggcgatcgaggatttcgagttagcactggagaattgtcccacccatcgcaacgcgaggaaatacctgtgccagacattagtggagagaggaggacagctggaagaagaggagaaattcttgaacgcagagagttactacaaaaaagctttggcactggacgaaacattcaaggacgcagaagacgccctgcagaagttgcataagtacatgcaaaagagcctggagttgcgcgaaaaacaggcagagaaggaggagaagcagaaaacaaaaaagatcgagacgagcgctgagaagcttcggaagctcctgaaagaggagaagaggctgaagaagaaaagacggaaatcaacctccagttccagcgttagcagcgccgacgagagcgtgagcagcagtagtagctcgagctcaagcggacataaacgtcataagaagcacaaaaggaaccgctcagagagttctcgcagttcacggagacattcctcgagggcctcaagcaaccagatagatcaaaatcgcaaagatgaatgctacccggttcctgccaacacctccgccagctttctaaatcataagcaggaagtggaaaaactgttaggaaagcaggaccgacttcagtacgagaagacccagatcaaagaaaaggaccgatgccctctctcatcttccagcctggagatcccggatgattttggcgtatatagttacctgttcaaaaagcttaccatcaagcagcctcaggccggaccctcgggcgatataccagaagagggaattgtgatcattgacgatagttctatccacgtgactgatcctgaggacttgcaggtggggcaagatatggaagtagaagatagcgggattgatgaccccgatcatggttag

SEQ ID NO: 60184 - DNA, 1320 bp, Artificial Sequence
  Description of Artificial Sequence: Synthetic coding sequence
atggatagagacttgctgagacagagcctgaattgccatggaagcagcctgcttagcctattgcgttccgaacaacaagacaacccacacttccgtagcctcctcggatccgccgctgagccggctaggggaccccctccccagcacccccttcagggcaggaaagaaaagcgggtcgataacatcgagattcagaaatttatcagcaaaaaggctgatcttctctttgccctaagctggaaaagtgacgccccagccactagcgaaattaatgaggactcggaggatcactatgctatcatgcctccactggaacagttcatggaaataccatcaatggatcgcagggaactcttttttcgggacatcgagcggggagacatcgtgataggtagaatttcatcaattcgcgaattcggattctttatggtcttgatttgtctggggtcgggtatcatgagggatatcgctcacttggagatcacagctctctgccctcttcgggatgtaccatcacatagcaaccacggcgaccctctctcatactatcagacaggggatatcatcagggccggtatcaaggacattgaccgctaccacgagaagctggccgtctcgctgtactcatcctctctcccccctcacctgtctggaatcaagctgggcgtgattagcagtgaagagctacctctctattaccggagaagtgtggaacttaacagtaactcactggagtcttacgagaacgtgatgcaatccagtctgggcttcgtgaatccaggagtggtggaatttctgctggagaaactgggtattgatgaatccaatccaccttcgctcatgagaggtctccagtccaagaatttctcagaggatgacttcgcctcagctctccgcaaaaagcaaagtgcaagctgggcactcaagtgtgtgaaaatcggcgtcgactacttcaaagtcggcaggcacgtggacgccatgaacgagtacaataaggcattggagatcgacaagcagaacgtggaggccctagtagcccgaggcgcactatatgcaaccaaaggcagcctgaataaggcgatcgaggactttgaactggcgctcgagaactgtcctacacatcgcaatgcgagaaaatacctatgccagacgctggtggaaagggggggacagttggaagaggaggaaaaatttctcaatgccgagtcatattacaagaaagcgcttgccctcgacgagacgtttaaagatgcagaagatgccctgcagaagcttcacaaatacatgcaagtcattccatatttcctgctggagatctag

SEQ ID NO: 60185 - DNA, 1125 bp, Artificial Sequence
  Description of Artificial Sequence: Synthetic coding sequence
atggcctggttggattcccgaaacacaagcctgccctcactcgggttctgcctgctgcttctgcctctacatcccgctccactgcttccaaccaccccaacccccgcattgtgtccagggctggtccactcacaggggcacccgtcggcctgcccacatttccctcactcatatagcagaggacagcagtgcctagagcaggctgactgggaaacagctgtgttgctcttctcgcgagccttacatcttgatccccagttgggccagtgtctgtttgagcagtgcgccttcttagacgcactgaacgtttttagccacgcagctgaactgcaacctgagaagccttgcttccggtacagatgcatggcgtgtttgctggctttgaagcaacaccaggcttgcctgaccttgataactaacgaactgaaacaggacacaaccaacgcagacgtctacatcttccgggcacgcctctataactttctccagaaacctcacctgtgctaccgcgacctgcattcagcactcctactcaatcctaagcatccccaggctcgtatgctgctgcagaagatggtggcccaggcacaacaggcccgtcaggatgcaggtattctggccgtccagggtaagctggccaggacagccgctgaccagccttgccaccgggagcagccatccggaccccagagcttgccactgccgggtcatcacgtccccacagcacctggggtgagatggggctcaggcggtctgcccgaaggggcaggtcatggggaccgagggcctggcggacacggcgcagccggaacggcacccgctgttgccgacctgcagcggctgtgtcgcgctttgctccaggcaggcaggctcccagggggacgagccgcagccgaacaaggccctccaggcagagctgcaggtgagagaacgctccatcagcctagacggcaattccagaaggccgagaatcacttttccactgctattcgccacaaccctcagaaagcacagtattatttgtatcgcgcaaagtccaggcaattactacagaacatttttggtgcacgtcaagatgtcgcaacagtcttgctactaaatcctaaacagcctaaggatgcctag

SEQ ID NO: 60186 - DNA, 1230 bp, Artificial Sequence
  Description of Artificial Sequence: Synthetic coding sequence
atgcatggtttgtcgcccggaccccaggctgctagcggcttgccacacgctcaccaccagagggccgaggcaggccaccaccagcgtcgatgccttcatctgccaggccagactctccagctcagcccggaagcaccacctctgctgcccggtccggctcagagacttgccgtagagtcccaggcacccgctgggcaagacgcagcccctgaggacggtgggccaggaccggcaggcgctccacgttgcggcgaccccggatgcgcaggtcaggcagccgctaggacagcggcagatcagccttgccacagggaacaaccttccggccctcaatccctgcctctgcccggacaccatgtcccgactgccccaggcgttagatgggggtcaggtggccttcctgagggcgcagggcacggtgatcggggtcccggtggacacggtgcggcaggcaccgcaccagcagtggctgacctccagcgtttgtgtcgggctctgctccaagcaggaaggcttcctggcggacgcgctgccgcagagcaaggtcctccagggagagcagccggtgaacgaaccctgcatcagccgagaaggcaattccagaaggcggaaaaccatttctctaccgcgatccgacacaacccacagaaagcacagtattatctctatcgcgctaagtccagacaacttctgcagaatatctttggggctcggcaggacgtcgctacggtgttgttactaaacccaaagcaaccaaaactttccctgttaatgaccaatctctttcccggtatgagcgttgaagaggtcttgtccacacaaattgcgcacttggctcgcctacaactcgaacagatggttgaaggtagcttgcaagcagggagtcctcaaggtatcgtaggaatgttgaagaggcatgaactggaacgtcagaaggccctggcccttcaacactcttggaaacagggggagccactgattgccacatctgaggagctgaaggccactcctgaaattcctcaagtgaaacccggatccagcgagggtgaagccgaagctcctgaggaggaagaagaaaaggagaaggagaaaaaggaggtttccggcgtccaagctcgcgctagatccccatggggattgggccactctgtcccccaacctagagcggaaggctgccggcctgtggagtctgggtttcaggcctggctctgtaccccctctgccgtttag

SEQ ID NO: 60187 - DNA, 2622 bp, Artificial Sequence
  Description of Artificial Sequence: Synthetic coding sequence
atgacagattccgatgaggatgcgctcaaggttgatcagggtccatctcgtgacatccccaagccatgggttattcccgctccgaaaggtatccttcagcacatatttgggacttctcacgtcttccagtccatatgcgacgttaaaccgaaggttacaggcctcacagtgcccttgaaagtacgagagtattattctcgaggccagcagtgtttagagcaggcagattgggagaccgccgtgctgctctttagccgagcactgcatctggatccacagctagtggacttctacgcattgcgcgctgaagcgtacctgcagttatgtgattttagttcagccgctcagaaccttcgcagggcttattcgctgcaacaggataattgcaagcacctggagcgcttgaccttcgtcctttacctgcagggacaatgtctgttcgagcagtgcgcttttttggacgctttgaatgtattctcacacgcagccgagctgcaacccgaaaagccctgtttccggtatagatgtatggcctgcctgcttgctctgaaacagcatcaagcctgtctaacgctcatcactaacgaactgaagcaggatacaactaatgcagatgtgtacattttcagggctcgattatataactttctgcagaagccccatctctgctacagagacctgcacagtgctcttctgcttaatccaaagcaccctcaggccaggatgctcctgcagaagatggtagctcaggcccaacaggcaagacaggatgcaggtattctggcggttcaggggaaactgcaacatgcactgcagaggatcaatcgagccatcgaaaataatcccctggatccctcccttttcctttttagaggtacgatgtaccggagactccaggaatttgacggcgctgttgaggattttctcaaggttctcgacatggtcaccgaggaccaggaagacatggtcaggcaggcccagcggcaactgttgttgacttataacgacttcgcagtgcattgctaccgtcaaggcgcttaccaggagggggtgctgctgctgaacaaggccctgcgcgatgaacagcaggagaagggcctatatatcaatcgaggggactgctttttccagctgggtaatctggctttcgccgaagccgattatcagcaggctctggctctgtccccccaagatgaaggagccaatactcggatgggtttgttgcaggaaaaaatgggattctgtgagcagagacgtaagcagttccagaaggcggagaaccacttttccaccgccatacggcataatccacagaaggcccagtattacctgtaccgggctaaatcccgccagctgctccaaaatatattcggtgcaagacaggatgtggccactgttttactcttgaaccccaagcagccgaaactgtccctgcttatgactaatctattccccggaatgtccgtcgaagaagtgctgtctacacagatcgcccacctcgctcgcttacaattagaacaaatggtggaagggtcacttcaagcagggtcacctcaggggattgtcggcatgctaaaacgtcacgagcttgaacgacaaaaggccttagctctgcagcacagctggaaacaaggcgaacctctgatcgctactagcgaagaactgaaagctacgccagaaataccacaggtaaaacctggatcctctgaaggcgaggctgaggctccagaagaagaggaggaaaaagagaaggaaaaaaaggaagagaagaaatcagaactcattcctagcaaagtggcatctctgtcagattcatatctcgatcagacaagtagcgcgtcctcaatgtccttcagaaccactggcaccagcgaaactgagatgagtgcgatttgccaggagtacagatccactagtgctaccgccgtgacattttccgattcttctctactcaaaacacaatcttcggactcgggcaacaatagagaggcgttgtcccacggacccaggaaaatcaaagcaacccagggccaacgccagagtctgagcaagaccgaacccacccagagccagaggcgtaattcctctaagaccaaagccacgatccacaagcgcaactcatctaaaaccaaagcgacacagtcacagcgccgaaacagctcaaagacaagggctacgcaaggacagggccaaagttcttctaagacagaggccactcagggtcaacggcagtcttctagtgagatagaagctacccagggtcccagacaggaaccttccaagacaaagacaacgagaagccccaggcagagaccgagaaaagttaaggccgctcgcggtagatcgtggcggccttctaaagtggatgctacccagggccgaagccgcggactgctccggagtagcactaaaacagaagcattctatgatagcaattggtcattgtcgaagaccgagtatgcacagggtcaggggcagcggtccagtaaagccgagggcgctcaaggcaaaagccagggcatgtcaagcacttcctcaaaggctgaaagtacttggggcccttctcccagcctgagcaagactgaagttgatcaggacctcacatattacgaggccgtctag

SEQ ID NO: 60188 - DNA, 726 bp, Artificial Sequence
  Description of Artificial Sequence: Synthetic coding sequence
atggcgtgcttgctcgcactgaaacagcatcaggcctgcctgactctcattaccaacgaactgaaacaagacactactaacgcagacgtctatattttccgcgcaagactgtacaatttcctgcagaagcctcacctgtgttacagggatttacacagcgcactcctgttaaatccaaagcatccacaggctcgaatgctgctccagaaaatggttgcacaggcccaacaggccagacaggacgccggaatcttggccgtccaagggaaactgcagcacgccctccagcgcattaatcgcgctatcgaaaacaatccgttagatccctcactcttcctattccgtggcacaatgtatcgcagactccaggaatttgatggcgctgtggaggatttccttaaggtactggacatggtgacggaggaccaggaagacatggtgaggcaagcccagcgccagctgcttcttacatataatgactttgccgtgcactgctaccgacagggagcttatcaggagggcgtgctgcttctgaataaagccctgagagacgagcagcaggagaagggactgtacataaaccggggtggagcccagcggccaggccactggggaggcggagtgagaggctccctcgcaattagcaaggcaccaaccgggcatttgcggcctctcggtggacgcaggaagggcgagcggaaagaagcgcgagaggaagaaatgtag

SEQ ID NO: 60189 - DNA, 3426 bp, Artificial Sequence
  Description of Artificial Sequence: Synthetic coding sequence
atggctgccgctgtcggtgttaggggccgttacgaattgccaccttgtagtgggccaggatggctcttgtctctcagcgcgctactctcagtggctgctaggggcgcttttgcaaccactcattgggtggtgacagaagacggtaaaatccagcagcaagtggacagcccaatgaaccttaagcatccccatgatttggttatacttatgcggcaggaggctacagtcaactatctgaaagagttagagaagcagttagtcgcgcagaagatccatatcgaagagaatgaagaccgggacacaggcttggagcagcgtcacaacaaggaggatcccgattgtatcaaggccaaggttcctcttggggacctagacctttacgatggaacctacatcactctcgaaagcaaggacatctcacccgaggactacattgacaccgagtcaccggtcccacctgaccctgaacaaccagactgtacgaagatcttagagctcccttactcaatccacgcatttcaacacctacgcggagtccaggaacgagtgaatcttagtgcccctttgctgccaaaagaggaccctatctttacttatctatcgaaacgcctgggacgcagcatcgacgacattgggcacctcattcacgaagggcttcagaagaacacaagcagttgggtcctgtacaacatggccagcttttattggcgtatcaagaacgaaccatatcaggtggttgaatgtgccatgcgggctctgcacttctcatcacgccacaataaagacatcgccctggtcaatctagccaacgtgcttcatcgggcacacttctccgcagacgcagccgtcgtggtgcacgccgctctggatgatagtgattttttcactagctattataccctgggcaacatttacgcaatgctgggcgaatataaccactccgtcctatgctacgaccacgccctgcaggctagacccggattcgaacaagccatcaaacggaaacatgcggtgttgtgtcaacagaagctcgagcagaaattggaagctcagcacagaagtctacagcgtactctcaatgagctgaaggaatatcagaaacaacacgaccattacctaagacagcaagaaattctcgagaagcacaagctgatccaggaggagcagatactcaggaatattatacatgagacccagatggctaaagaggcccagttgggtaatcatcagatctgccgcctggtcaaccaacagcattcactgcactgtcagtgggaccaacctgtgcgttaccatcgcggagacatttttgaaaatgtggactacgtgcagtttggagaggatagctctacttcttccatgatgtcagtgaactttgatgttcaatcaaatcaaagtgacatcaatgattcagtaaagtcaagccccgtggcccactccatcttgtggatttggggacgggatagtgatgcataccgcgataaacaacacatactgtggcccaagcgggctgactgtaccgagagctatccaagagtacctgtcggcggtgaactcccaacctatttcctgcctccagaaaacaaggggctgcgtatccatgagctatcatcagacgactattctaccgaagaagaggcccagacacccgactgctcaataaccgacttccgtaaatcacacacacttagctatttggtaaaggaactggaagtgaggatggacctgaaagccaagatgcctgacgatcacgctcggaaaattctgctttccaggatcaacaactacaccattcccgaagaagaaataggttcctttctgtttcacgcaattaataaacctaacgcccctatttggcttattctaaacgaagcagggctgtattggagagctgtcggcaacagtaccttcgctatcgcctgtctacaaagggccctgaacttagcccctctccagtaccaagatgttcccctcgttaacttggctaacctccttatccactacggcctccatctcgacgcaaccaagctgcttctgcaggcacttgcaattaacagtagcgagcctttgaccttcctaagtttagggaatgcatatcttgcgctgaagaacataagcggcgcactggaggcatttagacaggcactgaagctaaccaccaagtgtccagagtgcgagaatagtctgaagttgattcgctgcatgcaattttacccttttctgtacaacataacctcatcagtgtgtagtggcacagttgtggaagagagcaacgggtccgatgaaatggaaaattccgacgaaaccaagatgagtgaagaaattctcgctctggtagatgagtttcagcaggcgtggcccctagagggattcggtggcgctctagaaatgaaaggcagaaggttggatctgcagggcatccgggtactcaagaaaggccctcaggatggggtggcaagaagctcatgctatggcgactgtcgttcagaggacgatgaggcaactgagtggattacctttcaagtaaagagggtcaaaaaaccaaagggagaccataagaagactcccggaaagaaggtggagaccggacagatagaaaacgggcatagataccaggcaaaccttgaaattaccggacctaaggtcgcttctcccggtccccagggtaagaaacgagattaccagcgactgggctggcctagcccagacgagtgcctgaaactacgctgggttgaactgaccgccatcgtatctacctggttagctgtctcttccaaaaacattgatatcaccgaacatattgacttcgctactcccatacagcagcccgctatggaacctttgtgcaacggtaatctcccaacttccatgcatactttggaccacctgcacggtgtgtctaatagagcgagcctacactacaccggcgagagtcagctgacagaggtgctgcagaatttggggaaagaccagtacccccagcagtccctggagcaaattggaactaggattgctaaagtgctcgagaagaaccagacatcatgggtgctgtcctctatggccgctctctactggcgggtgaagggccaaggcaaaaaagccattgactgtcttagacaagccttgcattatgctccccaccagatgaaagatgtccctctaatcagcttagccaacatcctccataatgccaaactctggaatgacgcagtaatcgtcgccacgatggcagtggagatcgcccctcatttcgccgtgaatcacttcaccctgggtaacgtgtacgtagctatggaagaattcgagaaggcccttgtgtggtatgaaagtactctaaagctgcagcctgagttcgtgcccgcaaaaaacaggattcaaactatacagtgccacctgatgctcaaaaagggcaggaggtccccttag

SEQ ID NO: 60190 - DNA, 2871 bp, Artificial Sequence
  Description of Artificial Sequence: Synthetic coding sequence
atggcagcagccgtcggggttagaggtcgatacgagctcccaccttgttcaggcccaggctggctgctgagtttaagcgctctgctcagcgtggcagctcgtggggctttcgccaccacacactgggttgttaccgaggatgggaagatacagcaacaggtggatagccctatgaatctgaagcatcctcatgacctcgttattctaatgcggcaggaagccaccgtgaactatttaaaagagctggagaagcagctcgttgcgcagaagatccacatcgaggagaacgaggatcgtgatacagggctggagcagaggcataacaaggaagatccagattgcatcaaagccaaggtcccattaggagacctggacctctacgatggcacctacataactttagaaagcaaggacatctcccctgaagactatatcgataccgaatcaccggtgcctcctgatccagagcagcctgactgtacaaaaattctggaactgccctattccatccacgcctttcagcatctgagaggcgtgcaagagagggtcaacctgagtgctccactgctgcccaaagaagaccctatttttacttacctctcaaagcgtctaggtcggtctatcgacgacatcggccacctaatccatgaaggcctgcagaaaaacacctctagttgggtcctgtataatatggcctctttctattggcgcatcaagaacgagccataccaagtggttgagtgcgctatgcgggctctgcactttagtagccgccacaataaggacattgcactagtaaacctcgctaatgttctacaccgtgctcacttctcagcagatgccgctgtggtggtacacgccgcattggacgacagtgactttttcacttcttactatacattaggaaacatttatgccatgctaggagagtacaaccatagcgtcctgtgctacgaccatgcccttcaggccagacccggatttgagcaggccatcaaaaggaaacacgctgtcctctgccagcagaaattggagcaaaaattggaggcccagcacaggtccctgcagaggacgttgaacgagctgaaagaatatcagaaacagcacgatcactacctgagacaacaggaaattctggagaaacacaaactgatccaggaggagcaaattctgcgaaatatcattcatgagacacaaatggccaaagaggctcaacttgggaaccatcagatttgtcgcctggtgaaccagcagcatagcctgcattgtcagtgggaccaacctgtaaggtaccaccgaggagacatattcgaaaatgtagattacgtccagtttggcgaagattccagtactagctcaatgatgtctgtcaacttcgacgtacaatctaatcagtctgacattaacgactcggtgaagagctccccagttgcccactcaatcctgtggatctggggtcgggactctgatgcttacagggataaacagcatattctgtggccaaagcgtgctgattgtaccgagagctatcccagggtgcctgtgggaggagagctgccaacctacttcttgccccctgagaataagggtctcaggattcacgaattgtcttcggatgactattctactgaggaggaggcccaaacaccagactgctcaattactgatttccgcaaatcccacacgctctcttatttggtgaaagaattggaagtgagaatggaccttaaagctaaaatgccagacgaccatgcgagaaagatcctgctgagcaggattaacaattatacaatacctgaagaggaaattggctcattcctgtttcatgctatcaataaaccaaacgcaccgatatggctgatcctaaatgaggccggactgtactggcgggcagttggaaacagcacgttcgcgattgcatgtctgcagcgcgctctgaacctcgcccctctgcagtaccaggatgtgcctctggtcaatctggcaaatctgctgattcactatggtcttcatctagacgccaccaaactgctgctacaggctctagcgattaactcctccgagcctctcacctttctcagtctgggcaatgcctacttagccctgaagaacatcagtggagcattggaagctttccgccaggccctgaagttaacaaccaagtgtcccgaatgcgaaaactccctcaagttgatacgttgtatgcagttttatccatttctatacaacatcacatcttctgtatgctccggcaattgccatgagaagacactggacaattcccacgataagcaaaagtactttgacaactcccagtcacttgatgccgcagaagaagaaccctccgaacgcggaaccgaggaagatcctgtcttctctgtagagaacagcggccgagacagcgatgcacttcggctggagtctaccgtggtcgaagaaagcaacggatctgacgagatggagaactctgacgagacgaaaatgagtgaggagatactcgcgcttgtagacgaattccagcaggcctggcccttggaaggttttgggggagctttggaaatgaagggtcgtagattggacctgcagggcatcagagtgttgaaaaaaggcccacaggatggagtggccaggtccagctgctacggtgattgtcgctccgaggacgacgaggcaacagagtggatcacattccaggtgaaacgagtaaaaaaacccaaaggcgaccacaagaaaacccccggtaagaaggtggagacaggacaaattgaaaacggccatagataccaggcgaatctggagattaccggtccaaaagtggcaagccccggtccccagggcctcttagattggaagactaggaaagtgccctag

SEQ ID NO: 60191 - DNA, 3366 bp, Artificial Sequence
  Description of Artificial Sequence: Synthetic coding sequence
atggagcaggttcctagcgcaggacgtcttgtccagatcaccgtaactgagggttatgacctgaagggtttcaaaggggatacccctgtgacttttatcagggcagagttcaaccaggttgtgttgggggattctgctaaaatcactgtgtcacccgagggctcagctaaatataattttacatccagtttcgaatttaatcccgaagggggtatcaccagtgacgacttggcacacaaacctgtttttctgacagttactgaagtgttgcccaaagagaagaaacagaaagaagaaaagactctaatccttggccaggcagttgttgacctcttacccctgctggaagggcagtcctcctttcagacgacggtaccactccaccctgtacagggaagccccctggagactcctcgaagttcagccaagcagtgctcactggaggtgaaagttttggtagcagagcctttattgactactgcacagatcagtggagggaatctgctaaaagtaacgcttgaagccgcatactcagttcctgaaagttttattcccactggtccgggacagaattatatggtgggcctgcaggtgccttccttgggagaaaaggactacccaatcctgttcaagaatggcacacttaaattggggggtgaaagggaacctgttccacgacctaaaaagtggccgatcgcaaatatcttggctcctggggcaaataacatccctgacgcttttatagttgggggtccttatgaagaagaggagggggaactaaaccatcccgaagacagcgagtttagaaaccaggctgagtgcattaagaagcggatcatctgggatctggagtccaggtgttatttggatccctctgccgtcgtatcatttcagaagaggatagctgactgccgactgtggccagtagagattacccgagtgccccttgtgaccatacctaaagggaaggccggtaagaccgagaagacagatgaagaggctcagttatcctttcacggggtggcatacgtgaacatggtaccactcctatatcccggagttaaacgtattagaggcgcattccacgtttatccctatctggacagcgtggttcacgagaaaaccaagtgcctgctgtccctattccgcgatatcggccaccaccttatccataacaacaagataggaggaatcaatagtttacttagcaagcaggcagttagtaagaaccttaaagaagataagcctgtgaaagagaaggacatcgatgggaggccgagaccgggtgacgttcaggcacctagcatcaagagccagagctccgacaccccgcttgagggagaacctccattgtctcataatcccgaagggcagcaatatgtcgaggcaggcacatacatcgttctggagatccagctcgataaagccctcgtccccaagcggatgccagaggaattagcgcgtagagttaaagaaatgattcccccaaggcctccgctaactcgtcgaaccggcggagcccaaaaagcaatgtctgactatcacatccaaataaagaatatatcaagagcaattctcgatgaatattatcggatgtttggaaagcaggtggcaaagctggagagcgatatggattcagagaccctcgaggaacaaaaatgccagctcagctatgaactgaattgttcaggaaagtacttcgccttcaaagagcagttgaagcatgccgtcgtgaaaatcgttcgggataagtatcttaaaacaacctcgttcgagtcccaggaagagttgcaaactttcatttccgagttgtatgtattcctcgtcgaccaaatgcacgtggctcttaatcagaccatgcccgatgatgtgcagggaacagtggccaccatctacacatcaagcgagcagctgcagctgttcgcatttgaagctgaagtgaacgagaacttcgagatggccgctgcctactataaagaaaggttggtgagggaaccgcagaatttggaccactggctcgattacggcgcattctgtcttctcacagaggacaacataaaggcccaggagtgcttccagaaggccctgagcttgaaccagtctcatatccactccctgctgctgtgcggtgtcctagcggtcttattggagaactacgaacaggcagaaattttttttgaggatgccacctgtctcgagcccacaaatgtagtggcttggactttactgggcctatactatgaaatacagaataatgatatcagaatggagatggcctttcacgaagcctccaagcaattgcaggcccgtatgctgcaagcacaggtcactaagcaaaagagcaccggggttgaagacaccgaggagcggggaaagagagaaagttcgctagggccttgggggatcactaatggctcagccactgctatcaaggtggaggcacctgccggtcccggagctgcactctccattctcgataaatttctggaagaatctagcaaactgcagagcgactcccaagagcccatcctgacaacccagacctgggacccttctataagccagaaacctagcaacacttttataaaagaaattccaacaaaaaaggaagcttcaaagtgccaagattctagtgcactgctgcaccccggtttgcattacggagtatcacaaacgaccaccatttttatggaaacgattcacttcctgatgaaagtgaaagccgtacagtacgtgcaccgcgtcttagctcatgagctgctctgtccacagggaggaccctcttgtgaatactatctcgtgttggcccaaactcatattctcaagaagaattttgccaaggcagaagaatatctccagcaagccgcacagatggactacctcaacccaaacgtgtggggactcaagggccatctgtacttccttagcggaaaccacagcgaggcgaaagcttgttacgagcggaccatttcgtttgtggtggatgccagcgagatgcactttatttttctgcgactcggtctcatttacttagaggagaaggagtatgagaaagctaagaaaacgtacatgcaggcctgcaagaggtcccctagctgtctaacctggctcggcctcggaattgcctgttacaggctcgaggagttgactgaggcagaggacgccttgagtgaagccaacgcactcaacaattacaacgctgaggtttgggcttacctggcactggtctgtctcaaggtaggcaggcagctggaggcagagcaggcatataagtacatgatcaagctgaaactgaaggacgaggcccttcttgcggagatacataccctgcaagaaaccgtgggcttcggaaatccttctttttag

SEQ ID NO: 60192 - DNA, 1086 bp, Artificial Sequence
  Description of Artificial Sequence: Synthetic coding sequence
atggagcaggttcctagtgccggacgactggtccaaattacagtaacagagggctatgatctgaaggggttcaagggtgacacacctgtgacattcatcagagccgaatttaatcaggtggtgctgggagatagtgcaaagatcacagtctcacctgaaggtagcgccaaatataacttcacctctagctttgagtttaatcccgaaggcggaataacttccgacgatctggcacacaaacccgtcttcctgacagtgaccgaagtattgcctaaggagaaaaaacagaaggaagaaaaaacgcttatactcgggcaggctgtggttgatctgctgcccctgttggaaggccaaagcagtttccaaacgaccgttcccttacatccagtccagggcagcccccttgagacgccgaggtcaagcgctaagcagtgtagcttggaggttaaagtgctggtcgctgagcctttgctgacaacagcccagatctctgggggtaatctgctcaaagttacactggaagcagcttattcggtcccagaatctttcattcccactgggccagggcagaattatatggttggcctgcaagtgccatccctgggtgaaaaggattatcctattctgtttaaaaatggcactctaaatggaaaccacagtgaagccaaagcttgctatgaaaggacaataagttttgtggtcgatgcaagtgaaatgcattttatcttcctgcggctgggtctgatctacctggaagagaaggaatatgagaaggctaaaaaaacatatatgcaggcctgtaagaggtcgccaagctgtctgacctggctcggtctgggtatagcctgctaccggttagaagagctcactgaggccgaggatgcactgtctgaggcaaacgctctgaacaattataatgcagaagtgtgggcctacttagccctggtctgtcttaaggtaggtcgccagctggaagcagagcaggcctataaatacatgatcaagctgaaactgaaggacgaggccctcttggccgagatccacacactgcaggaaacagtgggctttggaaacccctctttctag

SEQ ID NO: 60193 - DNA, 3366 bp, Artificial Sequence
  Description of Artificial Sequence: Synthetic coding sequence
atggaacaggtgccatctgcaggccgactcgtgcaaatcacagtgacggaaggctacgacttgaaaggcttcaaaggggatactcccgttacattcatccgcgcagagttcaaccaagttgtgctgggcgacagtgcaaagataaccgtctccccagaaggaagcgcaaagtataactttaccagcagctttgaatttaatcccgaagggggtataactagcgacgatctcgctcacaaaccggtgttcctgacagtgacagaggtgttgcccaaagagaaaaagcaaaaggaggaaaaaactttgatcctcggacaggcagttgttgatcttctcccactgctggaagggcagagcagctttcagactactgtgcctcttcacccggtgcagggctcccctcttgagacaccccgtagcagtgcaaaacagtgttctctagaagttaaagtcctggtcgccgagccactactcaccactgcccagatttctgggggtaatctgctcaaagtcacactcgaagccgcatactctgtccccgagagctttattccgactggacctggccagaattatatggtgggcctgcaggtgccgagtcttggcgaaaaggactacccaattctatttaaaaatggcaccctgaagttgggcggtgagagggagcccgttccaaggcccaagaaatggcccattgccaacatcctggccccaggggcaaataatattccagacgctttcattgtgggcggtccctatgaagaggaggagggggagcttaaccaccccgaagactcagagtttagaaaccaagcagaatgcatcaagaaacggataatttgggatcttgaatcacgatgttacctggacccgagcgctgtagtgtcattccaaaaaaggatcgcggattgtaggctttggcctgtggaaataacgcgcgtaccactcgtcaccatccctaaggggaaggctggtaaaaccgaaaagactgatgaggaggcacagctgtcctttcacggtgtcgcatatgtgaacatggttccattattgtatcctggcgtgaaaaggattcggggtgccttccatgtgtacccctatctggacagcgttgtgcatgagaagaccaagtgcctgctgtctctttttagggatatcggccaccaccttatacacaacaataagatcggcggaataaatagcctgctttccaaacaagctgtgtctaagaatctgaaagaggacaaaccagtgaaggaaaaagacattgacggaaggcctcgaccaggagatgtgcaagcgccaagtatcaaaagtcagagcagcgacactccactcgagggtgagccccctctctcacataaccccgaaggccagcagtatgtcgaggcaggaacgtatattgtgctcgagattcagctggacaaggcgctggtgcccaagagaatgcccgaggaacttgctcgcagagtcaaggagatgatcccccctcggcctcctctgacccgtaggactgggggagctcagaaagcgatgagcgactaccatatacagatcaaaaacatcagtcgcgctatcctagacgagtattacagaatgtttggtaagcaggttgccaaactggaaagcgacatggattcagagaccctagaagagcagaaatgtcagctgagctatgagctgaactgttccggcaagtatttcgcctttaaagagcagcttaagcatgcggttgtcaaaatcgttcgtgacaagtatcttaagaccaccagctttgaatctcaggaagagctccagacattcatttccgagctgtacgtgtttcttgtggaccagatgcatgtggcccttaaccagacaatgccagatgacgtccagggaacagtcgccacgatctacacttctagcgagcagctccagcttttcgccttcgaagctgaagtcaacgagaattttgaaatggcggctgcttactataaggagaggttggtccgggaaccacaaaacctcgaccattggcttgattatggggctttttgtctgctcacggaggacaacattaaagcgcaggagtgtttccagaaggctttgagcctgaaccagagccatattcactcacttctgttgtgtggtgtgttagctgtgctactggaaaattacgaacaggcggagatctttttcgaagatgctacatgcctggagccaacaaacgtagtcgcctggacccttttgggcttgtactatgagattcagaacaacgatatccgcatggagatggcgtttcatgaggcgagtaagcagctccaggccagaatgctgcaagcccaagtaacgaagcagaaatccactggtgtggaagacaccgaggaacgaggtaagcgcgagtcgtccctgggcccatggggcatcaccaatggtagcgcaactgcaatcaaggttgaggctcctgccggacctggagccgcactgtcaatcctggacaaatttctagaggaaagctcaaagctgcagagtgattcgcaggaacccatcctgaccactcaaacgtgggacccctcgattagccagaagccatccaatacttttattaaggagatacctacgaagaaggaagcttctaaatgtcaggacagctcagccctgctgcacccagggcttcactatggagtctctcaaacaacaaccatttttatggagaccatacactttctgatgaaggtcaaggccgtccaatacgtacatcgtgtgttggctcacgagcttttgtgcccacaaggagggccatcctgtgagtattacctcgtgctcgcccagacccacattctgaagaaaaattttgcaaaagctgaggagtatctgcagcaagccgcacagatggattatctgaaccctaacgtgtggggattaaagggacatctgtatttcctttccggaaatcacagcgaggccaaggcatgttatgagcggacaatttcctttgttgtcgacgcctccgagatgcacttcattttcctacgtctgggactaatatacctagaggaaaaagaatacgaaaaagccaagaaaacgtatatgcaagcatgtaagcggtcaccgagttgcctcacctggctgggcttgggcattgcatgctatcgcttggaggagctgacagaagcagaggatgcactttctgaggcgaatgcactaaacaattataacgcggaagtttgggcctacctggcattggtctgtctgaaggtcggcaggcaactggaagccgaacaagcctacaagtacatgattaaactcaaactgaaggacgaagcgctgctggctgaaatacacaccctgcaggagactgtgggattcggcaacccttcgttctag

SEQ ID NO: 60194 - DNA, 1758 bp, Artificial Sequence
  Description of Artificial Sequence: Synthetic coding sequence
atggaacaagtcccctcagccggacgcctcgtacaaattactgtgactgaaggctacgatttgaaaggatttaaaggcgacacaccagtaacatttatccgcgcagagtttaaccaggttgtgcttggggattctgctaaaattaccgtgagcccagaaggctcagccaagtacaatttcacgtcgtcctttgagttcaacccagaaggcggtataacatccgacgatctcgcccacaagcctgtttttctcaccgttactgaagtgctgccgaaggaaaaaaagcagaaggaggagaagacgctgatcctcggccaggcagtggtggatctgcttcctctgctcgagggccaatcctccttccaaactacagttccactgcacccagtccagggctcaccactggaaacgcctcggagctccgccaagcagtgttctctggaagtgaaggtgctggtagcagagcccttgctcactaccgcccaaatctctggagggaatctgcttaaggtcaccctggaagctgcgtactctgtgcctgagagctttatcccaactggccctggccagaactacatggtgggcttgcaggtgccaagtctcggagagaaggactatcccatcctgtttaaaaatgggacgctgaaactgggcggagaacgggaacccgtgcccagacccaagaagtggcccatcgccaacatcctcgcgcctggtgctaataatattcccgatgcgttcattgttggcggaccctacgaagaggaggagggcgagctgaaccatcccgaagatagcgagtttcgcaatcaagcggaatgcattaaaaagaggataatttgggatctggagagccggtgctatctggatccatccgcagtggtttctttccagaaacgtattgctgattgcagattatggcctgttgaaatcaccagggttcccctggtaaccattccaaaggggaaggccggaaagaccgagaaaactgatgaagaggcacagctgtcctttcatggagttgcctatgtgaacatggtgcccttgttgtatccgggagtgaaacgcattaggggagcctttcacgtctatccttatctcgactctgttgtgcacgaaaagaccaaatgtctcctatcactgtttcgcgacatcggtcaccatttgatccacaacaataagattggaggtatcaattctctgctgtccaaacaggcggtaagtaagaacctaaaagaagataagcccgtcaaggagaaagatattgatggacgccctcgccctggagacgtgcaagccccttctattaagtctcagagcagtgacactccgctggagggcgagccacccctctctcataatccggaaggacagcagtacgtggaagcaggtacttatattgtcctggagatccagctcgataaagcattggtcccgaagcgaatgccagaggagctcgcaaggagagtaaaagagatgatccctcctaggcctcccctaacccggcgaacaggcggagctcagaaagccatgagcgactaccacatacaaatcaaaaatatatcacgagctatcttggatgaatattacaggatgtttggtaagcaggtggccaagctcgaatcagacatggattcagagaccctagaagaacaagcttacaaatacatgattaagctgaagctgaaggacgaagcgttactagccgagatccacaccctgcaggagaccgtcggatttggaaatccatccttctag

SEQ ID NO: 60195 - DNA, 360 bp, Artificial Sequence
  Description of Artificial Sequence: Synthetic coding sequence
atggagcaggtgcctagcgccggacggctcgtgcaaattacagtgacagaaggttacgatctgaagggtttcaagggtgacacccccgtcacttttattcgcgctgagtttaaccaggtagtgttgggagatagcgctaaaatcacagtgagtcccgaaggatcagcgaaatataacttcacaagtagttttgaattcaaccctgaggggggtataaccagcgacgacctcgcccacaagcctgtgttcttgactgtgaccgaagtgctgcccaaggagaaaaagcagaaggaggagaagaccctaattttggggcaggctgtggttgatctcttgccacttctcgaggggcagtcttag

SEQ ID NO: 60196 - DNA, 3276 bp, Artificial Sequence
  Description of Artificial Sequence: Synthetic coding sequence
atggagcaagtaccctctgccggtaggctggtgcagattacagtgactgaaggctacgacctgaagggcttcaaaggtgatactcccgttacattcatcagggccgagttcaatcaggtcgtcctcggcgactcagccaagatcacggtgtctccagaaggatccgccaagtataacttcacttcaagctttgagttcaatccagagggtggcatcacttctgatgacctcgcacacaagccagtttttttaactgtcaccgaggtgctccccaaagaaaagaagcaaaaggaggaaaaaacactgatacttggacaggcagttgttgatttactgcctctgctggaaggacagtcttcatttcagacaactgtgcccctgcacccagtgcagggtagcccactcgagacgcctcgctcatcggccaagcagtgcagcttagaggtgaaggtgttggtggccgaacccctcttaactactgcacagatttcaggcggaaatctcctgaaggttaccctggaggccgcttactccgtgccagaatcctttatcccaacggggcctggtcagaattatatggtcgggcttcaggtaccctccctcggagagaaggactaccctatcctcttcaagaatggcactctaaagctgggcggagagcgggagcctgtcccccgtcctaagaagtggcccatcgcgaacattctcgcccctggcgcaaacaatatccctgacgcctttattgtgggtggaccctatgaggaggaggagggcgaattgaaccaccccgaggattccgaatttcgtaaccaggctgaatgcataaaaaaaagaataatttgggaccttgaaagtcgctgttatctggatccaagtgctgtcgtgtctttccagaagcggattgctgattgccgcctgtggcccgtggagattaccagagtgccattggtgacaataccaaaaggaaaagcgggaaagacagaaaaaacagacgaagaagcccaattgtcgttccacggtgtggcatacgttaacatggtgccccttctgtatccaggcgtgaagaggatcagaggtgcattccacgtttacccatatttagacagcgtcgtccacgaaaagacaaagtgcttattgtcgctgttcagagatattggtcatcacctgatccataataacaaaatcggcggtatcaactcattactctccaagcaagccgtgagtaaaaacctcaaggaggacaagccagtcaaggagaaagacattgatggccgtcctcgccctggggatgtacaggccccttccataaaatcacagagcagtgatacccccttggagggcgaaccgccacttagccataatcccgagggccagcaatacgtcgaggcaggcacgtatatcgttctagaaatccaacttgacaaggctctcgttcctaagagaatgcccgaagaactggccaggcgagtgaaggagatgatacctcctagacccccactgactcgcaggacgggtggtgcacagaaggccgtctccgattaccacatccaaattaaaaatatatcacgcgctattttggacgagtactaccgtatgttcggcaagcaggtggccaagctagagagcgatatggacagtgagacactagaggagcagaaatgtcaactttcttatgagctcaactgctctggtaaatattttgcatttaaggagcagctgaaacatgccgtggttaaaattgtgagggataaatacctaaaaacaaccagtttcgagtctcaggaagagcttcagacatttatctctgagctgtacgtgtttcttgtcgaccagatgcatgttgccctcaatcagaccatgcctgatgatgtgcagggaacagtcgcaactatatacaccagttccgaacagctacaattgtttgccttcgaggccgaagtcaatgagaacttcgaaatggcagccgcatactataaggagaggctcgtccgggagccacagaatctcgatcactggctggactacggagctttctgcctcctcactgaagataacatcaaagcacaagaatgttttcagaaagcgttgtctctgaaccagtctcacatccatagccttctgctttgtggggtgcttgctgtactgctggaaaactacgaacaagcagagattttttttgaagacgcaacttgtttggagccgacaaacgttgtcgcttggaccctcctgggtctctattacgagattcagaacaacgatattagaatggaaatggccttccacgaggccagtaaacagctccaagctagaatgttgcaagctcaggttacgaaacagaaaagcaccggcgtggaggatacagaagaacgaggtaaacgggagagttctctcggtccttggggtataacaaacgggtctgccactgctataaaagtagaggctcctgcaggcccaggcgcagccctgtcaatcttggacaagtttcttgaggaatccagcaagctgcaaagtgactctcaggaacccatattaacaactcagacctgggatccttctatcagccagaagccatccaataccttcattaaagaaatcccaaccaagaaagaggcctcaaagtgtcaagatagcagtgctttactgcaccccggactgcactatggcgtaagccagactacaacaattttcatggagactattcactttctgatgaaagtaaaggctgtccagtacgtccaccgagttctagcgcacgagctgctctgcccccagggaggaccatcttgcgagtactacctcgtcctggctcagacccacatactgaagaaaaacttcgccaaggccgaggagtacctgcaacaggccgctcagatggactatcttaatcccaatgtctgggggctgaagggccatttgtacttccttagcggtaaccactctgaagctaaagcatgctatgaaaggacaatctccttcgtcgtagatgcctcagagatgcatttcatttttttgcgcttgggactgatatacttggaggaaaaggagttagaggagctgaccgaggccgaggatgccctcagtgaggccaacgcacttaataactacaacgccgaagtgtgggcttacctcgcactagtgtgcttgaaggttggtcgtcagctagaagctgaacaggcttataagtacatgatcaagcttaaacttaaagacgaggcactcctggccgagatacatactctgcaggagacagtggggttcggaaatcccagcttttag

SEQ ID NO: 60197 - DNA, 3366 bp, Artificial Sequence
  Description of Artificial Sequence: Synthetic coding sequence
atggagcaagtcccttcagccggtaggctcgtgcagataactgttaccgagggctacgacctgaaggggtttaagggcgacacgccagtgaccttcattcgagcagaatttaatcaggtagtgttgggcgacagcgccaaaattaccgttagcccagagggctcagcgaagtataacttcaccagttcctttgaatttaacccagagggaggcatcactagtgatgatttggctcacaagccggtgtttcttactgtaacagaagtgctgcccaaggagaaaaagcagaaagaggaaaaaaccctcatcctgggtcaggccgtagtcgatctgcttcccttgctcgaagggcagtccagcttccagacgactgtgcccttgcacccagtccaagggagtcccctggaaacgcctcgcagctctgccaaacagtgttcactggaagtgaaggtactggtggctgagcctctgctcacgacagcccagatttccggaggcaacctacttaaagtgaccctggaagctgcctactcggtgcccgagtcatttattccaacaggcccagggcagaattacatggtggggttacaggtgccaagcttgggcgagaaagactaccctattctgtttaaaaacgggacgttgaagttgggaggtgagagggagcccgtcccccgaccaaagaaatggccaatagctaacatcttggcgccaggggcaaataatataccagatgcatttatagtagggggtccctacgaggaggaggaaggggaacttaatcatccagaggattccgaattcaggaatcaagcggagtgcatcaaaaagagaattatttgggacctggaatcacggtgttatctagacccttctgctgtggtttcttttcagaagaggatagctgattgcaggctctggcctgtggagataactcgcgtgccgttagtcacaattcctaagggcaaagcagggaaaactgagaaaaccgacgaggaggcacagcttagcttccatggggtggcctatgtaaacatggtgcctctactgtatcccggtgttaagaggatccggggtgcctttcatgtgtacccgtatctggactccgtggtgcatgagaagaccaagtgcctgctcagtctgttccgagacatcggccatcacttgatccacaacaacaagattggcggaatcaatagtttactcagcaaacaggccgtctctaaaaacctcaaagaggacaagcctgtgaaggaaaaagacatcgatggcaggccacgaccaggggacgtacaagcccctagcattaagagccagagttccgatactcctctcgagggagaaccacccctctcccacaaccccgagggccaacaatacgtggaggcaggcacatatatcgtgctagagattcagctggataaagctctcgtcccaaagcgcatgcctgaggagttggctcgcagagtgaaggagatgatcccgcctagaccccctttgaccaggcggacaggaggcgctcagaaggcagttagtgattatcatattcagattaagaacatcagcagggcaattttagatgagtactacagaatgttcggcaagcaggtggccaaactggagagcgacatggacagcgagacactggaggagcagaagtgccagcttagctatgagctcaattgctcaggaaaatactttgctttcaaggaacaactcaaacacgcggtcgtcaagatcgtccgtgataaatatctgaagaccacttcttttgagtcccaggaggagctccaaacatttatttcagagctgtatgtatttctggtagatcaaatgcatgtagcactgaaccagacaatgcccgacgacgtacagggaactgtggctactatctacacgtcttctgagcagctacagctgttcgccttcgaagcagaggtgaacgagaatttcgagatggccgcagcctactataaagagcggctggtgagagagccacaaaatctggaccattggttagactacggcgcattctgtctgcttacagaagacaacatcaaagcgcaggaatgcttccagaaggctctcagccttaaccagtcacatattcacagtctgctgctatgtggggtcctggccgtcctgcttgaaaactacgagcaagcagaaatcttttttgaggatgcgacttgcctggagcctaccaacgtggttgcctggacactgcttgggctctattacgaaatccagaataatgacattcgcatggaaatggcattccatgaggcctccaagcagcttcaggccaggatgctgcaggcacaggtgaccaagcaaaagtctacaggggtggaggacaccgaggagagaggcaagagggagagttctcttgggccttggggaatcacaaatggatctgcaaccgccatcaaggtggaggcaccggcaggaccaggcgctgccctatccatcctggacaaattcctggaggagtcaagtaagctgcagtccgatagtcaagagcccattctgactactcaaacctgggacccttcaatatcacagaagccaagcaataccttcatcaaagaaatccctaccaagaaggaggcttctaagtgccaggactccagcgccttgttgcacccaggcctacattatggagtcagccagaccacaactatatttatggagacaatccacttcctcatgaaggtaaaggctgtccagtacgtacatcgggtcctggctcatgaactgttgtgtcctcagggaggcccaagctgtgaatactatttagttttagcccagacccatatcttgaagaagaattttgccaaagccgaagaatacctgcaacaggctgcccagatggactacctgaatcctaatgtgtggggactgaaaggacacctgtacttcctgtctggcaaccacagcgaggccaaggcgtgctacgagcgcaccatcagctttgtcgtggacgcatccgaaatgcactttatctttctgcgactcggcctgatctacctggaggaaaaagagtacgagaaggccaagaagacctatatgcaggcttgcaagcgatccccctcctgtcttacttggctcggtctgggtatcgcttgttaccgactggaggaactgactgaagccgaagacgccctgtccgaagccaatgcgttgaataactacaacgcagaagtgtgggcatatctcgcactggtgtgccttaaagtagggagacagttagaggccgaacaggcctacaaatacatgatcaagctgaagctgaaagatgaagcattgctcgcagaaatccacactctgcaggagactgtgggatttgggaatccttctttttag

SEQ ID NO: 60198 - DNA, 1497 bp, Artificial Sequence
  Description of Artificial Sequence: Synthetic coding sequence
caagaagaattgcagacattcataagtgagctgtatgtcttcctggtcgaccaaatgcatgtggctcttaatcagactatgcccgatgacgtgcaaggtacggtggcaaccatatataccagcagtgagcagcttcagctgttcgctttcgaggccgaggtgaatgagaacttcgaaatggcggcagcttactacaaagagcgcctggtcagagagccccaaaacctcgatcactggctcgattatggcgctttttgcctcctcacggaggataacattaaagcccaagagtgctttcagaaagcattgtctctgaatcaatcccacatacatagtctgctcctgtgtggggtcttagcggtcctgttggaaaattacgagcaggccgagatctttttcgaggatgcaacttgcctggaacccaccaatgtggtggcgtggacccttctagggctgtactatgagatccagaacaacgacatccggatggaaatggcctttcacgaggcttccaagcagcttcaggccagaatgctgcaggcacaggtgacaaaacagaaatcgacaggcgttgaggataccgaagagcgtggtaagcgagaaagtagcctgggcccttgggggatcacgaacggatccgctaccgcaatcaaagtagaggcccctgccggacccggtgctgccctcagcattctggacaagtttttagaggagtcaagcaagcttcaatccgacagtcaagaacccatcctgacgactcagacttgggatccttccatctcacagaaacccagcaacacctttataaaagagatacctacaaagaaggaagcctccaagtgtcaggattcatccgcgctcttgcaccctgggctgcattacggcgtgagtcagaccaccacaatttttatggagactatccactttctgatgaaggtaaaggcagttcagtatgttcacagggtacttgctcatgagctcctgtgcccccagggtggcccatcctgcgaatattatctggtgttggcacagacgcatattctgaagaagaatttcgcaaaggctgaagagtacctccaacaagccgcacagatggactacctgaatcctaatgtgtggggtctaaaaggccacctttatttcctgtccggaaaccactccgaggctaaggcatgctacgagaggactatatcttttgtcgtggatgcaagtgaaatgcacttcatctttcttcggctcggtttgatttatctcgaggagaaggagcttgaggagctcactgaagccgaggatgccctttccgaagccaacgcattaaacaactacaacgccgaggtctgggcatacctggctcttgtgtgcctgaaagtgggcaggcaactggaggccgagcaagcttataaatatatgataaaactgaagttaaaggatgaagccctattggcagaaattcataccctgcaggagaccgtagggttcggaaacccgtcgttctag

SEQ ID NO: 60199 - DNA, 3966 bp, Artificial Sequence
  Description of Artificial Sequence: Synthetic coding sequence
atgtcatctaatgactcctcattaatggcgggaattatctattatagtcaggagaaatacttccatcacgtgcagcaggctgctgctgtaggactggagaaattctctaatgaccccgttctgaagttctttaaagcatatggagtcctcaaagaagagcacatccaggatgccatcagcgacctggaatccatcagacatcacccagatgtaagcctgtgctcgactatggcactcatctatgcccacaaacgctgtgagatcattgacagggaggcgatccaagagttggagtatagtttgaaggagatccggaagaccgtgagcgggacggctctctactatgctggactattcctctggctgatcgggcgacatgataaggctaaagagtatatcgatcgcatgctgaagatctctcggggatttagggaagcctacgtgctgagaggctgggtggaccttacgagtgacaagcctcatactgccaaaaaagctatagagtacctagagcaaggcatccaagatacaaaggatgtgcttggtctaatgggcaaagctatgtattttatgatgcagcagaactatagcgaggctcttgaggttgtgaaccagattaccgtcacctctggctcattcctaccagcccttgtgctaaagatgcagttattcctggctcggcaggattgggaacagaccgtcgagatgggtcacagaattctggagaaggacgagagcaacattgatgcgtgccagattctgacagtccatgagctggccagggaagggaacatgacaacagtgtctagcctgaaaacccagaaagcaacaaaccatgtgcggaatctgatcaaagccctagaaactcgggaaccagagaacccatcgttgcaccttaaaaaaatcatcgttgtgtctcggctgtgtgggtcccaccaggtgatcttaggtctcgtgtgcagcttcattgagcgaaccttcatggccaccccctcatatgtccatgtcgcaaccgagctgggctacctgttcatactgaaaaatcaggtgaaagaagccctgctttggtactccgaggcaatgaagctcgataaggatggaatggcaggattgacaggaattatcttatgtcatatattggaaggccacctggaggaagcagaataccggcttgagtttttgaaggaggtgcagaagagtctgggtaagtctgaagtattgatcttcttacaggctctcctcatgtctaggaaacacaaaggagaagaagagacaactgctctattgaaagaagccgtggagctgcatttttcctccatgcagggcatacccctgggaagtgaatactttgagaaactggatccctactttctcgtgtgtatagctaaagagtaccttctgttttgtccaaagcagcccagactcccaggacagatcgtcagccctcttctgaaacaggtagccgtgattctgaaccctgtggtgaaggctgcgccagcattgattgatcccctttatcttatggctcaagtcagatactatagtggagagctcgaaaacgcacagagtattctgcagagatgcctcgagctcgaccccgcatcagtcgatgcacatctgcttatgtgtcaaatttaccttgcacaggggaactttggcatgtgcttccactgtcttgaattaggggtgagccacaatttccaagtacgcgatcatccgctgtaccatctcatcaaggctagggctctcaacaaggctggcgactatcctgaagccattaagacccttaaaatggtgattaagctgccagctctgaagaaggaagaggggaggaagtttctgcggccttcagttcagccttctcagagagcgtcaatcctgctggaactggtcgaagcccttaggttaaatggagaactgcacgaggcgaccaaggtgatgcaagacactattaatgagtttgggggaactccagaggagaacaggatcaccatcgctaatgtggatctggtgctttccaagggtaacgttgacgtcgctctcaacatgctgaggaacatcttgcccaaacaatcctgttacatggaggcaagggagaaaatggcgaatatctacctgcaaactcttcgtgataggcggctatacatccggtgttatcgagagctgtgtgaacacctgccaggaccgcatactagcctcctcttaggcgatgccctcatgagcattctggaacctgagaaggccttagaagtctacgatgaggcttacagacaaaaccctcacgatgcaagcctggcttctagaatcgggcacgcttacgtgaaggctcatcagtacactgaggccattgagtattatgaagccgcacagaaaatcaacggtcaagatttcctgtgctgtgacctgggcaaactcctcctgaagctcaaaaaggtgaacaaggctgaaaaggtgctaaagcaggcgctagaacacgacatcgtgcaagacatcccttccatgatgaatgacgtaaaatgccttttactgctggccaaggtgtacaagagccataagaaagaggctgttatcgagacgctgaacaaggcccttgacctccagtcacggatcctcaagagagtccctctggaacagcctgagatgatcccttctcagaagcagttggccgctagcatctgcatccagtttgctgaacattatctggcagaaaaagagtacgataaggcagtccagtcctataaggacgtctttagttatctcccaaccgacaacaaggtgatgcttgagctcgcccaactatatttgctacagggacacctggatttgtgcgagcagcattgcgccattctgctgcagaccgagcaaaatcacgagacagcgtcagtgctcatggcggatctgatgttccgcaagcaaaagcatgaagccgctataaatctgtaccatcaggtgctcgagaaggctcccgataactttctggtattacataagttgatcgatctgctgagaagatctggcaaactcgaagatattccagctttctttgagctcgcaaagaaggtatcttcccgtgtccccctggagccgggttttaactactgcagagggatttactgttggcacatcggtcagcccaatgaggctctgaaattcctgaataaggctaggaaagattctacgtgggggcagtctgcaatctatcacatggtacagatttgcctcaacccggacaatgaggtggtcggcggagaggcgtttgagaaccaaggtgcagagagcaactatatggagaagaaagagttagaacagcaaggggtgagcacggcagaaaagttgctccgagaattttacccccactcggattcatctcagacgcaactgcgcttactgcaaggactatgcaggctggctacaagagaaaaggctaatatggaagccgctctcggcagcttcatccagatcgcccaagcagaaaaagattctgtccccgcactgttggccctagctcaggcctacgtgttcttaaagcagatcccgaaggcaaggatgcagcttaaaagacttgctaaaacaccttgggtgttatcagaggccgaagatctcgagaagagttggctcctgctagcagatatctattgtcaggggagcaaattcgacctcgctctggagctgctgaggcgatgcgtgcagtataataagtcctgttataaggcttatgagtacatgggctttatcatggaaaaggagcagtcatataaggacgcagtgacaaattataaactggcctggaaatactcccatcacgccaaccctgcgatcggattcaaattagccttcaattacctaaaagataagaagtttgtcgaggcaattgagatctgtaacgatgtgctgcgcgaacacccggactacccaaagatccgcgaggagattctagagaaggccaggcgcagccttcggccttag

SEQ ID NO: 60200 - DNA, 3912 bp, Artificial Sequence
  Description of Artificial Sequence: Synthetic coding sequence
atgtcctctaacgacagcagcctcatggctggtattatctattattctcaggaaaaatacttccaccatgttcagcaggcagctgccgtgggtctggaaaagttttccaatgaccctgtcttaaaatttttcaaagcctatggagtcctaaaggaagaacatatacaggacgccataagcgacttggagtcaattagacatcaccctgatgtgtccctgtgttcaacaatggcactgatctacgcccacaaaagatgtgaaatcatagatcgggaagcaatccaggaattggagtacagccttaaagagatacgcaaaaccgttagtggcaccgccctgtactacgccggactatttttatggcttatcggacggcatgacaaggcaaaagagtatattgataggatgctgaaaatcagcaggggcttccgcgaggcctacgttctacggggttgggtcgacttgactagcgataagccgcataccgccaaaaaggcgatcgagtacctggagcagggaattcaggacactaaggacgtgttaggtctgatgggaaaagctatgtatttcatgatgcaacaaaattactccgaggcgcttgaagttgtgaaccagattaccgtgacgtccggttcattcctccccgctcttgtcctgaagatgcagctctttctcgccagacaagattgggagcagaccgtcgaaatgggtcaccggattctggagaaggatgagtccaatatagatgcctgtcagattctgacggtgcacgagctcgccagagaaggtaatatgaccactgccactaaccacgtgaggaacctcataaaagcactggaaaccagggagccggaaaacccctctcttcatcttaagaaaattatagttgtatctagactgtgcggctctcaccaggtgatcctgggtttagtgtgctcctttatcgaaaggaccttcatggccacaccatcatacgtccacgttgcaaccgaacttgggtacctgttcatattgaaaaaccaggttaaggaagcgcttttgtggtattccgaggctatgaaactcgacaaagacggaatggctgggctcactgggataatactgtgccatatactggaagggcaccttgaagaggtacagaaatctttgggcaagtctgaggtcttaatttttctacaggcactcctgatgtccagaaagcataagggagaagaagaaactaccgccctgctcaaggaagctgtggaacttcactttagtagcatgcagggcattccgctgggaagcgaatactttgagaagctggacccttactttctggtttgcatcgccaaagaatatctcctgttttgccctaaacaacctcgcctgccaggccagattgtatcaccactgttaaagcaggtcgcagtaatcttgaaccctgtggtcaaggcggcacctgctctcattgaccccctgtatctgatggcccaggtgcggtattattctggagaacttgaaaatgctcagtccattctgcagcgctgtctggagctagaccctgcctcggtggatgcgcatctccttatgtgtcaaatttatttggcccagggcaacttcggaatgtgtttccattgtctggagctgggtgtgagccacaactttcaggtcagagatcacccattgtatcacctgatcaaggctagggctctaaataaggcgggtgattaccctgaagcaattaagaccctaaagatggtgattaagctgcctgcactcaagaaggaggaaggccgtaagtttcttcggccttcagtgcagccctcccagagagcctccatcctgcttgaacttgtggaagcgctgaggctgaacggtgaactgcacgaggctacgaaagttatgcaagacactatcaacgaatttggcggaaccccagaggagaatcgcatcacaatcgcaaatgtcgacctcgtgttatccaagggcaacgttgatgtcgctttgaacatgctccggaatatactccccaagcagtcatgctacatggaggcccgagagaagatggcaaatatttacctccaaactctgagagaccggaggttgtacattcgatgctacagagaactctgtgaacaccttcccggaccacacaccagcttgctgcttggcgatgctcttatgtcgatcctcgagcctgagaaggccctggaggtgtatgacgaggcctatcggcagaacccacacgacgcctctctagccagcaggattggacacgcttatgttaaggcacatcagtacacagaagctatcgagtattacgaggcagcccagaagattaatggccaggatttcctgtgttgtgaccttggaaaactactgctgaagctgaaaaaggtgaacaaagcagagaaggtgttgaaacaggccctcgaacatgatattgtgcaggacatcccctcaatgatgaacgatgtgaaatgtctgctcctgctggccaaggtgtacaaaagccacaagaaggaagctgtgatcgagactctcaacaaagctctggacctgcagtctaggattctgaaacgggttccactggaacagcccgaaatgatcccatcccagaaacagttagcagcctctatatgcatccagttcgcagagcactacttggccgaaaaggaatacgataaggccgtgcaaagctataaggacgtattcagttatctgcccactgacaataaggtcatgctggagttggcacagctgtacttgctccagggacacttggatctgtgtgaacagcactgcgccatactgctacagaccgagcaaaaccacgaaaccgctagcgtgcttatggccgaccttatgttcagaaagcagaagcacgaggcagccattaatctgtaccatcaggttctggagaaagctccagacaattttctggtcttgcacaaactgatcgatctgctgagaaggtctggcaaactcgaagacattcccgcattttttgagctggccaagaaggtttccagccgggttcccctcgagcccggttttaactactgccgcggaatctattgctggcacatcggccagccaaatgaggcccttaagttcctcaataaagccaggaaggactcgacatggggacaaagcgccatttaccatatggtgcaaatttgcctgaatcccgataatgaagtggttggcggagaagcattcgaaaaccagggcgctgagagcaactacatggagaaaaaggagcttgaacaacagggcgtgtctactgccgagaagttgttgagggagttctatccccactcagactcgtcgcagacccagttgcgattgctgcaggggttgtgtaggctggctactagggagaaagctaatatggaggcagcacttgggtccttcatccagatcgcgcaggctgaaaaggacagtgtgccagccctcctggccctcgcgcaggcctacgtctttctgaaacagatccctaaagctaggatgcagctgaaacgcttggcaaagacaccctgggtcctgtccgaggccgaagacttggagaaatcctggctccttctcgccgatatctattgtcaggggtccaagtttgacttggcgctagagttgctgaggagatgcgtccagtataataaaagctgctataaagcatacgagtacatgggtttcataatggagaaagagcagtcatataaggatgcggtcaccaactacaagctagcctggaaatatagccatcatgccaaccccgcaatcggctttaaattggccttcaattatcttaaagacaaaaagttcgttgaggccatcgagatctgtaatgatgtcttgcgcgagcacccggattacccaaaaatcagggaagagatcctagagaaagcgaggagaagtcttagaccctag

SEQ ID NO: 60201 - DNA, 3963 bp, Artificial Sequence
  Description of Artificial Sequence: Synthetic coding sequence
atgtcaagtaacgatagctctctcatggcgggaattatttactattcgcaagagaaatattttcaccacgtgcaacaggcagcggctgtggggctcgaaaagttttccaacgaccccgtgctcaaatttttcaaggcttacggcgttctcaaggaggagcacattcaggatgcgatctcagacctcgaatctattaggcatcacccggacgtttctctgtgttcaacaatggcactcatttacgctcacaagcgatgcgaaatcatcgacagagaggcaattcaagagctagaatacagcctgaaggaaattcgcaaaacggtatctggcactgccttatactatgctgggctgttcctatggttgatcggtcgccatgacaaagccaaagaatatatagataggatgctgaaaattagtaggggatttcgggaagcatacgtgctgagaggatgggtggatcttacgtctgataagccccatactgccaagaaagctatcgagtatttggaacaggggatccaagatacaaaggacgtactggggctgatgggcaaggcaatgtatttcatgatgcagcagaactatagcgaagccctggaagtagtgaaccagatcacagtgactagcggttccttcctccccgctcttgttttgaaaatgcagctgtttttggctcggcaagattgggagcagaccgtggagatgggccaccggatactcgagaaagacgagtccaacattgacgcttgtcagatcctgaccgtgcacgagctggctagagagggtaatatgaccactgtctcttcactgaaaactcagaaggccaccaaccatgtgcgtaaccttatcaaggctttggagacacgggagcccgaaaatccttcattgcatcttaagaagatcattgtagtctctcgcttgtgtggttctcatcaggtcatactgggcttggtgtgcagtttcatagagagaacctttatggcgaccccatcctacgtgcacgttgccaccgaactcggctacctgtttatcctgaagaaccaggtgaaagaagctctcttgtggtattcagaggcaatgaagctagataaagacggcatggctggtctgactgggattattctgtgtcacattctggaggggcatctggaggaggcggaatacagactcgagtttttgaaagaggttcaaaagtcgttgggcaagtccgaggtgttaatcttcttacaggcactcttgatgagcaggaaacacaaaggggaagaggagaccacggctcttcttaaggaagccgtcgaattgcactttagttctatgcaagggattcctttgggcagcgagtatttcgaaaaactggacccctacttcctggtctgcattgccaaagagtatctgttgttttgtcctaagcagcctagattacctggacaaatagtgtcacccctcttgaagcaggtggcggtcatcctcaaccctgtcgtaaaagccgcacctgctctgattgatccactgtatctgatggcccaggtcaggtactatagcgagcttgaaaatgcccagagcatcctgcaacgctgtctggagctggacccagcctccgtggacgcacatctgctgatgtgccaaatatatttggcccaaggcaatttcgggatgtgcttccattgcctggaacttggcgtcagtcataacttccaggtcagagaccacccgttgtaccatctcattaaagccagggccttgaataaggccggagattatcccgaagccatcaagaccttaaagatggtgatcaaattgccagctcttaaaaaggaggaaggacgaaagtttctgcgcccaagcgtgcagccttcccaacgagccagcatccttctggaactcgtcgaggccctacgactcaatggtgaactgcacgaggcaactaaggtgatgcaggatacaatcaacgaattcgggggtaccccggaagagaatagaataacaatcgcgaacgtcgatcttgtcctaagcaaaggcaacgttgatgttgctcttaacatgctcagaaatatccttcctaaacagtcgtgttatatggaggctcgagagaaaatggctaatatctatctgcaaacactgcgcgaccggagactttacataagatgctatagggagttgtgcgagcatttacccggaccccacacatccttactcctcggtgatgcattaatgtccatattggaacccgagaaggccctggaggtgtacgacgaggcgtacaggcaaaacccacacgatgcttccctcgcttccaggataggtcacgcatacgtcaaggctcaccagtacactgaagcaatcgagtattacgaagctgctcagaagatcaacgggcaggatttcctttgctgtgatctcggaaagcttctgctgaaactgaaaaaagtgaacaaggcagagaaggtcctcaaacaggcacttgagcacgatattgtccaggatatcccttctatgatgaatgacgtgaagtgcctgctcctgcttgccaaagtctacaaaagccacaaaaaggaagcagtgatcgagacccttaacaaagccctggacctccaaagcagaatactcaaacgggttcccttggaacagccggaaatgatacctagtcagaagcagctggcggcaagcatttgcattcagttcgcggaacattatctggcggagaaggaatacgacaaagctgtccagagttacaaagatgtgttctcatatctgcctacggacaataaagtgatgttggagctggcccagctgtacttgctgcagggccacttagatctgtgtgaacagcattgcgccatcctcctgcagaccgagcaaaaccatgaaacagcttcagtgttaatggcagatctcatgttcagaaagcagaaacacgaggctgccataaacctgtatcaccaagtgctggaaaaggccccagacaatttcctggtccttcacaaactgatcgatttactgcggaggtcagggaaattagaggatatccccgctttctttgagctggcaaagaaagtgagcagtcgcgttcccctggagcccggtttcaattattgtaggggaatctactgttggcacattggccagcccaatgaagctctgaagttcctgaataaggccaggaaggactctacatgggggcaatccgcaatctaccacatggtgcagatttgcttgaaccctgacaatgaggtggtagggggagaagcattcgagaatcagggggcagaatctaactacatggaaaaaaaagagcttgagcagcagggggtcagcacagccgagaagctcctgcgggagttttacccgcactctgactcttcccaaacccagctccggcttctgcagggcctctgccggttagcaacgagagagaaagcaaatatggaagcagcactggggtcattcatccagatagctcaggcagaaaaggacagcgttcctgccctgctggccttagctcaggcctacgtgtttttaaaacagattccaaaggccaggatgcagcttaagcgcctagccaaaactccctgggtgctgtctgaggccgaggatctcgaaaaatcttggctgctccttgctgacatttactgccagggatccaagttcgacctggccctggagctgctcagacgatgcgtgcagtataataagtcctgttacaaagcttacgaatatatggggttcatcatggagaaggaacagagttataaggatgcagtgacaaactacaagcttgcctggaagtacagtcaccacgccaatccagctataggtttcaagctggccttcaattatttgaaagacaaaaaattcgtggaagcaatcgaaatatgtaatgacgttctccgggagcatccagattacccaaaaatccgggaggaaattctggaaaaagcccgacgctcccttagaccatag

SEQ ID NO: 60202 - DNA, 3819 bp, Artificial Sequence
  Description of Artificial Sequence: Synthetic coding sequence
atgtcttctaatgactccagcctgatggctggcattatctactactcccaggaaaagtactttcatcacgtacagcaggcagctgccgtgggtctagaaaaattttccaacgatcccgtcctcaaatttttcaaagcttatggagtcctcaaagaggaacatatccaggatgctattagtgacctcgagtctataagacatcaccccgatgtgagtctttgttccactatggcacttatctacgctcacaaacgctgtgaaattattgatcgtgaagcaattcaagagctcgaatacagcttgaaggagattaggaaaacagtgtcaggcacagcgctatactacgctggcctgtttctgtggctcattggaagacacgacaaggcgaaagagtacattgacaggatgctaaagatatctcgagggttccgcgaagccatgtacttcatgatgcagcagaactactccgaggctctggaggtcgtaaaccaaattaccgtgacttcgggctcattcttgcctgctttagtgctgaaaatgcagctgttcctggccaggcaggactgggagcaaacagtcgaaatgggccaccggatcctggagaaggacgagtcaaacatcgacgcctgccagattctcacagtgcacgagctcgcccgagaaggaaatatgactactgctacaaaccacgtgcgtaaccttatcaaagcattggagacccgcgagccagagaacccaagcttacacttgaaaaaaataattgtagtcagccggctgtgtgggtcccaccaggtgatcctgggactggtgtgcagtttcatcgagagaacgtttatggcaactccgtcgtacgtacatgtagccacggagttgggatatctgtttatcctaaaaaatcaagtgaaggaagcgctgctgtggtattctgaggcaatgaagctggataaggacggcatggccggactcaccgggattatcctctgtcatatcctggaagggcacttggaggaggccgagtaccgactcgagtttctgaaggaggtgcaaaaaagcctcggtaaatctgaggtgttgatatttctacaagcgctactgatgagccgaaagcataagggggaggaggaaaccacggctctcctgaaagaggcagtcgagttacattttagttcaatgcagggaattcccttgggatctgagtactttgaaaaactggatccttatttcttagtgtgtattgcgaaagagtacctacttttttgtccaaagcagccaaggctccctggccaaattgtgagccccctgctgaagcaggtcgccgtgatcctcaatccagtcgtgaaggccgcacccgcactgattgatcctttgtatctgatggcgcaagtgcgttattattccggggaattggagaatgcccagtccatcctgcagcgctgcctagagttggacccggctagcgttgatgcacatttactgatgtgtcaaatctatctggctcaaggtaacttcggcatgtgcttccactgcctggaacttggagtcagccacaattttcaagtgagggatcatcctctctaccacctcatcaaggccagagcccttaataaagccggagactacccagaggccatcaaaaccctgaagatggtgatcaagttacctgccctgaaaaaagaagagggcagaaagtttctgcggccaagcgttcagccatcccagagggctagcattctgcttgagttagtggaggctctgcggctgaacggagaactacacgaggccaccaaggtcatgcaagatacaataaatgagttcggcggaactcctgaggagaaccgcatcaccatagcgaatgttgatctcgtgttgagtaagggcaacgtggatgtggccctgaacatgctgaggaacattctgccgaagcagtcttgctacatggaggccagagaaaaaatggcaaacatttatctgcagactctcagagatcgcaggctctatatcaggtgctacagagaactatgtgaacatctgcccggaccccacacatcactgttgttaggggacgcattaatgtcaatcctcgagcctgagaaggccctggaagtgtacgatgaggcttatcggcaaaaccctcacgacgcctccctagcatcaagaatcggccacgcgtatgtgaaagcccaccagtacactgaggccatcgagtattacgaggccgctcagaaaatcaatggccaggactttctttgctgcgatctggggaaattgttgctgaagctgaaaaaggtgaacaaggctgagaaggtccttaaacaggccctggagcacgacattgtgcaggacataccaagcatgatgaacgacgtaaagtgcctgttactactcgccaaggtgtacaagagtcacaaaaaggaggcagtcatagagactctgaataaagctctcgatctgcagagcaggatactgaagagagtgcccctcgaacagcctgagatgatcccctctcagaagcagcttgcagcctctatttgtattcagttcgcagaacactatctggcagaaaaggaatacgataaagcagtccaatcttataaagacgttttctcctatctgcctactgataataaggtgatgctcgagctggctcagctttatcttctgcagggccacctcgatctgtgcgagcaacactgtgctatactgctgcagacagaacagaatcatgaaaccgccagcgttcttatggccgatctgatgttccggaaacagaaacacgaggctgcgatcaacctgtatcaccaagtactcgagaaagcacccgacaactttcttgtgctgcacaagttgattgatctgttacgacgctcaggaaagctggaggatatacctgcctttttcgagctggccaagaaagtttccagccgagtgccacttgagccaggattcaattattgccgcggtatctattgctggcatattggtcagcccaatgaagccctcaagttcttgaacaaggccagaaaagattccacctggggccagtccgccatttaccacatggtccaaatttgcttgaatcccgataacgaggtcgtgggtggcgaagcattcgagaaccagggtgccgagtccaattacatggaaaaaaaggagctggaacagcagggagtcagcactgctgaaaagctgctgagggagttctacccacatagcgatagcagccagacccagctaagactgctccaagggttgtgccgtctcgccacccgcgagaaagccaacatggaggctgcactaggctcatttattcagatcgctcaagcagagaaggactctgtaccagcacttctcgccctggcgcaggcatacgtcttcctaaagcagataccaaaggcaaggatgcagctgaagcgcctagctaagaccccatgggtactgtcagaagctgaagacctggaaaagtcctggcttctcctggcagacatctactgccaaggctccaagttcgatctggccttagagctgctacgtcgatgcgtacagtacaacaaaagctgttacaaggcatacgaatatatgggattcattatggaaaaagagcagagctataaggatgcagtgaccaattacaaactggcttggaagtacagccaccatgccaaccccgctatcggatttaaactagctttcaactatctcaaggataaaaagttcgtcgaagcaatagaaatctgtaacgatgtactgcgcgagcatcccgattacccgaagattcgagaggaaattttggaaaaggcaaggagatccctgcgcccttag

SEQ ID NO: 60203 - DNA, 1119 bp, Artificial Sequence
  Description of Artificial Sequence: Synthetic coding sequence
atggcagagttggaggctgtcgcagacgaccttgacgcactgattgacgatctcgactatttacccggtcacttccacttagagatgcagcttaattttgagcctcgcagcccagcccctcaaagggcccgtgacctaaaattacagcgagaggggctcaggcaagagttgcagctggccgcagctcctcaacgcccagcggtgcgccatctcctcggcgcattcgcattctacctcgaggagcttgatgaagctcgtgaatgttttctcgaggttgcacacgaacacccgggaaatctgaacgcatgggcgaacctcgctcacgtatacgggagactgggtcaggaagaggaggaggaggcgtgcgctgccaggttggccgaccttatgggactagctgaagaacccgaggccgctggtgacccccaactgagggctgctcggtgtctggccgaacagggctacgcccacgggttcgatgtgggctgtgcctctcccgaggagagggccagagggctggcagccggaatcgccctgtatgacaaggcgcttggctatggacagcagatccccatggaggagaagagggggtggtatttcacaatggccacattatatatcaggttggacgggattttccttgagcttgggtccgaggagcagaaaagactgcccgctttcaatcgcacccttgccctgctccgccaggtcttaaagagtgaggatcctcgacatagagctctcgcctggtgttatttgggcatgttgttggagaggaaagacactttctccaccacccccatgggagttcacgattgcggatactccggcaccgatcctctggattgctttggcaaagccatcgaaatcgctaaaaaccagccaccaattctgaaccgcctggcaaaaatcttttacttcctgggaaaacaggacatggcaatcggtacttgtaacatggccctggacgtgctgcgggatccggaattgaattggcaggcctattgcacgcgggcaaagcgcaggggcctgacgatgttaccgcgattggtgtccaactcttgggcacaggccgtactcccccctcgccctcccaaagttctggagtttcaggtctag

SEQ ID NO: 60204 - DNA, 1710 bp, Artificial Sequence
  Description of Artificial Sequence: Synthetic coding sequence
atggctgagctggaggccgtcgctgacgacctggatgccctcatcgacgatttggactacctgccaggtcacttccacctcgagatgcagctgaattttgagccacgatctcccgcacctcagagagcccgagacctaaagctgcaacgggagggactcagacaggaactgcagttggccgcagctcctcagagaccagccgtgcgacatttactgggagcgttcgctttttatcttgaagaactcgatgaggcacgggagtgtttcctggaggtcgcacacgagcaccccggaaatctgaacgcttgggccaaccttgcacatgtttacgggagattgggccaagaggaagaggaggaggcttgtgctgccagactggcggacttgatggggcttgctgaggaacctgaagctgcaggagatccccagctgagagccgcaaggtgtttggctgagcagggctatgcacacggatttgatgtgggatgcgccagccctgaggagcgggcaagaggcctggccgctggcatcgccctgtatgacaaagcactgggctacgggcaacagatccctatggaagagaaaagaggttggtatttcaccatggctactctctacattcgtctcgacggtatttttctggagctgggaagcgaagagcagaaacggttacctgcatttaatcggaccctggccttgcttcgacaagtcttgaaatctgaggaccctcgccacagggctttggcttggtgctacctgggtatgttactcgagcgcaaggacactttctcaactacccccatgggagtacatgactgcggctactctggcactgatcctcttgattgtttcggaaaggcaatcgagattgccaaaaatcagccccctattctgaaccggctggccaagattttctatttcctggggaagcaggacatggcaattgggacatgcaacatggcactagatgtgctcagagaccctgaactgaattggcaggcatattgcacacgtgctaagatccatattagggcttatctacacgacttaaaacgcgcaaagatgggactgggtggtatgcctgatcggaaccatttagcatgtgccaaagctgaccttgaggaagtagtcagagtatgtccagggttcaaagcttaccttgacattggacaggtttactactacatgggcgtggatgctgtgcaggagctgctggccgttgatgaggcagctttaaaccaggctctggtgtttctggcgaaggctggcgagtcagaactgggggcaactctccccgagctccagttactgagaggaaaatgcttacgtatcaagggcgaggacgccaacgccgctgcctgtttcaaaagggctgtagaactggatgacgccggtagttcccacacagacgggttcggctgcttgctggaggcgttattagctcagtggtctcaggcccaactgtccgatggtgagctaggacgagaggtggacgcatggctgaggcgagctcaggataagtatccggcagccaggctccgacaggagctccaaagagtgtggcgcggtcacacggatgaagttctgggtttggctcgcgctctcgttgctcaaggtagacccgctttggtacgtctcctgtttgaaaccatggaaagagaaggtgaaggggcttccgccccaagggacagacgtgccgtgagcttctag

SEQ ID NO: 60205 - DNA, 1344 bp, Artificial Sequence
  Description of Artificial Sequence: Synthetic coding sequence
atgcaggagtcccaggagactcacatatcaaaccatctcgacgaagttgtcgctgctgtttcaattacacataggaagaagttccaaaataaactgctgcagaccgcgctgttccagccaccgagggaaaagctgcatctttgcgaagagaaagccaaatcatattccaattcccacgaatacaaacaggcagtacacgagctcgtcaggtgtgtcgccctgacgagaatctgttatggcgacagtcactggaagctggcggaagcgcatgtcaacctcgctcaggggtatttacaattgaagggtctttctctccaagcgaaacagcacgccgaaaaagccaggcaaatccttgcgaacagtattgtgcccccttactccgagaacaccgacgtctttaagttctcgattgagctcttccacaccatggggagagccctcttaagtttgcagaagtttaaagaggccgctgaaaacctgacgaaggcggaaaggttatcaaaagaactcctacagtgcggcagaatcatcaaagaggagtggatcgagattgaggccaggattcgactcagctttgcccaggtttaccaaggccagaaaaagtctaaggaagcactgtctcactaccaggccgctttggagtacgtcgagatttcaaagggggaaactagccgagaatgcgtgcccatcctgcgcgaacttgcaggggtcgagcaggctctgggtctccacgacgtgtctattaatcactttctgcaggcccatctgatcattctgagccggtcaccgtcgcaagttgaagctgctgacagcgctcacatcgttgcgcacgcggcagtagcgtctggacgccacgagcatcacgacgtggcggaacagtattttcaggaatccatggcccaccttaaggattcagagggcatgggcagaaccaagttcctgtcaatccaggacgagttctgccattttcttcaaatgaccggccaaaaggagcgggcaactagcatcctgagagaatccctcgaagccaaagtggaagcgtttggagacttctctccagaggtggcagaaacatataggctgttaggcggagccgacttggcccaggggaatcactccggcgctcgtaaaaaacttaagaagtgtctgcagattcagaccctgctctatggtccgcaggacaagaggacactggctacgcagcaagccatgggaatgctgagtaccgcaccaaaggtcgcttctaagcctaggcaggcatccaaggccaaggtcgctttttgcaccagcatcccccaggacacgctcttaggcaaagcacgccctggtactaccgcagactag

SEQ ID NO: 60206 - DNA, 1182 bp, Artificial Sequence
  Description of Artificial Sequence: Synthetic coding sequence
atgcaggaatcgcaggaaacccacatctctaatcacctggatgaggtcgttgcggcagtttccattacacaccgcaagaaatttcaaaataaactgctgcaaactgcgcttttccaaccccctcgcgaaaaactccatctgtgtgaggagaaagcgaagtcctactctaacagtcatgaatacaaacaggccgtgcatgaactggtccggtgcgttgcacttaccagaatttgttatggggatagccactggaagcttgcagaggcacacgtcaatcttgcacaagggtatctccagctcaagggtctgtctctccaagctaagcagcacgccgagaaagccagacagattttagccaattcaatcgtcccgccatactcagagaacactgacgtgtttaagttttctatagaactcttccacacaatgggccgtgcacttttgtcccttcaaaagtttaaggaggccgctgagaacttgacaaaggcagaaagattgagcaaggagctactgcagtgtggtcgcatcatcaaggaggagtggatagagatcgaggcgaggattcgactaagttttgcccaggtgtatcagggccagaagaaaagtaaggaggctttatcacattaccaggctgcactcgaatatgttgagatatctaagggggagacttctcgggagtgcgttccaatcttgcgcgagctggccggtgtggagcaggctttggggctacatgacgttagtattaatcatttcctgcaagcgcacttaattatcctgagccgcagccccagccaagtggaggccgcagactccgctcacatcgttgctcacgccgctgtggcctcagggcgacacgaacatcatgatgtggcggagcagtattttcaagagtctatggcccacctgaaagattctgaggggatgggtcggaccaaattcttgtccatacaagacgaattttgccattttctgcagatgaccggacagaaggaacgtgctacttcaattctgcgggaaagcctggaagccaaagtagaggccttcggggatttctcacccgaggtggcagagacctaccggctgctcgggggtgccgacttagcccaagggaatcatagtggcgcacggaaaaaactaaagaagggcgacctgagcttcctactcagcgctaccttaccctag

SEQ ID NO: 60207 - DNA, 1344 bp, Artificial Sequence
  Description of Artificial Sequence: Synthetic coding sequence
atgcaggagagccaggagacgcatattagtaatcatctagatgaggtggtggccgctgtgagcatcactcacaggaagaaattccagaataagcttctgcaaactgccctgtttcagccaccccgtgaaaaactgcacctttgcgaagaaaaggctaagagttatagtaatagtcacgagtataagcaggcagtacatgaattggtgaggtgcgtcgcattgactcggatttgctacggagatagccactggaaactagctgaagcacacgtgaacctagcccaaggttacctgcagctgaaggggctgtcactacaggccaagcagcacgcggaaaaggcccgacagattctggctaactccattgtgcccccatactctgaaaacacagatgtgtttaaattttctatcgagctgttccacaccatgggcagagctctgcttagtctccaaaagttcaaagaagcagccgaaaacctcacgaaggctgaaagactctccaaagagctcctgcagtgtggcaggatcataaaagaggagtggattgaaattgaggcccgtatccgcctgagctttgctcaggtctaccagggccagaaaaagagtaaagaagcactttcgcattatcaggcggctttggagtacgttgagatctccaagggcgagacatctcgggagtgcgtgcccattctgagggaactcgctggcgtagagcaggccctaggactacacgacgtgtcgattaatcattttctgcaagcccatctgattattctttccagatcccctagtcaggttgaagctgcagactccgcccatatcgtcgcacacgccgcagtcgcctctggcaggcacgaacaccacgatgtggctgagcaatattttcaggaatccatggcccatctcaaagatagtgagggaatggggcgaaccaaattcctatctattcaggacgaattttgccactttttgcagatgaccgggcagaaggagcgtgcaacatctattcttagggagagccttgaagctaaggtggaggcgtttggggacttttctcctgaagtggctgagacctacagattactgggcggtgccgacttggcccaggggaatcactcaggagctagaaagaagctgaaaaagtgtctgcagattcaaaccctgctctacgggccacaggacaaaaggaccctagccacccaacaggcgatgggtatgttaagcaccgcccctaaagtcgcttcgaaaccccgtcaggcatctaaggcaaaggtggccttctgtacctccataccccaggacaccctgctaggcaaagctcggccaggtacaaccgctgactag

SEQ ID NO: 60208 - DNA, 1344 bp, Artificial Sequence
  Description of Artificial Sequence: Synthetic coding sequence
atgcaagagtcgcaggagactcacatcagcaatcatctggatgaggtcgtggcggctgtgtctataacgcatagaaagaagttccagaataaactgcttcaaaccgcactgttccagcctccaagggagaagcttcacctgtgcgaggagaaggcgaaaagctactctaattcacacgaatacaagcaagctgtacacgagctcgtgagatgcgttgccttaacaagaatctgttacggcgactcacactggaagctagctgaggcccatgtgaatctcgcacagggctatctccagctgaagggactttccctgcaagcaaagcagcatgctgagaaggcaagacaaattctcgccaactcgatcgttcccccttactcagagaatacagacgtcttcaaattcagtatcgaactgttccacactatgggcagggcactattgtctctgcaaaaatttaaagaagcagcagaaaatctcactaaagctgagaggttgagcaaggagttgctccaatgcggacgcatcatcaaagaggaatggattgaaatcgaagccagaatcagactgtccttcgcccaggtttatcaagggcagaagaaatctaaagaagctctgtctcactatcaagccgctcttgagtacgtagagatctctaagggggagacctctcgggagtgtgtgccaatcctcagagagcttgcaggagtggagcaagccctgggcctgcacgacgtcagcatcaatcacttcttacaagcccacctcattatcctttcaagatctccctctcaggtcgaggctgctgacagcgcccatatcgttgcgcacgccgctgttgcctcgggcagacacgagcatcatgacgtggccgagcaatactttcaggaatccatggcacacctgaaagatagcgagggtatgggcaggaccaagtttctatcaatccaggacgaattttgtcatttcttgcagatgaccggacagaaagagagagccacatcaattctacgagagtctttggaagctaaggtagaggctttcggagactttagccccgaagttgccgaaacttaccgtttattggggggtgctgatttggctcagggtaaccattcaggggcacgcaaaaaactgaaaaaatgcctacagatacagaccttgctgtatgggcctcaggataaaaggacgctggccacgcaacaggctatgggtatgctgagcactgcaccaaaggtggcctcaaagcctcgtcaggcaagcaaggcaaaggtagcattctgcacttcgatcccccaggacacattgctaggaaaagctaggccagggaccacagccgattag

SEQ ID NO: 60209 - DNA, 1344 bp, Artificial Sequence
  Description of Artificial Sequence: Synthetic coding sequence
atgcaagagagccaggaaacccacatctccaaccatcttgatgaggttgtcgccgcagtgagcattacgcaccggaaaaaattccagaacaaactgctccaaaccgctctcttccaaccacccagagagaagttgcatctatgtgaagagaaagcaaagtcatactccaatagccacgaatacaagcaagccgtccacgaactcgtgcgttgcgtggctctgactcgtatctgttatggtgactcccactggaagcttgcagaagctcacgtgaacctggcccaggggtatttgcagttgaaaggactgagcctccaggccaagcaacatgctgagaaagctcgccaaattttggccaactctatagttcccccatactccgagaataccgatgtctttaagttctcaatcgagctgttccatacaatgggtcgggcactactgagcctgcaaaaatttaaggaggcagctgagaacctgactaaggcggagcgcctctctaaggaactcctccagtgtggtagaatcattaaggaggagtggatcgagatcgaggccagaatcagactcagtttcgcgcaggtgtaccagggccagaagaagagcaaggaggccctgagtcactatcaggcagcccttgaatatgtggagatatcaaaaggagagactagccgagaatgtgtgcccatactgcgggaactcgctggcgtcgaacaggccttggggctgcacgatgtaagcatcaatcatttcttacaggcccacctgattatcctctccagatccccttcccaagtggaagcggctgactccgcacacatcgttgcccatgcagcggttgccagcgggagacatgaacaccatgacgtcgcagagcagtattttcaggaatcaatggcccacttgaaggacagcgaggggatggggcgtactaagttcttgagcatccaggacgagttctgtcactttttgcagatgacgggacagaaggaaagagctacttccattctgcgcgagtctttggaggcaaaagtggaagcgttcggggatttttctccagaggtcgccgagacttaccgcctcctgggaggtgctgaccttgctcaggggaaccactccggggctagaaagaagctgaaaaaatgcctgcagatacaaacactgttatacggaccccaggacaagaggacacttgcaacgcagcaggcgatggggatgctgtccacggcgccaaaggttgcttccaaaccgaggcaagcttccaaggccaaggtggctttctgcacatctattcctcaggacaccctgctcggaaaggcgaggccaggcaccacggccgattag

SEQ ID NO: 60210 - DNA, 171 bp, Artificial Sequence
  Description of Artificial Sequence: Synthetic coding sequence
atgcaggagagccaggagactcacatcagtaaccatctggatgaggtcgtggcggctgtgtctatcacacaccggaaaaagtttcagaataaactgctgcagaccgcactgttccagccaccgagagaaaagctccacctgtgcgaggagaaagcgaaatcttattcatag

SEQ ID NO: 60211 - DNA, 1344 bp, Artificial Sequence
  Description of Artificial Sequence: Synthetic coding sequence
atgcaggagtcacaggagacacacatctctaaccacctcgacgaagttgtcgctgcggtgtccataactcataggaaaaaatttcagaataagttgctgcaaacggctcttttccagcctcccagagaaaagctccacctgtgtgaggaaaaagccaaatcctactcaaactcccacgagtacaaacaggccgtgcacgagctcgtgaggtgtgtggctttgactcggatttgctatggagacagccattggaaactcgcagaggcgcacgtaaatctggctcaaggttacttgcaactcaagggcctgtcactgcaggccaaacagcacgccgaaaaggcgagacagattctggcaaacagcatagtcccaccgtactccgagaatacagacgtgttcaagttttctattgagctcttccataccatggggagagcgttgctttctctgcagaaattcaaagaggcagcagaaaacttaaccaaagccgagcggctcagcaaggaactgctccagtgcggtagaataatcaaggaggagtggattgagatcgaggcacgcattagactgtctttcgctcaagtttatcaaggacaaaaaaagtccaaggaggctctgtcacactaccaggccgctctggaatacgtggagatttcaaagggcgagaccagccgtgaatgcgttcccattctgcgggaattggcgggtgtagaacaagccctgggacttcacgatgtctcaattaaccatttcctccaggcgcacctcatcatcctgagccgcagccctagtcaggtggaggccgctgactccgctcacattgtggcccacgccgcagtcgcctccggccgtcatgaacatcacgacgtcgctgagcagtactttcaggagtctatggcacatttaaaggacagcgaaggaatgggaagaacgaagttcctctccattcaggacgaattttgccattttctgcagatgacggggcagaaggaaagggccacctcaatactcagagagtcgctggaggccaaggtggaggcattcggggacttcagccctgaggtagcagaaacataccgactgctcggaggggctgacctcgcgcagggaaatcattctggcgcacgaaagaaacttaagaaatgcttgcagatccagaccctgctgtatgggcctcaagataagaggaccctggccacccagcaggcaatgggtatgctgagtaccgctcccaaggtagcctcaaagccaaggcaggcatcaaaagcgaaagttgccttttgtacaagcattcctcaggacactttgctgggaaaggcgagaccaggtaccaccgcagactag

SEQ ID NO: 60212 - DNA, 1344 bp, Artificial Sequence
  Description of Artificial Sequence: Synthetic coding sequence
atgcaggaatctcaggagacccatatttccaatcacctagatgaggtagtggccgcagtgtcgatcacccaccgaaagaagttccagaataaacttctccaaacagctctgtttcagccccctcgcgagaagctacacctttgcgaagagaaggccaagagttattcaaacagccacgaatataaacaggctgtccatgagctagtcaggtgtgtggctctcactaggatctgttatggcgactcccattggaaactcgcagaggcccatgtgaacctggcgcagggctacttgcagctgaaaggcctctctctgcaggcaaagcagcacgcagagaaggcacgacaaatcctcgcaaattctattgtccccccatatagcgagaataccgatgtttttaagttcagtatagaactctttcacactatgggacgcgctcttctgagtctccagaaattcaaggaagcagccgagaacctgaccaaggccgagagactgagtaaggaactgttacagtgtggacgcatcatcaaagaggagtggattgaaatagaggcaagaatcaggctttccttcgcacaggtataccaaggtcagaaaaaatcgaaagaagctttgagccattaccaagctgcgctggaatacgttgaaatctccaagggcgagacctccagagaatgtgtgccaattttgagggagctagcaggcgtggagcaggccctgggactgcacgacgtgagcataaaccattttcttcaggcccatttaatcatactgtcccggtctccttcacaggtcgaagccgcagattcggcccatattgtagcgcatgccgcagttgcatccggaaggcacgagcaccatgacgtggccgaacagtacttccaggaaagcatggcccatctgaaagactccgagggtatgggaaggactaaatttctcagcatccaggacgagttttgccacttcttacagatgactgggcagaaggagcgggctactagcattctgagggaatctctcgaagcgaaggttgaggctttcggcgacttctcccccgaagtggcagagacttaccgtttgctaggcggtgcagacctggcccaagggaatcactctggcgctcggaagaaattgaagaaatgtctgcagatccaaaccctgctgtacgggccacaggacaaacgcaccttagcgactcagcaggcgatgggaatgctgtccactgcacccaaggttgcaagcaaaccacgccaggcctcgaaagccaaggtcgctttttgcacctccattcctcaggatacgctactcgggaaagctcgaccgggaacaaccgccgattag

SEQ ID NO: 60213 - DNA, 162 bp, Artificial Sequence
  Description of Artificial Sequence: Synthetic coding sequence
atgcaggaaagccaggagacacacatctccaatcacttggacgaggtagtggctgcggtgtccataactcacaggaagaagtttcaaaataagcttctccagactgcgttatttcaaccccctagagagaaactgcacctctgtgaggagaaagctaagtag

SEQ ID NO: 60214 - DNA, 456 bp, Artificial Sequence
  Description of Artificial Sequence: Synthetic coding sequence
atgcaggaaagccaagagacccatatcagcaatcacctggatgaagtggttgcagccgttagcatcacgcacaggaagaagtttcagaacaagctgttacagaccgccctgtttcagccccctcgggagaagctccacttgtgcgaggagaaagcgaagtcatacagcaattcacacgaatacaaacaggccgtacacgaactcgtgaggtgcgtggccctgaccaggatctgttacggcgacagccattggaagctggccgaggcccatgtgaacctcgcccagggctacctgcagctgaaaggtctatcgcttcaggccaaacaacacgccgagaaggccagacaaattctagcaaattcgatagttcctccctactccgaaaacaccgatgtcttcaagttttcaattgagttgttccacactatgggcagagctctactctcactgcaatag

SEQ ID NO: 60215 - DNA, 252 bp, Artificial Sequence
  Description of Artificial Sequence: Synthetic coding sequence
atgcaagagtcccaggagacacacatcagcaaccacttagatgaagtcgtcgcggcagtctctataacccatcgcaagaaatttcagaacaaactactccaaactgcactatttcaacctccgcgagaaaaactccatctttgcgaggagaaggccaaaagctactctaattcccacgagtacaaacaggccgtccatgagctagtgcgctgcgtggctttaacccgcatctgttacggcgactcacattag

SEQ ID NO: 60216 - DNA, 348 bp, Artificial Sequence
  Description of Artificial Sequence: Synthetic coding sequence
atgcaagagtctcaggaaacacacatttccaaccatcttgacgaagtggtcgcggctgtgagcattacccatagaaagaagtttcaaaataagctgctacagactgccctgttccagcctcccagggagaaactgcacctttgtgaggaaaaggccaagagttactcaaatagccacgaatacaagcaggccgtgcatgaattagtccgctgcgtggccttaacacgtatatgttacggtgatagccactggaaactggccgaggcccacgtgaaccttgcacagggctacctgcagttgaagggactgtccctgcaggcaaaacagcacgcagagaaagcaagatag

SEQ ID NO: 60217 - DNA, 474 bp, Artificial Sequence
  Description of Artificial Sequence: Synthetic coding sequence
atgcaggagagtcaggaaacacacattagtaatcatcttgatgaggtagtagctgctgtcagcattactcatagaaaaaagttccagaataaactcctccagactgctctctttcaacccccaagggagaagttgcacttatgtgaagagaaggccaaaagttacagtaactcacacgaatataaacaggccgttcatgaattggttcgctgcgtggccttgacccggatatgttatggtgactcacactggaagttggcagaggcacacgtaaacctggcacagggatacctgcagctgaagggtttgagcctgcaggctaagcaacacgccgagaaagctcgacaaatcctcgcgaactccatcgtgccaccttactctgagaacaccgatgtctttaagttctcaattgaactgtttcacaccatggggagggctctgctgtctctgcagaagtttaaggaagctgcatag

SEQ ID NO: 60218 - DNA, 1344 bp, Artificial Sequence
  Description of Artificial Sequence: Synthetic coding sequence
atgcaggagtcccaagaaacccacatctcgaaccaccttgacgaggttgtggcagccgtatctattacccatcgcaagaaattccagaataagctgctgcaaactgcactgttccagccaccgagagaaaaactacacctttgcgaagagaaagccaaatcctacagcaattctcatgaatacaagcaggccgtgcatgaactggtgcgatgcgtcgcgttaacgcgcatctgttacggagattcacattggaagcttgccgaagctcatgtaaacctggcacagggatacctgcagctgaagggtctctctctgcaggccaagcagcacgccgaaaaagcaaggcagatcttggcgaactctattgtaccgccttattctgagaatacagacgttttcaaattctccatagagctgttccacaccatggggagagccctgctgagcctccaaaagttcaaggaggcagcggaaaacttgaccaaggccgaaaggttgtccaaggagctcctccagtgtggtcggattataaaggaggaatggattgaaattgaggcacggatacgattgtcctttgcacaggtgtaccaaggtcagaaaaaaagtaaggaagccctgtctcactaccaagccgcactggaatatgtggagatcagcaagggagaaacatccagagaatgcgtccccatcctgagagaactggccggagttgaacaggccctgggattgcatgacgttagtataaaccacttcctgcaggcccatctcatcattttaagtagatcacccagccaggttgaggcagccgactcagcccacatcgtcgcacatgctgctgttgcgagcggccgtcacgaacaccatgacgtcgcagaacaatactttcaggagagcatggcgcacctcaaggactcagaaggaatgggacgcacaaagttcctgtccatccaggatgagttctgtcacttcctacagatgacagggcagaaggagcgtgccacttctattctgagggagtctctcgaggccaaggtcgaagctttcggggacttttccccggaagtcgccgagacatacaggttgctgggcggtgctgatctggcacagggcaaccactcgggcgctagaaaaaagctgaagaagtgtctccagattcagacgcttctttatggaccccaagacaaaagaacactagccactcaacaggccatgggcatgttgtccactgctccaaaagtggccagcaagccgaggcaagcaagtaaagctaaggtggcattttgcaccagcatcccacaagatactttgctgggcaaggcaagaccaggtacaacagccgattag

SEQ ID NO: 60219 - DNA, 1344 bp, Artificial Sequence
  Description of Artificial Sequence: Synthetic coding sequence
atgcaggaaagccaggagactcacatttctaatcatctggatgaagtggtcgccgcagtgtctattacccatcggaaaaaattccagaataaacttttgcagacagctctgttccagccgccaagagagaagttgcacttgtgcgaggagaaagctaagagctattccaactcacatgagtataagcaggcagtacatgagctggtcaggtgtgtggctttgacccggatctgttacggcgacagtcactggaagctggcagaagctcatgtgaacctggctcagggctacctgcagctgaaaggcctttctctacaggcgaagcaacatgccgaaaaggcccgtcagatcctcgccaattctatcgtgccaccctactcagagaacacggacgtttttaaattctccatcgagctcttccacacaatgggccgagccctgctgtcactgcaaaaattcaaggaagctgctgaaaatctgactaaggccgagaggttatctaaagagctacttcagtgcggcaggattatcaaggaggagtggattgaaattgaagccaggatccgactttccttcgcacaggtctatcagggacagaagaagtctaaggaggccttatctcactaccaggccgctctcgagtacgttgagatttccaagggcgagaccagccgcgaatgcgtgcctatcctcagggagcttgcaggcgtggaacaggctctgggcctgcacgatgttagcattaatcacttcctgcaggcccacctgataatcctgtcacggagcccttcccaggtggaagctgccgattcggcacacattgtggcccatgctgccgttgcctctggaaggcatgaacaccatgacgtggccgaacagtacttccaggaatctatggcccatctgaaggacagcgagggaatgggtcggactaagttcctcagcatccaagacgagttctgccactttctgcagatgactggacagaaggaacgcgcaacctctatactgcgtgaatctcttgaggctaaggtggaggcctttggtgacttttcgccagaggtggcagagacttaccgactgctagggggagcagacctcgctcagggcaatcattctggagcccgtaaaaagcttaagaagtgccttcagatccagactctgctgtacggccctcaggataagaggactctcgccacacaacaggccatgggcatgttgagtacagcgcctaaagttgcctctaaacctcggcaggccagcaaagcaaaggtggctttttgtacttcgatccctcaggatactctcctgggcaaggccaggcctgggacgacagctgattag

SEQ ID NO: 60220 - DNA, 1344 bp, Artificial Sequence
  Description of Artificial Sequence: Synthetic coding sequence
atgcaagagagccaggagacgcatatctccaatcacctggacgaggtggtcgctgcagtgagtattactcatcggaaaaagtttcagaacaagctactacagacagcattattccagcctccgagggagaagcttcatctttgtgaggaaaaagccaagagttattccaattcgcacgagtataagcaggcagtgcatgagctcgtccggtgtgtggcgctgacaagaatctgctacggtgacagtcattggaaattggcagaggcccacgtcaacttagctcagggttatctgcagcttaaggggctatctctccaggccaaacagcacgccgaaaaagcccgacagatactggctaactctattgtgccaccttacagcgagaatactgatgtatttaaattcagtatcgaattgtttcacaccatgggaagagccctcttgagtttgcagaaattcaaggaggcagctgaaaacctgacaaaagcagaaaggctgtcaaaggaactgctccaatgtgggaggattataaaagaagagtggatcgagatagaggccagaatcaggcttagctttgcacaagtataccaagggcagaaaaagtccaaagaagccctaagccactaccaggccgcactcgagtacgttgaaatctccaagggagagacctctagagagtgtgtcccaattttgcgcgagcttgccggtgtggagcaggccctgggtctgcacgacgtttccatcaaccatttccttcaggcccacttgatcattctctctcgcagccctagccaggtggaagctgctgattctgcacacatagtggcgcatgctgccgtggcttcggggcgtcatgaacaccacgacgtggctgagcagtactttcaagaaagtatggcacatctcaaggattcagaaggaatgggacggacaaaattcctgtccatacaagatgagttctgtcacttcctgcaaatgaccgggcagaaggagcgggcaacaagcatccttcgagagtcgctggaagctaaagtcgaggcctttggagatttcagcccagaagtcgcagagacctaccgcctcctgggtggcgctgatcttgctcagggaaaccactccggtgccagaaagaaactgaagaaatgtctccagatccagaccttgttgtacggccctcaagacaaaagaactttagctacacagcaggctatggggatgctctctaccgcaccaaaggtagcctcaaagcctcgccaggcatccaaagcaaaggttgccttctgcacttcaattccacaggacacactccttggaaaggcacgtcccggaactacggctgattag

SEQ ID NO: 60221 - DNA, 1344 bp, Artificial Sequence
  Description of Artificial Sequence: Synthetic coding sequence
atgcaggaatctcaggaaacgcacatctctaaccatttggacgaggtggtcgctgcggtttccatcacacacaggaagaaatttcagaacaagctgctgcagacagccctcttccagcccccaagggagaagctccacttatgtgaggaaaaggctaaaagctactcgaattctcacgaatacaagcaagctgtacatgagctcgtccgatgtgtggccttgacccggatctgttacggggactcacactggaagctggctgaggcgcacgtgaatctcgctcagggatatctccagttaaagggactttctttgcaagctaaacagcacgccgagaaggcccgtcagatcctcgcaaacagtatagttcccccatatagtgagaatacggacgtcttcaaattctccattgagctgtttcataccatgggacgcgctctgctgtcactccagaagtttaaggaggcagccgagaatctgactaaggcagagaggctgagcaaagagcttctgcagtgcggacgaattataaaagaggagtggatagaaattgaagctaggataagactgagttttgcacaggtgtaccagggtcaaaagaaatccaaggaagccctctcgcactaccaggccgctctggagtacgtagagatttccaagggggagaccagtagagaatgtgttcctattctgcgggaattggctggtgtagaacaggcactgggattacacgacgtgtcaatcaaccattttttgcaggcacacttaatcattctcagtcgctctccatcacaggttgaagccgcagactccgctcacatcgtggcccacgctgccgtggcctctggcaggcacgaacatcacgatgtcgccgaacaatattttcaggagtctatggctcacctgaaggatagcgaaggcatggggaggaccaaatttttgagtattcaggacgagttttgtcactttctacagatgaccgggcagaaggaacgcgcaacttcgattcttagggaatcgctcgaggctaaggtggaggcctttggggatttttccccagaagtcgccgaaacctatcggttgctgggcggtgccgacctggcccagggaaatcattctggagccagaaaaaagctcaaaaaatgcctgcagattcagactttactgtacggacctcaagataaaagaacattggctactcagcaggcaatgggaatgctcagcactgcaccaaaagtggctagcaagccccgtcaggcttctaaagctaaagtcgctttctgcacatcgatcccgcaggataccctgctggggaaagcccgacccggtacaaccgccgattag

SEQ ID NO: 60222 - DNA, 1086 bp, Artificial Sequence
  Description of Artificial Sequence: Synthetic coding sequence
atgcaggcctctcctattcggattcctactgtttctaacgacatcgattgggatttttgtttccacatgtcgcagcaaacggagattccagctcaccagcaaaccgatgagctgtaccctacaggcggatgtggcgagtccgaggaggaaacaaaagcaaaggagaaagaaaaggctattgactgtatgtcacacccgaaagaaaaactagcccagagtcagaagaaggtcgcacaactgattaaggaaaaaatgaacactcaggctaacaaagagttgatccgatgcgtaatcctgtctcggattatatttggcgatcaccactggaagtgcgctcgtgctctggccaatttggcatatggatatctgactctgcgcggactgccagtgcaggccaagaagcacgccacaagcgccaagaatacgctgttgacttggaaagccaacactacatctaacaaagagaaggaggagattctggaagccttagtcaagctgtactatacactgggcgtagcatggctgctccagaacagaggtcgggaagcgtactttaacctgcaaaaagctgagcgcaacatgaaagagcttaaggagctatacaaagggggagtatgtgagcttcaggtgtcggagaacgaccttactctggcgcttggcagagcatcgttggcaattcaccgtttgaacctcgcgttggcttattttgaaaaggccatcggcgacgttatcgccgctaaaggggaccgcactagcgatctgatcagcctctacgaagaggccgcacagatcgagcagctgcgacgaaaccacaatcaggctatccagtatcttcagcaggcgcattcagtttgcgtatccctgtttaccgaggtgtcacccaagaccgccgagatgagtgccctactggctaaggcctatgcaatgtcaggcgaagctcagcatcgggacgcagtcgagatctactttattaggagcataaacgcttacagagcaactttagggagtgaggatttcgaaacattgtccaccactgaagagttctgcaaatggttagtgcagaatggcgagaaacaagacaagtag

SEQ ID NO: 60223 - DNA, 1086 bp, Artificial Sequence
  Description of Artificial Sequence: Synthetic coding sequence
atgcaggccagtccaattcgtatcccaactgtgtctaacgacatcgattgggacttttgcttccacatgtcccagcagacagaaatacccgctcatcagcagacagatgagctctacccaacaggaggctgtggcgagtccgaggaagagactaaagctaaagagaaggagaaggcgatcgactgcatgtcccacccaaaagaaaagctggctcagtcccagaagaaggttgcacagctgataaaagaaaaaatgaacacacaagctaataaggaattgatcaggtgcgttatacttagtcggatcatttttggggatcaccactggaagtgcgccagagctctcgcaaacctggcatacggttatttaactctgcgcggactccctgtacaagccaagaagcacgccacaagcgcaaagaacaccctactgacatggaaggcaaacacgacttccaataaagaaaaagaagaaatattagaggccttagtgaagctgtattacaccctgggtgttgcctggctacttcaaaatagatgccgcgaggcctatttcaacctgcagaaggcggaacgcaacatgaaggaattgaaagagctgtataaaggcggtgtgtgcgaactgcaggtgtctgaaaatgacctaaccctcgcattgggaagagcctcactggccatccacagactgaatttggccttggcttacttcgagaaggccatcggagacgtgatcgccgctaaaggtgacagaacgagcgatcttatctccctctacgaggaagctgcacagatcgagcagctaagacggaaccacaaccaggccattcagtacctccagcaggcacattctgtttgcgtttctctcttcactgaagtgagccctaaaacagccgaaatgagtgctcttctggctaaggcatacgctatgtccggcgaggcccagcatcgcgacgccgtcgaaatctatttcataaggagtattaatgcctaccgagccacattaggctccgaggactttgaaaccctgtctaccaccgaggagttttgcaagtggctagttcaaaatggcgagaaacaagatagatag

SEQ ID NO: 60224 - DNA, 1068 bp, Artificial Sequence
  Description of Artificial Sequence: Synthetic coding sequence
tgatccacggaaaggcggttgctgggacatctgtacaatgacttgggactgggctattcgcagctccagttgttcccactggcggttgaagcctttctgcaagctctgcctctgtgttgggtgcccggtgaacaggccactgtgctgagaaatctgggcatggcccataacgctctggggaattatcaggaggcacgcgagtttcaccagaaggcagccgatctgcacgggagtgttgggcagcgttgggaacaaggacgctcttttggaagtctcgcttttgcactgtctcagctgggggatcacaaggccgctcgcgacaattacctgcatgcgctccaggccgcacgagatagcggagacatgaagggacagtggcaggcttgtgaaggtctgggagcggctgccgctagactggggcaatatgatcaagccctgaagtactataaagaagcactggcccaatgccaaaaggagcccgactccgtgagggagagattggtagcgaagctcgccgatacagtccgcactcggctggcccaggtcggcctggttcagacccacactcttacctctgctcccggacgtctccaggctcccggaggagcaagtcaggctgagggcacacctgctaaggccggaagttctaccgctggcgtgcagcaccgcagttcttccggctgggaggatgaagagttcgaagaggggcatcaaaaaaagaaagaggagcggtctgccaatgtgccagtcagggccggtccgggtcggcctgaactgtgctttttacctggcaccgtcaatcactctcaccacctcgctagtagctgccccacattcaccaagcatacaccctgccgcggaactgtgttggggaaggcatcaatttattcccctggcccacgagctcacttaccctttgtaggccctggccctccacgcgcagagtacccatctatactagttccgaatggaccccaggccaataggtcctccagatggccccgagaatccctttctcgctcccggcagagaaggccaatggagtccgggatctgtacaatcgtgtag

SEQ ID NO: 60225 - DNA, 1749 bp, Artificial Sequence
  Description of Artificial Sequence: Synthetic coding sequence
atgtcctctccaaaccccgaagacgtgccaaggagaccagaacctgagccttcttcttctaacaaaaaaaagaagaaacggaagtggttgcgacaggaggctagtatccaggcactgacacgagctggacacggagcccttcaagctgggcagaaccatgaggccctgaataattttcagcgcgcttttcttttagcctctaaagccccacagacccgcgataccccagtgctgcaagcgtgtgccttcaacctcggcgctgcctatgtggagactggcgacccagccaggggcctggaactcctgctgcgcgctcatccagaggagaaggcccagggcaggaggcacggcgatcagtgttttaatgttgcgctggcctatcacgctctgggcgagcttccacaggcactggcatggtatcatagagccctgggccattatcagccacagggcgaccaaggcgaagcttgggccaagatgggagcatgctatcaggcattgggccagcctgagctcgccgctcactgtttacaggaggcttcacaggcttatgcacaggaacggcagcttcgcgcagctgccctcgccctcggggcagccgcaggttgtatgctgaaatcaggaaggcatcgggttggcgaagttgttcaggtgctagaaaagtcccggcgtctggctgagcgcagtacagaacgaaggctgctcggccacctctacaatgacctggggctcggctattctcagctccagctgtttcccctagctgtggaggcatttctgcaggcattgccgctgtgttgggtcccaggcgaacaggccacagtcttgcgtaatctgggtatggcccacaacgcccttggaaattaccaggaagctcgagagtttcaccagaaagccgctgacctgcacggaagcgtaggccagcggtgggagcaaggaagaagttttggctctctggcgttcgcactctctcagctgggtgatcataaagctgctagagataactacctgcacgctctgcaggccgcacgtgactctggtgacatgaaggggcagtggcaagcttgcgaaggtctaggtgccgcagctgcccgattgggacagtacgaccaagccctgaaatactacaaggaagccttagcccagtgtcagaaggaaccagactctgttcgtgagagattggtggctaaattagccgacacagtccgcacccggctggctcaggtgggcctggttcagacccacacactgacctccgctcccggaaggctgcaggcccctggcggagccagtcaggccgaaggaacccctgctaaggcaggatcaagtaccgcaggagtgcagcatagaagtagcagtgggtgggaagatgaggagtttgaggaaggtcatcagaagaaaaaggaggagagaagtgcgaatgtgcctgtgcgcgcaggacctgggcgtccagagctgtgcttcttacctgggacggtcaaccattctcatcatttggccagctcatgtcctacattcacaaaacatacgccgtgcagaggcacagtactgggcaaagcctccatatatagtcctggcccaagggcacatctgcccttcgtcggtcccggaccccctcgcgctgaatacccctctatcctggtgcctaatggtcctcaggcaaacagatcatcacgatggccgcgagagtcactttcaaggagcaggcagcgacgccctatggaaagcggcatctgtacgatcgtgtag

SEQ ID NO: 60226 - DNA, 1749 bp, Artificial Sequence
  Description of Artificial Sequence: Synthetic coding sequence
atgtcatcgcctaatccagaggacgtgcctcgacgccctgagccagaaccaagcagcagtaacaagaagaaaaaaaaacggaaatggttacggcaagaagccagtatccaggccctgacccgggctgggcacggagccttgcaggccggtcaaaaccacgaggctttaaataacttccagcgcgcttttttactggcttccaaagcccctcaaaccagggacacacctgtgctgcaagcatgtgcttttaatctgggggctgcctatgtggaaaccggcgatcccgctaggggcttggaactacttctccgcgcacacccagaggagaaggcccaggggcgtagacatggggatcagtgcttcaacgtagcactcgcctatcacgctctgggcgagcttccccaggctttggcctggtatcatagggccttaggtcactatcagccccagggtgaccagggagaggcctgggcaaagatgggcgcttgctaccaagccctgggccagcctgagctggccgctcattgcctgcaggaggcatcccaggcatacgctcaggagcggcaattgagggccgctgcattggcgctgggcgcagctgccggatgtatgctgaagtctgggcgtcatcgggtcggcgaagtggtgcaggtgttggaaaaatctcggagactggctgaacggagtactgagagacggttacttgggcatctgtacaatgacctcggcctgggttattctcagttacaactgttccccctggctgttgaggcttttttgcaagctttgccactctgttgggtgcccggagaacaagcgaccgtgctccggaacctggggatggctcataacgccctagggaattatcaagaggctcgcgagttccatcaaaaagccgcagatctgcacggtagtgtcggccaaagatgggagcagggcaggtctttcggaagcctagccttcgcactgtcccagctcggagatcacaaagccgcacgtgacaactacctgcacgctcttcaggccgctcgtgacagcggagacatgaaggggcaatggcaggcctgcgaaggcctgggggcagcggctgcaagactcggccagtacgaccaggccttgaaatactacaaagaggcccttgcccaatgtcagaaggagcccgactccgttagggagagactagttgccaagttagccgataccgtgagaacacgtctagcgcaagtcggcctcgttcagacccatactctgactagcgctcccggacgactccaggccccaggaggtgcctcccaggcagagggcaccccggcaaaggcgggatctagcacagctggcgtgcaacaccgttcctcatctggctgggaagatgaagaatttgaggaggggcatcagaaaaagaaggaagagaggtcggcaaacgtgccggtgcgcgcaggacctggccgaccagaactctgtttccttccaggaactgtaaaccatagccatcatctggcgagctcctgcccgacattcaccaagcacactccctgccgcggtactgtgctcggaaaggcttccatttatagccctgggcctcgcgctcacctgccatttgtagggccaggacccccacgtgcggagtatccatccatcctggtccccaatggccctcaggccaataggtctagccgctggcccagggagtcgcttagtagatctagacagcgtcgcccaatggagtccggcatctgtaccattgtctag

SEQ ID NO: 60227 - DNA, 552 bp, Artificial Sequence
  Description of Artificial Sequence: Synthetic coding sequence
tgacacctctataatgatttggggctgggctatagccagcttcagttattccctctggccgttgaggccttcctgcaggccctacccctgtgttgggtcccgggtgagcaggccaccgtgctgcggaatttgggcatggcccataacgctctgggcaattaccaagaagctcgcgagttccaccagaaggctgccgacctgcatgggtccgtgggccagcgttgggagcagggcaggtcctttggttccctggcttttgctttgtcacagctgggagaccataaagcagcgcgtgacaactaccttcacgcacttcaagccgcaagggatagtggcgcacgattttgcgccaggaccgctgggggacaggccggtcgccatcgggaagatgccttgggaccaggtggcgctgggccagatagccaccctgacttcggttccggcaagactcccggatctcgctggggccagccaggcggaggggacccttccaaaggacgcaaacagcattccaggtgcccagcccagatattccagtgggtaggtcgctag

SEQ ID NO: 60228 - DNA, 2019 bp, Artificial Sequence
  Description of Artificial Sequence: Synthetic coding sequence
atgagtgaccccgaaggagagactttacgatcgacattcccctcctatatggcagagggtgagaggttgtatctgtgcggcgaatttagtaaggcagcccagtccttcagcaatgctttgtacctgcaggacggtgataagaattgcctggtggctaggtcgaagtgttttctcaagatgggagacctggagcgatcactgaaggacgctgaggcaagcctccaaagcgatcctgcattttgtaaaggcattctgcagaaggcggagacactgtataccatgggggatttcgaattcgcccttgtcttctaccaccgtgggtataaactgagaccagaccgagagtttagggtggggatccagaaggcacaggaagcaattaacaactctgtcggcagcccttcttctataaaattggagaacaagggcgacctgtcgtttctgtctaaacaagctgaaaacatcaaggcccagcagaagccccagcccatgaaacatctgcttcacccgactaagggggaaccgaaatggaaggcctcactgaagtcagaaaagacggtgaggcagctcctgggcgagctctacgtcgataaggaatacctggagaaactgctgttggatgaggatttgataaaaggtactatgaaggggggactcacagtagaggacctgatcatgactggcatcaattatttagatacccactcgaatttttggagacagcagaagcctatttatgccagagaacgcgatcgtaagctaatgcaggagaagtggctgagagatcataagagacgcccaagccagacagcccactacatcctgaagagtctggaagatattgatatgcttttgacctctggctctgctgaggggtctctccagaaggctgaaaaggtcctgaagaaggtgctggagtggaataaggaggaagttcccaataaggacgagctcgttggcaatctttattcctgtattggcaacgcgcagatagagcttggccagatggaggccgcactgcaaagccatcggaaggatctcgagattgcaaaggaatacgacctgccggatgctaagagccgcgctctggataatatcggtcgcgttttcgctcgagttggcaagttccagcaggctatagatacctgggaagaaaaaattccactggccaaaacgacactggagaagacttggttgtttcatgaaataggtcgctgttacctcgagctcgatcaagcctggcaggcgcagaactacggagagaaatctcagcagtgcgctgaagaagagggtgacatagagtggcaattaaatgcatcagtcttggttgctcaggctcaggtcaaactacgggattttgaaagtgccgtcaacaacttcgagaaagccctggagcgagccaaactcgtgcacaacaatgaggcgcagcaggctataatctctgcactggatgacgcaaacaaaggtatcatcagagagttaaggaaaaccaactatgttgagaatctgaaagagaagagtgaaggcgaggccagcctctacgaggaccgaatcatcacacgtgaaaaggatatgcggcgagttagggatgagcccgagaaggtggtgaaacagtgggaccattccgaggacgaaaaggaaactgacgaggatgacgaagccttcggtgaagccctccagagccctgcatcaggcaagcagtctgtagaggctggcaaggctaggtccgacttgggagccgtggctaagggcctgtcaggggaattaggtacccggtctggcgaaaccggcaggaaacttttggaagccggacggagggagagcagagagatttaccgcaggccatccggagagctggaacagcgcctgtcaggggaattcagccggcaggagccagaagagttgaagaagctttcagaggttggtcggagagaacccgaggagttggggaaaacccaattcggcgagattggagaaacaaagaaaaccggcaatgagatggaaaaggagtacgaatag

SEQ ID NO: 60229 - DNA, 1464 bp, Artificial Sequence
  Description of Artificial Sequence: Synthetic coding sequence
atgatgttatcccgtgccaaaccggctgtaggaagaggtgttcaacacacagacaagaggaagaaaaaggggaggaaaattcctaagctagaggaactgctgagcaagagagacttcaccggcgcaatcactctgctagagttcaagagacacgtgggcgaagaggaggaagacaccaacctgtggatagggtactgcgcgttccacctgggggactacaagagagcacttgaggaatatgagaacgcaaccaaggaagagaactgcaattccgaggtttgggtcaatttggcatgtacatactttttcctgggaatgtacaagcaggcggaggcagctggcttcaaggcatcaaaaagccgcctacagaaccggctgctcttccacttggctcataagttcaacgatgagaagaaactgatgagctttcatcagaacctgcaggacgttacagaagatcagttgagcttggcatccatccactatatgcgaagtcattatcaggaagctattgacatatataagagaatactgctcgacaaccgagaatacctggctctgaatgtgtatgttgctctgtgctactataaactggactattacgacgtttcccaagaggtcctggccgtgtacttgcagcagattcccgacagcactatcgctctaaatctgaaggcctgcaatcatttcaggttatataacggtcgcgctgcagaagccgagctgaagtccttaatggacaacgcttcaagctcttttgaatttgctaaggagctcatcaggcacaacctcgtggtatttcgtggaggagagggcgctcttcaggttctgcctccattggtggacgttatccccgaggctcgcctgaatcttgtgatctactaccttaggcaggatgatgtacaagaggcgtataacctaattaaagatttagagccaactacccctcaggagtacattcttaaaggggtggttaacgccgctctgggccaggaaatgggatcaagggaccacatgaaaatagcccagcagttcttccagttggttggaggctctgcctctgaatgtgatacgattccaggtcgccagtgtatggcatcgtgctttttcctattgaagcagtttgacgacgtgctgatctatctgaactcatttaaatcatacttctacaacgacgatatcttcaacttcaattacgctcaggcaaaagctgccacaggcaacacctccgagggtgaagaagcatttctgctgatccagtccgagaagatgaagaacgattacatttatctgtcgtggctcgctcgctgttacattatgaacaagaagcccaggctggcatgggaactgtacctcaagatggaaacctccggcgaatccttcagcctattacaactcatcgccaacgactgctataaacgggatcctagcagatctgctccatttacagagaaacatagatag

SEQ ID NO: 60230 - DNA, 1665 bp, Artificial Sequence
  Description of Artificial Sequence: Synthetic coding sequence
atgatgctgtctagagcaaagcccgctgttggaagaggtgtgcagcatacagacaaaaggaagaagaagggaaggaaaattcccaaacttgaggaacttctcagcaaacgtgattttaccggcgcaattactctgctcgagttcaaacgtcacgttggggaagaggaagaggatacgaatctctggataggatattgcgctttccatctgggcgactacaagagagcattggaagagtatgagaacgcaactaaagaagagaattgtaatagtgaagtatgggtgaatctggcctgcacctactttttcctgggaatgtacaaacaggcagaagccgcaggatttaaggccagcaagtctagactgcagaaccggctgctcttccatttagctcataaattcaacgatgaaaagaagttgatgtcatttcaccagaatctgcaggacgtgaccgaggaccagctgagtcttgcctccatccactatatgcgaagtcactaccaggaagccatcgacatctataagaggattctgcttgacaaccgagagtatcttgccctgaacgtgtacgtggccctgtgctattacaaacttgattactatgacgtctcacaggaagtcctagcggtgtaccttcaacagatccccgactccacaatcgccctcaacctgaaggcctgcaaccactttaggctctataatgggagggcagccgaagccgaactcaaatcgttgatggacaatgcctccagttccttcgagtttgcaaaagagcttatccgccataatcttgtcgttttcagaggaggtgagggggctctgcaggtcttgcctcctctggtggatgtaattcctgaggcgaggctgaaccttgtaatctattacctgaggcaggacgacgtgcaagaggcttacaacctgattaaggacctcgagcccaccacaccgcaggagtacatccttaaaggagttgtgaacgcagccctggggcaagagatgggttccagggatcatatgaaaatagcacagcagttctttcaactggtggggggatccgcctcagagtgtgataccataccaggacgccaatgcatggcaagctgcttctttctcctgaagcagtttgatgatgtgctcatctatctgaatagcttcaagtcttatttttataatgacgatatcttcaattttaactacgcccaggcaaaggccgcaactgggaacacctcagaaggggaggaagctttcctcttaatccagtcagaaaagatgaaaaacgattatatttacttgagttggctggccaggtgctatataatgaataaaaaaccaagactggcctgggagttgtacttgaagatggagacttccggcgagtcattctcccttcttcaactaatcgctaatgactgttacaaaatggggcagttttactactccgcaaaagcatttgacgtattggaacggctggatcctaatccagagtactgggaaggcaagcgaggcgcttgtgtcggaatttttcagatgatcatagccggaagggagccaaaggagacgctcagggaggtgctgcatctcctgcggtcaactggtaacacccaggtcgagtatatgatcagaatcatgaagaaatgggcaaaggaaaacagagtgtctatttag

SEQ ID NO: 60231 - DNA, 1572 bp, Artificial Sequence
  Description of Artificial Sequence: Synthetic coding sequence
atgatgctgagtcgggctaaacctgctgttggacgcggagttcaacatacagataaaagaaaaaagaagggaaggaaaatccccaaactcgaggaactactctctaagagggatttcacgggggctattacgctcctggaagagtacgagaatgcgacaaaggaagagaactgtaattctgaggtatgggtgaacctagcttgcacatactttttcctcgggatgtacaaacaggctgaggcagcaggtttcaaagcctcaaaaagtcgcctgcagaatcgcctgttgttccatctggctcacaaattcaatgacgaaaaaaagttgatgagcttccaccaaaatcttcaggatgtaactgaggatcaactgtctctcgcatcaattcactacatgcggagtcattatcaggaggcaattgatatttataagcgaatcctcctcgacaaccgggaatatctggccctcaacgtgtacgttgcgctttgctactacaaacttgattactacgacgtctcacaagaggtactggccgtctacctgcagcagatacccgactctactatcgcactaaacctgaaagcttgcaaccactttcggctgtacaatggtagagcagccgaggcagaattgaaatccttgatggacaatgcctcatcttcgtttgaattcgccaaagaactcattcgccacaatcttgtcgtttttcggggtggagagggcgctcttcaggtcttgcctccacttgtcgacgtgatccccgaggccagactgaacttggttatctactatctgagacaggacgacgtgcaggaggcttataaccttattaaagacctcgagcctaccacaccccaggaatacatattaaaaggggtagtgaatgctgcactcggccaggaaatgggttcacgggaccacatgaagatcgcacagcagttctttcagcttgttggtggcagcgcgagcgaatgcgataccattcccggtagacaatgtatggcgagctgtttttttttactgaagcagttcgatgatgtgctgatctatctcaactcatttaagagttacttctataatgatgacatcttcaactttaactacgcccaagctaaggctgccaccggcaatacctctgagggggaagaagcattcctgctcatacagagcgaaaaaatgaaaaatgattatatatatctttcatggctcgctcggtgttatattatgaacaagaagccccgactggcatgggaactatacctcaaaatggagacatcaggagaaagcttctctctcttgcaactgattgctaatgattgttacaagatggggcagttctactactcggctaaggccttcgacgtgctcgagaggctagaccctaaccccgagtattgggaggggaagaggggtgcctgcgtgggcattttccaaatgatcatcgctggtcgcgagcctaaagaaacattgcgggaggtcctccatctgcttaggtctaccggtaatacccaggtggaatacatgattaggatcatgaaaaagtgggctaaagaaaacagagtgtccatctag

SEQ ID NO: 60232 - DNA, 2532 bp, Artificial Sequence
  Description of Artificial Sequence: Synthetic coding sequence
atgtggacacctgagcttgccattctgcgaggcttcccgaccgaagccgagcgccagcaatggaagcaagagggggtagtcgggagcgagtctgggagcttcctccagctgctgctggaggggaattatgaggccatattcttgaacagcatgacacagaatattttcaactcaaccactaccgctgaggagaagatcgacagttacctggaaaaacaagtggtgactttcctggactacagcaccgacctcgataccacagaacgacagcaattaatttttctcctgggggtgagctcgctccaattgtttgtgcagtccaattggaccgggccacccgtggatctgcacccacaagattttctgtccagcgtgctcttccagcagttctccgaggtgaagggactggacgcatttgtcctaagcctgctgacactcgatggcgaaagtatttattcactcaccagtaagcctattcttctcctccttgcaaggatcatcttggttaatgtgagacacaagctgaccgccatccagagcctgccctggtggaccctacgctgcgtcaatatccatcaacacctgctggaagaaagatcaccccttctgttcacactggccgaaaattgcatagaccaggtaatgaaactccagaatctgtttgtagatgatagtggccgatacctggccattcaattccaccttgagtgcgcatacgtcttcctctattattacgagtacaggaaggccaaggatcagctggatatcgccaaagacattagccagctccagattgatctgaccggcgcattgggcaagcggactcgctttcaggaaaactatgtcgcccagttgatcctcgacgtaaggagagaaggtgacgtactgtcaaattgtgaatttacccccgcacccactcctcaggagcacctgacgaaaaacctggaacttaatgatgacactattctaaatgacatcaaactggccgactgtgagcagtttcagatgccggatttgtgtgccgaggagatcgccatcattctaggcatatgcactaactttcaaaagaacaatccagtgcatacattgacagaagtcgagttactggcgtttacttcctgtctcctgtctcaaccgaagttctgggccatccaaaccagtgctcttatattgaggacaaagctcgagaagggatctacccggagggtggaaagagccatgaggcaaacacaggccttggctgatcagttcgaggataagaccacatccgtgttggaacgccttaaaattttttattgttgccaggtgccaccccactgggcgatccagaggcaattagcaagtctcctttttgagctgggttgtaccagttccgcacttcaaattttcgaaaaactggagatgtgggaggatgtggtcatttgttacgaacgagcaggccagcacggaaaagccgaagaaatacttaggcaggaactggaaaagaaagaaacaccctccctgtattgtctactgggggacgtgttaggtgatcacagttgttatgacaaagcttgggagctgtcaagatatcgctctgcccgagcacaacggtcaaaagctctgctgcacctgcgcaataaagaattccaggagtgtgtggagtgcttcgagagatccgttaagatcaaccctatgcagctcggggtgtggttctctcttgggtgtgcctacttggctctcgaggattaccaggggagcgcgaaggcctttcagaggtgcgtgactctggagccggataatgcggaagcgtggaataatttatccacctcctacatccggctgaagcagaaggtcaaagccttcagaacactccaggaggccctcaagtgcaattatgagcattggcagatctgggagaactacatactcacatccactgatgtgggagaattcagcgaggcaatcaaggcctatcacaggcttctggacctgagagacaagtacaaggacgttcaggttctgaagatcctcgtgcgtgctgttattgacggtatgaccgataggtctggcgatgtggcaactggcctcaaagggaaactgcaggaactgtttggtagagtgacttctagggtaactaatgatggggagatctggcgcctctacgcacacgtgtacggaaatggccagagtgaaaaacccgacgaaaatgagaaggccttccagtgtttgtccaaagcatacaagtgtgacactcagagtaactgctgggagaaagatattacaagcttcaaggaagtcgtacagagggctttgggactcgcacacgttgctatcaagtgctctaagaacaaatcctcctcacaggaggccgtacagatgctctccagtgtcagacttaacctgcgcggattgctgtccaaggccaagcagctatttacagacgtggctacaggagagatgagccgagagcttgccgatgacattactgctatggacaccctcgtgactgaactccaagatctgtctaatcagtttcggaaccagtactag

SEQ ID NO: 60233 - DNA, 7445 bp, Artificial Sequence
  Description of Artificial Sequence: Synthetic coding sequence
atggaacaaagcccccctcccgcacccgagccaacccagggcccaacacccgctcgctctcgccgacgccgtgagcccgaatcacccccagcctccgccccaattccactgtttggggcagatacaataggccaacgctcaccagatggtccagtgctgagcaaggcagaattcgttgagaaagtgagacaaagcaaccaagcttgccacgacggcgacttccatacagctattgtgctttataatgaagccctggccgttgacccgcagaattgtattctgtatagcaataggtctgcagcctatatgaagattcaacagtacgacaaggcccttgatgatgctataaaagccagactgctaaaccccaaatggccaaaggcctactttcggcagggggtcgcccttcagtacctggggaggcatgcagacgcgctggccgctttcgcatccggcctcgcacaggaccctaagtccctgcagctgctagtgggcatggtggaggctgcgatgaagtcaccgatgagagatagtctggaaccgacttatcagcagctccagaagatgaaactggataagtctccctttgtagtggtgtctgtggtcggacaggagctgctgactgcgggtcaccatggcgcttctgtagttgtcctggaagcggctctgaagatcggtacatgtagtctgaagctgagaggttctgtgttctccgctcttagtagcgcatattggagtctggggaacaccgagaaatccaccgggtatatgcaacaagacttggatgtggcaaaaacgctgggcgaccaaaccggggaatgccgcgcacacggcaatctgggctctgcattcttcagcaaagggaattaccgcgaagctctgactaaccaccgacaccagctcgttttagccatgaaactgaaagatagggaagcagcatcttccgctctttcctcactgggacacgtgtacacggcaatcggcgattacccaaatgccctcgcctcccataagcagtgtgttctactggcaaaacagtccaaggatgagctcagcgaggctcgggaactcggcaatatgggggctgtttatatcgctatgggcgatttcgagaatgcagttcaatgccacgagcagcacttgaagattgctaaggacctgggcaataaacgcgaggaagctcgagcttactccaacctcggatccgcctatcattatcggagaaacttcgataaagctatgagttaccacaattatgtgcttgaactcgctcaggagctcatggaaaaggcaatcgaaatgcgtgcctacgcaggcttagggcacgccgctcgttgtatgcaggacctggaacgggcaaagcagtatcacgagcaacagctgggcattgccgaggacctgaaagacagagccgcagagggcagggctagctcgaatttagggatcatccatcagatgaagggtgactacgataccgccctgaaactccacaaaactcatttatgtatagcccaggagctctccgactatgcggcacagggacgagcttatggcaacatggggaacgcctataacgctttgggcatgtacgatcaggccgtgaaatatcatcgccaggagctgcagatctccatggaggtcaatgaccgggcaagccaggctagcactcatggcaatctggctgtggcttatcaggcgcttggggctcatgatcgggcattgcagcactaccagaatcatttaaatatcgctcgcgagttaagagacatccagagtgaggctcgagccctgtctaatctgggcaattttcattgttctagaggcgaatatgtacaggccgctccctactacgaacaatatcttcggctggctcctgatctccaggacatggagggcgaggggaaggtgtgccacaatttaggctatgcccattactgcttgggcaactaccaggaagcagtgaaatactacgaacaagacctggcactggctaaagatctgcatgataagctatcccaagccaaagcatactgtaacctggggttggcgttcaaagcgctactgaacttttccaaggcggaggagtgtcaaaaatatctcctctcattagcccaatcattgaataactcccaagcaaaatttcgagctctgggtaacttaggggatatcttcatttgtaagaaagacattaatggcgctatcaaattttatgagcaacagctggggctcgcgcatcaggtgaaagacagacgcctggaagctagcgcatatgctgccctgggcacagcttatcggatgatccagaagtatgataaagcattgggctaccacacccaggagctggaagtgtaccaggagctgtctgatttacctggcgaatgccgtgcacacgggcacctcgcagcagtctatatggccctgggcaagtacacgatggcctttaagtgttacgaggaacagctggatctggggcagaagctgaaggatccgagtttggaggcccaggtatatgggaatatgggtattacaaagatgaatatgaatgtgatggaggaggcaatcggatactttgaacagcagctggcaatgttgcaacagcttagtggaaatgagagtgtgctggatcggggaagggcctacggcaacctaggcgattgctatgaagcccttggtgactacgaagaggcaatcaaatactacgagcagtatttgtccgtggcacaatccctcaataggatgcaagaccaggcaaaggcatatagggggctcggaaacggccaccgcgctatgggtagtctgcagcaagccctcgtgtgctttgagaagaggctggtcgtggcacacgagttgggcgaagccttcaacaaggcccaggcgtacggcgaactgggctctcttcacagtcagctggggaactacgagcaagccatttcttgcttagaacgtcaactgaatatcgccagggacatgaaggaccgcgcattagaaagcgacgctgcgtgtggattgggcggtgtgtatcagcagatgggcgagtacgataccgccctgcagtaccatcagttagatctgcagatcgccgaggagactaacaatcctacatgccaggggagggcatacgggaacttgggcctgacctatgagtccctgggaacatttgagcgcgcagtggtctatcaggagcagcatctcagtattgctgcgcagatgaacgatctggcagccaagacagtttcttatagttccctgggcaggacgcaccacgccctgcagaactattcacaggccgtaatgtatctgcaggagggtttacggctcgccgaacagctcggaaggagggaagacgaagccaaaatcagacacgggttaggtttgtcactgtgggcctccggtaacctcgaagaagctcagcaccagctgtatcgcgcaagcgcattattcgagacaatcagacacgaggcccagctttccaccgattacaagctcagcctgttcgatctacagacctcatcctaccaagccttacagcgcgttctcgtctcacttggacatcacgacgaggcactggctgtggcagagcgcggaagaacgagggcgtttgccgacctattagtggagaggcagacgggccagcaggactcggacccttattcaccagttacaattgatcaaatcctcgagatggtgaatggccagcgcggacttgtgctgtactattccctggccgctggatatttgtatagctggttactagcccctggggctggaattgttaaatttcacgagcattatctgggtgaaaacacggttgagaattcttctgactttcaggcgagcagcagtgtgaccctgcctacagcgaccggcagcgccctggagcagcacatcgcctcggttcgggaagccctgggcgtggagagccactactcccgtgcctgcgcgtcttctgaaacagagagcgaagctggtgatattatggatcaacagttcgaagagatgaataataagttgaattccgtcacggaccccacaggttttctaaggatggtgagacgcaacaacttgtttaaccggagttgtcaaagcatgacgtcactcttctctaatacagtaagccccacccaggatggtacgagcagcctgcccaggagacagtcatctttcgccaaaccaccattgagagccctgtatgaccttcttatcgccccaatggagggaggcctcatgcactcctctgggcctgtagggagacaccggcagctgatcttagtgctggagggcgagctgtacctgatcccctttgcgttactcaaggggagtagcagcaacgagtacctgtatgaaagatttggattattggcggttcctagcatacgctcgctgagtgtgcagagcaagtcgcaccttagaaaaaacccacctacatattctagctctacgtcaatggctgcggtcattggcaatcccaagcttcccagtgcggtgatggaccggtggttgtggggcccaatgcccagtgccgaggaggaggcatacatggtcagcgagttgctcggatgccagcccttggtgggctctgtggcaactaaagaaagggtgatgtccgcactgactcaagctgaatgcgttcacttcgcgacgcatatttcgtggaagctatccgccctggtgctcactcccagcatggatggcaaccccgcaagcagtaagtccagctttggccacccatatacaattcccgagtccctcagagtgcaggatgacgcctcagacggggaatcaatcagtgactgtccccctctacaggagctcctccttaccgcagccgatgtgctggacctccagctgccagtgaaactggtggtgctcggatcttcacaagaaagcaactccaaagtgactgccgacggtgtcattgcattgacccgagccttcttggccgctggggctcaatgcgtgctggtgagcctgtggccagtccccgttgcagctagcaagatgttcattcatgcgttctactcatccctgctgaatggattaaaggcttcagctgcactcggggaggctatgaaggttgtacaatcttcaaaagcattttcgcatccttcaaactgggctggctttatgctcataggaagtgacgttaagctcaactccccgtcttccttgataggccaggcccttactgaaatcttgcagcaccctgaacgggctcgggacgctctgagggtcctcctccatctggtcgagaaatccctccaaagaattcagaatggtcagaggaacgcaatgtataccagccagcagtctgtagagaataaggtgggcggaatacccggttggcaggctttgctgactgcagtcggtttcagattagaccccccaacctccggcctacctgcagcggtcttttttccaactagcgaccctggcgacaggctgcaacagtgttccagtacgctacaaagcctccttggcctccccaatcccgctttgcaagcgctgtgcaagctcatcacagcttcagaaacaggagaacagctcatctctagggctgtcaagaatatggttggcatgctccatcaggtcctggtccaattgcaggcaggcgagaaggaacaggacctcgcatccgctccaatccaggtgtccatcagcgtgcagctgtggcggctacccggatgtcatgagtttctggccgctctcgggttcgacctgtgtgaagtcggtcaggaggaggttatcctcaaaaccggcaagcaggcaaatagacggacggtgcacttcgccctccagagcctgctgagcctgttcgatagcacagagctgcccaaaaggctgagcctagactcatcttctagcttggagtccctggctagtgcccaaagcgtgtccaacgcactgcctttggggtatcagcagcctcctttctcgccgactggcgctgattcaatcgctagcgacgccatcagcgtgtactctctgtcgtccatcgcctcaagcatgtcgtttgtatcaaaacccgaaggcggaagtgagggcggaggccctggaggacgtcaagatcatgataggagcaagaacgcatatctccagcgcagtacacttcctaggagccagctgccccctcaaacgaggcctgctggcaacaaggacgaagaggaatacgaaggattctccatcatatcgaacgagcctttggcgacttaccaggagaaccgcaatacctgcttttcacccgatcacaagcaaccccaacctggaaccgctggcggaatgagagtgagtgtgagctccaagggaagtatttctacgcctaactcaccggtgaagatgacgctaattccatcacccaatagcccttttcagaaggtgggaaaactagcttctagcgatactggggagtctgaccagtcctctacagagacagattctaccgtaaaaagccaagaagagagcaacccaaagctcgacccacaagaactggcacaaaagatactggaggagacccaatctcatctgatcgcggtggagcggctccaacgctctgggggacaggtctcgaagtccaataaccctgaggatggagtccaggccccatcctcgaccgctgtctttagagcatcagagacaagtgcctttagtagaccagtgctgtcccatcagaagtctcaaccaagccccgttaccgtgaaaccaaaaccgcctgcaagaagcagtagcctccccaaagtatcttctggatatagctctcccacaaccagtgagatgtccattaaggactccccctcccagcattctggtcgcccaagcccaggctgtgatagccagaccagccaactcgatcagccacttttcaagctgaagtacccctcttccccctatagtgcacatatctctaaaagccctaggaatatgtcacctagttccggccaccagtccccagcgggatctgccccttccccagctctcagctacagctctgcagggagcgctagatcaagccctgcagacgcaccagatatagacaaattgaagatggccgctattgatgagaaggtgcaggccgtgcataacttaaaaatgttttggcaatcaactccacagcacagtacgggcccaatgaagatatttcgcggtgcgcctgggaccatgactagtaagagggatgttctctctctgctgaacctgagccccagacacaataagaaggaggagggagtggataaactggagctcaaagagttgtccctccagcagcacgatggtgctccaccaaaagctcctccaaacgggcattggcggactgaaacaactagcctcggatctcttccactgcccgcagggcctcccgctacagctccagcacgtcccctccgcctaccatcgggcaacggctataaatttctgtcacccggtcgcttctttccatcatcaaaatgcta

SEQ ID NO: 60234 - DNA, 1428 bp, Artificial Sequence
  Description of Artificial Sequence: Synthetic coding sequence
atgacgacacttccaccactgccaatgaccaggccaaaactgacggccctggctcgtcagaagctcccttgctccagcaggaagattcctcggtcacagctgatcaaggagaaggacgacatagaccactatctggaagtaaacttcaaaggcctgtctaaagaggaggtcgccgcatatcgcaacagttataaaaagaatatttgcgtggacatgctccgcgatggatatcacaaatctttcaccgaactgttcgcactgatggagagatgggatgccctcagagaagcagccagggttcgaagtcttttttggttacagaaacctctagaggagcagccagacaagctagattacctgtaccattatctcacaagggcagaggatgcagaacgcaaagagagctttgaagacgtgcataataacctctatgcgctcgcctgttatttcaataattcagaagataaatgggtacgtaaccacttctatgaaagatgttttaagatcgcgcagttaatcaagatcgactgcggaaagaaggaggcagaggcccacatgcacatgggactgctctatgaagaggatgggcaactgcttgaagccgcagaacattatgaagccttccaccagctgacgcaagggcgaatttggaaggacgaaacaggaagaagccttaatcttctggcttgtgaaagtctcctgcggacctatcgtctcttatctgacaagatgcttgaaaacaaggagtacaaacaggcaatcaaaattctcattaaggcttcagaaattgctaaagagggtagtgataaaaagatggaggctgaagcctcatattacttggggttagcacacctagccgcagaggaatacgagactgctttaaccgtcctggacacatactgtaagatttccaccgatttagacgacgatctgtccctgggtagaggctacgaagccattgccaaagttttgcagagtcaaggcgagatgactgaggccattaagtatttaaagaagttcgtgaagatcgcccgaaacaacttccagtcactagacctggtgcgggctagcacaatgttgggagacatatataacgaaaagggttattacaataaggcttccgaatgcttccagcaagcgttcgataccactgtcgagttgatgagcatgcccctcatggacgagacgaaggtgcactacgggattgcaaaggcccaccagatgatgctgactgtcaacaactacatagagagtgctgacctgacatcgttgaactacctcctgtcgtggaaagagagccgaggtaatatcgaaccagacccagtcacagaggaatttagaggatccacagtagaagctgtctcccagaatagcgagaggctggaggaactcagccgctttcccggagaccagaaaaatgaaacatag

SEQ ID NO: 60235 - DNA, 960 bp, Artificial Sequence
  Description of Artificial Sequence: Synthetic coding sequence
atgactacgctcccaccactgcctatgacacggcctaaattgactgcactggcaaggcagaagttgccttgctcttcgagaaaaataccacggagccagttaatcaaagaaaaggacgatatcgatcactaccttgaggtgaactttaagggcctatccaaggaagaagtcgccgcatatcgcaatagctataaaaagaatatctgcgtggatatgttgcgagacggttatcacaagtccttcacagaactgtttgcacttatggaaagatgggatgccctccgcgaggccgctcgcgtcaggtcattgttttggctccagaaacctctcgaggagcaacccgataagctcgattacttgtatcactatctaacaagagcggaggacgccgaaaggaaggagtctttcgaagatgtccataataacctttacgctctcgcctgttacttcaataatagtgaggacaaatgggtgcgtaatcatttctacgaacggtgttttaagatagcccagctgataaagatcgactgtggaaagaaggaggctgaggctcatatgcacatggggcttctatatgaagaggacggccagctgctggaggcagctgagcactacgaggcattccaccagctgacacagggcagaatttggaaggacgagaccggccgatccctcaatctgctcgcctgtgagagcctgctgagaacctaccgcctcctgagcgataagatgctggagaataaggaatataagcaagccatcaagattctcatcaaagctagtgaaatcgctaaggagggatccgataaaaagatggaggctgaagcatcctattacctggggctggctcatctcgcggctgaggagtatgaaacggccttgaccgtgctggacacctactgtaagtccccacaaacttggatgatgatctcagtgtggggcgaagctatgaaaccctag

SEQ ID NO: 60236 - DNA, 1506 bp, Artificial Sequence
  Description of Artificial Sequence: Synthetic coding sequence
atgattcccatgtttactgtgaccttggaagactcaggcaccctgtggaagagcctccacagcagtagcgaaagcgaaatgacgacattaccccctctacctatgactagaccaaagctgaccgccctcgctaggcagaagctgccatgctccagcagaaagatcccaaggagccaactaatcaaagaaaaggatgacatcgatcactacctcgaagtgaacttcaaagggctgagcaaggaggaggtcgcagcgtacaggaactcatacaagaagaacatctgcgtcgatatgctccgagatggatatcacaagagctttacggaactgtttgccctgatggagcgttgggatgcactcagagaggccgcaagagtcagatctctattttggctgcagaagcctctggaggagcagccagacaaactggactacctttaccactatctgactcgcgcagaagacgctgaaagaaaggagtcatttgaagatgtacataacaatctttatgcactcgcttgctatttcaacaactctgaggacaaatgggtacggaatcatttctatgaaagatgctttaagatcgcacagctgattaagattgactgcggtaagaaagaggcagaggcacatatgcatatggggttactttacgaggaggatggccagttattggaagctgctgagcactacgaagccttccaccagctcacccaaggccgaatctggaaagatgaaacgggcaggtctctgaacttacttgcctgcgaatcgcttctgcggacgtaccggctgctgtcagacaagatgctcgagaacaaagagtataaacaggccatcaagatcttgatcaaggcctctgaaatagccaaagaaggctcagacaagaagatggaagcggaggcctcatactacctcgggctggcccatctggccgctgaagaatacgagaccgctcttacagtccttgatacctactgtaagatctcaaccgatttggatgatgatctgtccctgggccgtggctatgaagccattgcgaaagtccttcagtcccagggggaaatgaccgaagctatcaagtatctgaagaaattcgtgaaaattgcccgtaataacttccagagtcttgatttggtgagggccagcactatgctcggtgacatttacaacgaaaaaggttactataataaggccagcgagtgttttcagcaggcgttcgacaccacagtggaacttatgagcatgccacttatggacgaaacaaaggtccattacggcatcgctaaggcccatcagatgatgcttaccgtgaacaattacatcgaatccgctgatctaacttcgctgaactacctgctgtcctggaaagagtcccgtggcaatatcgaaccagaccccgtgaccgaagaatttagagggagtacagttgaagcggtgtcacagaattctgaacggctggaagaattatctcgtttccctggagaccaaaagaatgagacctag

SEQ ID NO: 60237 - DNA, 81 bp, Artificial Sequence
  Description of Artificial Sequence: Synthetic coding sequence
atgaccaccctgcccccattacctatgactcgccctaaattgacagcactggcgaggcagaaattgccctgttcttcttag

SEQ ID NO: 60238 - DNA, 1425 bp, Artificial Sequence
  Description of Artificial Sequence: Synthetic coding sequence
atgaccacactgccaccactccctatgaccaggccgaaactgaccgccctagcccgacagaagcttccttgctcgtcccgaaagatccccagaagccagttaattaaggaaaaagatgacatcgaccattaccttgaggttaattttaaaggtttgagcaaggaggaggtggcagcatataggaactcctacaagaaaaacatctgcgtggacatgttaagagacggttaccataagagctttaccgagctttttgcattaatggaaagatgggacgcactcagagaagccgcacgagtgcgcagcctgttctggttgcagaaacctctggaagaacagcccgacaagctggactacctgtatcattatctgacacgcgctgaggacgcagagagaaaggagagttttgaagatgtccataacaacttgtacgctctggcatgctatttcaacaactccgaagacaagtgggttcgcaaccacttttacgaaaggtgcttcaaaattgcccagctcattaaaatcgactgtgggaaaaaagaggcggaagcccacatgcatatggggctgctgtatgaggaagatggccagctgttagaggccgctgagcactacgaggcctttcatcaactgacccagggaagaatctggaaagacgagacaggcaggtctttaaatctcctcgcctgtgagagcctgctgagaacgtatagattgttatccgacaagatgttagaaaacaaggaatataagcaggcaatcaagatcctgataaaagctagcgagattgctaaggaggggagcgataagaagatggaagcagaagctagctactaccttggattggcacatctagccgctgaggagtatgaaactgccttgaccgtgctggatacctactgtaagattagcaccgatttggatgatgacctttcactgggcagggggtacgaggctattgccaaggtgcttcagagccagggtgagatgaccgaagccattaagtacctgaaaaagttcgtcaagatcgcccgtaacaatttccagtccttagatctcgtccgtgcaagtaccatgctgggtgatatctacaatgagaagggttattacaacaaggctagcgagtgtttccagcaggctttcgacacaacagtcgaactaatgtccatgccactcatggacgaaacaaaggttcattatggtatcgccaaggcacatcagatgatgctgacggttaataactatattgaatctgcagatcttacctcattgaattatctcttgtcctggaaagagagccgtggaaacatcgaaccagaccccgtgaccgagtttcgtggaagcaccgtggaagcggtgtcacaaaactccgaaagactggaggagctcagccgctttcccggtgatcagaagaacgagacgtag

SEQ ID NO: 60239 - DNA, 1506 bp, Artificial Sequence
  Description of Artificial Sequence: Synthetic coding sequence
atgatccccatgttcaccgtgactctagaagatagcggtaccctatggaaaagcctgcatagttcttctgagtcagaaatgacaacgctgccgccattacctatgacccgtcccaagcttacggcactcgcccgtcagaagctcccttgctcgagtagaaaaatccccaggagccagctaataaaagagaaggatgacattgaccattatctcgaagtgaactttaaagggctgtctaaggaagaagtcgccgcataccgcaattcctacaaaaaaaacatttgcgttgatatgctgcgggacgggtaccacaagagttttacggagttatttgcattgatggagagatgggacgcactgagagaagccgctagagtccgctccctcttctggctgcagaagccactggaggagcagccagacaagctagattacctctaccattacttgacccgagccgaggacgcagaacgaaaagaatctttcgaagatgtgcacaacaatctttacgccctggcttgttacttcaataatagtgaggacaagtgggtcaggaaccacttttatgagcgctgcttcaaaatcgctcagctaataaaaattgattgcggaaagaaggaagcagaggcccacatgcacatgggtcttctttatgaggaagacggacagcttttggaggcggcagagcattacgaggcctttcatcaactcacccaaggccgtatatggaaggacgagacgggtcggtctctgaatcttctggcttgcgagtccctgctgcggacctataggctgctgtccgataaaatgctggagaacaaggagtacaaacaagctattaagattctgattaaagcgtcagagattgcaaaagaaggctcagataagaagatggaggctgaggcatcttattatctcggactagcacacctggccgcagaggagtacgagactgctctgactgtgctggatacgtattgcaaaattagtaccgatctagacgacgatctcagtctgggccgtggttatgaagcaattgctaaggtgctgcagagtcagggtgagatgaccgaggcgattaagtacctgaaaaaattcgtcaaaatcgctaggaacaactttcagtcactagacctggtgcgtgcctctaccatgcttggggacatttacaatgagaaaggctattataataaagcttccgagtgcttccaacaggccttcgatacgactgtggaactcatgagcatgcctcttatggatgaaacgaaggtccactacggcattgcaaaggcccaccagatgatgctgaccgtgaacaactacattgagagcgccgaccttacatcgcttaattatctcctgagctggaaggagagtcgtggcaacattgagcctgatcccgtaaccgaggaattccggggatcgaccgttgaggcagtctcccagaacagtgagaggctcgaagagttgagccgtttccctggcgaccaaaagaatgagacctag

SEQ ID NO: 60240 - DNA, 282 bp, Artificial Sequence
  Description of Artificial Sequence: Synthetic coding sequence
atgataccaatgttcacagttaccctggaagattcaggcactctgtggaaatctcttcatagtagctccgagagtgagatgacaacccttccccctctgcccatgaccaggccaaaactgaccgcattggccagacaaaagctgccctgtagcagcagaaaaataccaagaagtcaactgattaaggagaaagatgatattgatcattatctcgaggtgaatttcaaagggttgagcaaggaggaagtcgcagcatacaggaactcctataagaagaattag

SEQ ID NO: 60241 - DNA, 1998 bp, Artificial Sequence
  Description of Artificial Sequence: Synthetic coding sequence
atggctggcttgtctggcgctcagatcccagacggagaatttacggctctagtctacagattgataagggatgctcgctatgctgaggccgtccagctgctagggcgagagctccagagaagtccaagatccagagcaggattgtctctgttgggctactgttactaccgcttgcaagagttcgccctggccgcagaatgctatgagcaattggggcagctgcatcccgagctggaacaataccggctatatcaagctcaggccctgtataaagcctgcctctatcctgaggccacaagggtggcctttctgctcctggacaaccctgcctaccacagccgggttcttcgactacaagcagctatcaagtactcggagggtgatctgcccggatcgcgctcactggtagaacagctgttgtccggagaaggcggtgaggagtccggaggcgataatgaaacagatggacaggtgaatctcggatgcctcctctataaagagggccagtacgaggcagcatgctccaagttctctgcgaccctgcaggcttccggctaccagcccgacctttcctacaacctggccctcgcatattacagcagcaggcagtacgctagtgccttgaaacatattgcagagattatcgagcggggtataaggcaacacccagagcttggcgtggggatgactacagaaggctttgacgttagatccgtggggaatacgttagtcctacatcagaccgccttggtggaggcgtttaacctgaaggccgcaatcgaatatcaactcaggaactatgaagtagctcaggagacactgactgacatgccacctcgtgccgaggaggagctggaccccgttacacttcacaaccaggccctgatgaacatggatgctcgccctaccgaagggttcgagaaactccagtttctcctccagcagaacccgttccctcccgagacgtttggtaatctactcctcctctactgtaagtatgaatacttcgacctagcagcagatgtcttagccgagaatgctcacttgacctataagtttctcactccgtatctgtatgacttcctggatgcacttattacctgccaaactgccccagaggaggccttcattaagcttgacggcctcgcaggcatgttgacagagcaactcagaagactgaccaagcaagttcaggaggcccgacacaatagggatgatgaggctattaagaaggccgtaaacgagtacgatgaaactatggagaagtatatccctgtcctgatggcccaggccaagatatactggaatctcgagaactaccccatggtagaaaaggttttccgaaagtccgtagaattctgtaacgaccacgatgtgtggaaattaaacgtggctcacgttttgttcatgcaggagaacaaatacaaggaggcgatcggcttttacgaacccatcgttaagaaacactacgataacattctgaatgtgtcggccatcgtgctggcaaatctgtgtgtgagctatatcatgacttcgcagaatgaagaagcagaggagttgatgcgcaagatagaaaaagaagaagagcaactgtcatacgatgatcccaacaggaaaatgtaccatctatgtatcgtcaatttagtcataggaacactgtattgcgccaagggcaattatgagttcggcatttcccgagtgattaaaagcctcgaaccctacaacaaaaaactgggaaccgacacctggtattatgccaaaaggtgcttcctgtctctactcgagaatatgtcgaagcacatgatcgtcatccacgatagtgtgatccaagagtgcgtgcagttcctcgggcactgcgaactctacggcaccaacattccggctgtgattgagcaacccctggaggaggagcgcatgcatgtcgggaagaacactgtaacggatgaatcccgtcagttaaaggctctgatttatgaaattatcggatggaacaagtag

SEQ ID NO: 60242 - DNA, 381 bp, Artificial Sequence
  Description of Artificial Sequence: Synthetic coding sequence
atgtaccatctgtgcatcgtgaatctggtcataggcactttatactgcgcaaaaggcaattacgaatttgggatttccagagtcatcaaaagcctcgaaccctacaataaaaagcttggaaccgacacctggtattacgccaaaaggtgttttctcagcctgctggagaacatgtccaagcatatgatcgtcatccatgactctgtcattcaggaatgtgttcagttcttgggccactgtgagctttacggtaccaatatcccggctgtgatcgagcagccactggaagaagaacgtatgcacgtgggaaagaacactgttaccgatgagagtcggcagcttaaggctttaatctatgagataataggttggaataaatag

SEQ ID NO: 60243 - DNA, 1998 bp, Artificial Sequence
  Description of Artificial Sequence: Synthetic coding sequence
atggccggtctgagcggggcacaaatcccagacggtgaatttaccgcggtggtgtacagactgattaggaacgcccgatatgccgaggctgtgcagctgctgggaggggagctacaacgaagtccgaggtccagggctggcctgtccttgctcggatactgctactatcggctgcaggaatttgcacttgcggcagagtgttatgaacagctcggccaactgcatccggagctcgagcagtatcggctctaccaggctcaggcactgtacaaagcttgcctatacgcagaggccacccgcgtcgcgttcctgctcctggataaccccgcttaccattccagggtgctcagattgcaagctgccattaaatacagcgagggtgatctgccagggtcgagaagccttgtagagcagctcccttcaagagaaggaggggaggagagcgggggagaaaacgagacagacggacagatcaatctgggctgcctcctttataaggaaggacaatacgaagccgcttgttcgaaattttttgcagccctgcaggcaagcggctatcagcctgatttgtcgtacaacctggcactcgcttattatagctcacgacagtacgcatctgccctcaagcacatcgctgaaatcatagagcggggaatccggcaacaccctgagctgggtgtgggaatgactaccgaggggatagatgttaggtcggtcggcaacaccctggtactacaccagacagcacttgtggaagcattcaatctgaaggccgctattgaataccagttgaggaattacgaggcagcgcaggaggcactgaccgacatgccccctcgagcggaggaagaattggacccagtcaccctgcataatcaggcactgatgaacatggacgccaggccaactgagggcttcgaaaagctacagttcctcttgcagcagaacccgttccccccagaaacatttggcaacttgctccttctgtattgcaaatatgaatacttcgacctggctgccgacgtcctcgccgagaacgctcacctgatctacaaattcctgactccttatttgtatgactttctcgacgccgtgattacatgccaaactgcacccgaagaggctttcattaagctggatgggttggcaggaatgcttactgaggtccttcgcaaactgacgatacaggtccaggaggcccgtcacaatagagatgatgaggctattaaaaaagcagtcaacgaatacgatgagacaatggaaaaatatatccccgttctaatggcgcaagcaaagatttattggaacctcgaaaattaccccatggtggagaagattttccgcaagagcgtggagttctgcaatgaccatgacgtgtggaagctaaacgtggctcacgtgctctttatgcaggaaaacaagtacaaggaagccatcggattttatgagcccatagtcaaaaagcattatgacaatatcctcaatgtcagcgctatcgtcctcgccaacctgtgcgtgtcatatattatgacctcacagaatgaggaggcagaggaattgatgcggaagatcgagaaggaagaggaacagctgagttacgacgatcccgacaagaaaatgtatcacctgtgtatcgttaatcttgtcattggcacactgtattgtgccaaagggaattatgattttgggatctcaagggtgatcaagtctctggagccctacaacaaaaaactcggcacggacacttggtactatgctaagcgctgttttctctctctgttagagaacatgtcaaagcatacgattatgcttcgggactcggtaattcaggaatgtgttcagtttctggaacactgtgagctgcacggcaggaatattcctgccgtgatagagcagcccctggaagaggaacggatgcacgttggtaaaaataccgtaacctatgaatcccgccaactgaaggccctgatctacgagatcatcggctggaacatttag

SEQ ID NO: 60244 - DNA, 1857 bp, Artificial Sequence
  Description of Artificial Sequence: Synthetic coding sequence
atggctggcctgtctggggctcagattcctgacggtgaatttgccctggcagccgagtgctacgagcaattgggccagcttcatcctgaactggaacaatacagattgtatcaggctcaggccctgtacaaagcatgcttgtatgccgaggcaacacgcgttgctttcctgttgttagacaaccctgcataccacagtagagtcttgcggctgcaggctgccattaagtacagcgaaggggatctccctgggagcaggagtcttgtggagcaacttccaagtcgggaaggaggagaagagagtgggggagagaatgagaccgatggacaaatcaaccttggatgtctgctttacaaagaggggcagtacgaggctgcctgtagtaaatttttcgcagccttacaagccagcggctaccagccagacctctcatataatctggccttagcctactatagtagtcgccagtatgcctccgctctcaaacacatagctgaaattatcgaacggggtatccgtcaacacccagaactgggggtgggaatgacaactgaaggaatcgacgtgcggtcagtggggaataccctggtcctgcatcagacagcacttgtggaggcattcaatctaaaagcagcaattgaatatcagctgcggaactacgaggctgcccaggaagccctgactgacatgcccccacgagccgaggaagaactagatcccgtgactttacacaatcaggccctcatgaacatggatgcccgtcctaccgaggggtttgagaagcttcagttcctcctacagcaaaacccgttcccgccagaaaccttcggaaacttgttgttgctgtactgcaagtacgagtattttgacctggcagccgatgttctggccgagaatgcccacctaatctacaagttcctgaccccctacttgtatgacttccttgacgccgtcattacctgccagaccgcccctgaggaagctttcattaaattagatggattggcaggcatgttaacagaggtgctcagaaaactcacaatccaagttcaggaagctcgacacaacagggatgacgaagcgatcaagaaggccgtgaatgaatatgacgagactatggaaaaatatatcccagtgttaatggctcaagctaagatctactggaatctggaaaattacccaatggtggagaagatatttcgcaaatcagtggagttttgcaacgatcacgatgtgtggaagttgaatgtcgcccacgtgctctttatgcaggagaacaagtacaaggaggcaataggattttatgaaccgattgtcaagaaacattacgataatattctcaatgtttcagcgatcgtcctagccaatctgtgcgtatcctatattatgactagccagaacgaggaagcagaggaacttatgcgcaaaatcgagaaggaggaagagcaacttagttacgacgaccccgacaagaagatgtatcatttgtgcatagtgaatctcgtcattggcaccttatactgcgccaaggggaattatgactttggcatctctagggtgatcaagtctctcgagccttacaataaaaagctggggactgacacgtggtactatgccaagcgctgttttttatccctgttggaaaatatgtccaaacataccattatgctcagagattcagtgattcaggagtgtgttcagtttctcgaacattgtgagctgcatgggagaaatattcctgccgtgatagagcagcccctcgaggaggaacgcatgcacgttggcaaaaataccgtcacctatgaatcccgtcagctgaaagcgctgatatacgagatcatcgggtggaacatatag

SEQ ID NO: 60245 - DNA, 468 bp, Artificial Sequence
  Description of Artificial Sequence: Synthetic coding sequence
atggctccaatcccgaagaccgtcggacgcattaaactggattgcagcctgcgtccttcctgtccattagaggtggccgcagccccaaagctatgcaaagagtttggccctgaggactatggagaggaagacatcgtcgactttttgcgccgactggtcgagagtgatccccagggacttcaccggatccacgttgacggcagttccggcaggttgcagctctggcaccatgactaccttctcggccacctcgacgatgaaggcaagtcgacagggcagagtgaccggggaaagggcgctgagggactggggacgtactgtggcctccgcaaatcattcctttacccaccatttccccaggtgccatcaaaacactgtttcgaggtcccatggcccgtatcaaccctggctctgagttttatgagcccgaaaccccctcaacctgctcccctgccagattccgagtag

SEQ ID NO: 60246 - DNA, 858 bp, Artificial Sequence
  Description of Artificial Sequence: Synthetic coding sequence
atggcccctatcccgaagacagttggcagaattaagctggactgctctctacgccctagctgccccttagaggtggcagcggctcctaaactctgtaaggaatttggcccagaagattacggcgaagaagatatagtggacttcctcagacgcttagtcgaatccgacccgcagggtctgcataggattcacgtggacggcagttccggcaggctacagctttggcatcacgactatctgttgggtcacttggacgatgaaggcaaatcaaccggccagagtgaccgcggaaagggggctgagggactcggaacctattgcggtttgaggaaaagcttcctgtaccccccacaggagtccgagccgtgtccccaaagccccagcgcgtcagctacttttccttccgtgtccgactccctgctgcaggtagccatgcctcagaagctcttggttacggaagaagaagcaaaccggctggccgaggagttggttgcagaggaagagcgcatgaagcagaaagcagaaaagaagcgtttgaaaaaaaagagacagaaggaacgaaagcgccaggagagactggagcagtactgtggcgagcccaaggcctccactacgtctgatggggatgaaagccccccaagctctccgggtaacccagtccagggtcagtgtggagaggaggaagacagtctcgatctgtcaagtacattcgtgtcactcgccctgagaaaagtgggcgactggccattgtcagctcgcagggagaagggacttaaccaggagccccaggggaggggactggccctccagaagatgggtcaagaagaagagtctcctcccactacttcaccttgctag

SEQ ID NO: 60247 - DNA, 603 bp, Artificial Sequence
  Description of Artificial Sequence: Synthetic coding sequence
atgccacagaagctgcttgtcaccgaggaagaggccaatagactggccgaggagttggtcgccgaggaggagagaatgaaacagaaggctgagaagaagcgtctcaaaaaaaaaagacagaaggaaaggaagaggcaagaacgcctggagcagtattgtggagagccaaaggcgagcacaactagcgacggagatgagagcccacccagctcacccggaaaccccgtgcaaggtcagtgtggcgaggaggaggattccctcgatctgagcagcactttcgtgtcattggcactccgaaaggtgggcgattggccgctgtcagccagacgcgaaaagggattgaaccaggaaccgcaagggagaggccctcttgcctgtctccattcttgcattattttacatgtgactgaagctacacccacaagcccctccccaagactccgcgtagagggaccgatactctcaagtccacgcacattacagcgcgctggtacgtcctgggacttagggtctagcatctgtctccgcccagacgagggcgcacctgttccccaccgcgctgggccatgcatctatcccttggttggggacattgtgtggtag

SEQ ID NO: 60248 - DNA, 741 bp, Artificial Sequence
  Description of Artificial Sequence: Synthetic coding sequence
atgccgctccgaattctagattatctgctaggtcatctggacgacgaaggaaaatctaccggccagtccgatagaggaaaaggagctgagggacttgggacctactgcgggctgagaaaatcatttctctaccccccacaagagtccgagccttgtccacaatccccttctgcctcagctaccttcccatctgtttcggacagcctgctgcaggtcgccatgccgcagaagctgcttgtgacagaagaagaggccaacagattagcagaggaattagtagccgaagaagagcgcatgaagcagaaagccgagaaaaagcgtctcaagaagaagcgccagaaagagcgtaaaaggcaggaacgcctagaacagtactgcggagaacccaaagcctcaaccactagtgacggagacgaaagcccccctagctctcccggaaatcccgttcagggtcaatgcggcgaagaagaagattccctggacctgagctctactttcgtatctttggctctcagaaaggtgggagactggccgctgagcgcccgaagagagaaaggactgaaccaagaaccccaggggagaggattggcccttcagaagatggggcaggaagaggagagtcctcctcgtgaagaacgacctcaacagagccccaaggtacaggtgagatggttgaagaacctaatccagctggagccctggaagggccacaaagagttgcttggcagacacagggtgtag

SEQ ID NO: 60249 - DNA, 2514 bp, Artificial Sequence
  Description of Artificial Sequence: Synthetic coding sequence
atggcgagaggtgagaggcggagacgagctgtgccagctgaaggcgtgagaactgcagagagagccgcaaggggaggaccaggtagacgcgacgggaggggaggaggaccacggagcacagcgggtggtgtcgcacttgcagtggtcgtcctgtcactcgccctaggaatgagcggacgatgggttctggcttggtatcgagctcggagggcagtgaccctccattctgcccctccagtgctgccggctgattcctctagtccggcagtcgccccagacctattttggggaacctacaggccccacgtatattttggaatgaaaacgcggtcccccaaacctctcctgaccggcctgatgtgggcgcagcaggggaccactcctggcacgcccaaacttcgtcatacttgcgagcagggcgacggcgttgggccatatggttgggagttccatgacggtctgtcttttgggagacagcacattcaagacggggctttacggctcacgacagaattcgtcaaacgccctgggggacagcatggaggagattggtcctggcgggttactgttgagcctcaggattctggaacctctgcactacccttggtgtcgctgttcttttacgttgtgaccgatgggaaagaagtgctcctgcctgaagtgggcgctaagggccagctcaagttcatctcaggccacacttcagagttaggcgattttaggttcaccttgttacccccaaccagcccaggagataccgccccaaaatacgggagttataatgtgttctggaccagcaatccaggattgccactgctaacagagatggttaaatctcggctaaactcttggttccagcatcgccctccgggagctcctcccgaaaggtatctgggactcccagggagcttgaaatgggaggataggggtcccagtggccagggccaggggcaatttctcatccagcaagtcaccttgaaaataccaatttcaattgaatttgtctttgagtcaggatccgctcaagccggaggcaatcaggctctgcctcgcctggcaggatcattactcacacaagccttggagtcgcatgcagaggggttccgcgaaagatttgagaagaccttccagctgaaggagaagggactcagtagcggagaacaggtcctggggcaggccgctctatcaggcctgctgggcggaatcgggtacttctatggacagggcctggtccttcctgacatcggggtcgaaggtagcgaacagaaagttgacccggctttgttcccccctgtgcccctctttaccgctgtgccgagtaggagctttttccctagggggttcctgtgggatgagggatttcaccagctggtcgtgcaaaggtgggacccctctttgactagggaggccctcggccactggctgggcttgctgaacgcagatggctggattgggcgagagcaaatccttggcgacgaggctagggccagagttccaccagagtttttagtacaacgcgctgtgcacgcaaatccccctacgctcttactacctgtagctcatatgctcgaggtgggcgatcccgatgatctcgcattccttagaaaagccctgccgcgtctgcatgcctggttcagttggctgcaccagtcccaggctggcccactgcccctttcatatcgttggagaggcagggacccagcgctgcccacgctgctgaacccaaagacactcccttctggattagatgattacccacgcgctagccacccatctgtcacagaaaggcatctggatttgcggtgctgggttgcactcggggcaagggtcctgactcggctggctgaacaccttggagaagcagaggtcgctgcagagctgggtcctctcgctgcgagtctggaggctgccgaaagtttggacgaactacactgggctcctgagctcggggttttcgctgacttcggcaaccacacaaaggccgtgcaactgaaacctcggccaccccagggtctggtccgggttgtcggtcgaccgcagccccagctgcagtacgttgacgccctgggatatgtgtctttattccccttgctgttgcggcttctggaccccacttcgagcaggctgggaccactgctggatatcttggccgattccagacacttgtggtctcccttcggcctgcgttctctggctgctagttccagtttttatggacagaggaatagtgagcacgacccaccttactggagaggcgcagtctggctgaacgttaattatctcgccctgggcgctctgcatcactatggccatctagagggtccccatcaggcgagggccgcaaaactgcacggggaactgcgcgctaacgtcgtggggaacgtgtggagacagtatcaggcaaccgggttcctctgggaacagtactcagatagggatgggagaggcatggggtgtcggccattccacggctggacttcgctggtgctgttggccatggctgaggactattag

SEQ ID NO: 60250 - DNA, 456 bp, Artificial Sequence
  Description of Artificial Sequence: Synthetic coding sequence
atggagggtcagagacaggagtctcacgctaccctgaccctggcccaggctcacttcaataacggggagtacgcagaagcagaggccttgtactccgcctacatcaggcgatgcgcctgcgcggcaagttccgacgaatccccgggatccaaatgcagccctgaagatcttgctaccgcctataacaacagaggccaaataaagtattttcgggtggatttctacgaagccatggatgattatacatccgctatagaggtgcagccgaatttcgaggttccctactacaatcgcggtctgattctctatcgactaggatatttcgacgatgcactggaagatttcaagaaagtcctagaccttaatcctggttttcaggatgccaccctgtccttgaagcagaccattctagataaggaagaaaaacagcgacgtaatgtggccaagaactactag

SEQ ID NO: 60251 - DNA, 789 bp, Artificial Sequence
  Description of Artificial Sequence: Synthetic coding sequence
atggcatcctttggctggaagcgtaaaatcggcgaaaaggtgagtaaggtgacatcgcagcagttcgaagctgaagcggctgatgaaaaggatgtggtcgacaacgacgagggcaactggctccacgcgatcaaaaggcgaaaagaaattctgcttgaaggctgcgcagaaaagtctaagcagttgaaagacgagggagcttccttggccgagaacaagcggtaccgcgaagctattcagaagtgggatgaagcccttcagttgactccaaatgacgcgactctctacgagatgaaaagtcaggtattgatgtccctgcacgagatgttcccggctgtccatgccgcagaaatggctgtccagcagaaccctcatagctgggagtcatggcagaccctcgggcgagcacagctcggccttggggaaatcattctcgccatcaggagcttccaagtggccctgcacatctatccaatgaatccagaaatctggaaggaagatctatcctgggccagaaccctacaggaacagcaaaaagttgcccaacgcataaagaaatctgaagcacccgctgaggtgacccacttctctcccaagtctatcccagattacgactttgaatccgacgagatagtggccgtgtgcgcagctattgcggaaaaagagaaaactgtttccgctaacaaaacaatggtcattgtgagtgcatcgggggcaattgaaacagtgaccgagaaggaggatggcgcaacgcctccagacggtagtgtattcatcaaggccagatag

SEQ ID NO: 60252 - DNA, 1701 bp, Artificial Sequence
  Description of Artificial Sequence: Synthetic coding sequence
atgcttcagcgctctcctagagccggtcccagtagagcccagggcaggcgggaggctgcagagactggtgggcctaccacccaggaaggtgtcgcctgtggggttcaccagctggctacactcctcatggagctcgactccgaggatgaagcctctaggcttctcgccgctgacgccctgtataggcttggccgactggaggagactcacaaagctctactggtggccttgtcacggaggccccaggcagcacctgtcctggctaggctggcattattacagctccggagaggatttttctatgatgccaatcagctggtcaagaaactcgtccagagtggcgacaccgcctgcctccaacccactcttgacgtgttctgccacgaggaccgccagctcctgcaaggacactgtcacgcccgagccctggctatcctgcgagccaggccagggggtgcggatggacgggtccacacaaaagaggcgattgcctacctgtcacttgcgatttttgcagccggatcacaggcctcagagtctctccttgctagggctagatgctacgggttcttgggccagaagaaaacagcgatgtttgacttcaacacagttctaagagctgaacctggaaacgtccaagccttgtgtggtagagctctggtgcacttggctctggaccagctgcaggaggccgtggatgatatcgtgagcgctctgaaactgggaccaggcacggttgtgcccgaattgcggtcacttaagcctgaagcccaggcccttatcactcaaggtctgtactcacactgccgcgctctgttaagccagctgccggataccggcgctcctttggaggacaaggatacgcagggcttactggctgtaggtgaggccctgataaagattgatagcggccaaccccactggcatctgttgttagcagatatcttgatggcccagggcagttacgaagaggctgggacccacctggagaaggccctgcacagagcccctacctctgaggccgctcgcgctcgcctggggttgctgcagttaaagaagggtgatgtgccgggagcagcaagagaccttcagtctctggcggaagtggacgcccctgacctgagttgcctcctccaccttttggaggccagtgagcggcagtcattggcccaagccgcagctcaggaagctggaaccctgctcgatgccggacagccaagacaagctctgggatattgcagtctctccgtgcttgcgtccggcagttcagcttgtcatctgcgactccgcgcaacctgcctggcggaactgcaggagtttggcagagcccttagagatctagatcacgtcctgcaagaagccctgggtgatggggatctgcccaggcgagcagaagacttctgtcggcaaggcaggttgttgctctctcttggagacgaggcggcagctgcaggagcatttgcccaggcactcaaactcgcgccttcattggcacagaatagcctttgtcgacagcccggacgagccccaaccgccagaatgtttctcctccggggacagtgttgtttggaagaacagcgtcacgccgaagcttggacagccgtggaatctggcctgctggtggacccggaccatcgcggtttgaagcgcctcaaggccagaatcaggagggaagccagctcaggctgttggctccaatag

SEQ ID NO: 60253 - DNA, 570 bp, Artificial Sequence
  Description of Artificial Sequence: Synthetic coding sequence
atgggaactcccaatgaccaggcagtcctgcaggccatatttaatcccgatacaccattcggcgacattgttggactggacctgggcgaggaagccgaaaaggaggaaagagaggaggacgaggtctttccacaagctcagctcgaacagtcaaaggctttggagctgcagggggtcatggctgccgaggccggagatctaagcactgcgttggaacggtttgggcaggccatttgcctccttcctgaacgtgcctccgcctataacaacagagcccaggccagacggctccagggggacgtggcaggagctcttgaggatctggagcgggcagtggaactgtcggggggacgtggccgagctgcccgacagtctttcgtgcagaggggcctcttggcacgtctccagggacgtgacgatgacgccagacgtgattttgagcgcgctgctagacttgggagtccatttgcccgacggcagctcgtcctgctcaatccatatgcagccctttgtaaccgaatgctcgctgacatgatggggcaactgcgtcgtccgagagactcccgctag

SEQ ID NO: 60254 - DNA, 393 bp, Artificial Sequence
  Description of Artificial Sequence: Synthetic coding sequence
atggcagcagaagcaggagacctcagcacagcactggagagattcggacaagccatatgcttgctccctgagcgtgccagtgcctataataatcgtgctcaggccagacgactccaaggcgacgtagccggtgctctcgaagatttggaacgggcagtggaactctccggcggaagaggacgggcagccagacagtcattcgttcaaagaggattgttggcacgcttacagggcagggacgacgatgccagacgagattttgaacgggcagcacgcctcggttccccttttgcgagacgccaactggtccttttgaatccctatgccgcactatgcaataggatgctggccgatatgatggggcagctgagaaggcctagagacagtcggtag

SEQ ID NO: 60255 - DNA, 4695 bp, Artificial Sequence
  Description of Artificial Sequence: Synthetic coding sequence
atgtcttccaaggaagtgaagaccgccctcaagtccgctagggatgctatacggaacaaggaatataaggaagcccttaagcactgcaaaacagttctcaagcaggagaagaataattataatgcatgggtgttcattggagtggctgccgcagaattggaacagcctgaccaggcccagtccgcatataaaaaggccgcagaactcgagcccgatcagctactcgcctggcaggggttagccaacctgtacgaaaaatataatcacataaatgccaaggatgacctaccgggagtgtaccagaagcttttggacctgtacgaatccgttgacaagcaaaaatggtgtgatgtctgcaagaaactcgtagacctgtactatcaggagaagaagcaccttgaggttgcccgtacatggcacaagcttatcaagacccgacaggagcaaggagcagagaatgaagaactccatcagttgtggagaaagctaactcaattcctggcagagagcaccgaggaccagaacaacgagacacaacaactactgttcaccgctttcgagaatgcactggggctgtcagacaaaataccttctgaagaccaccaggtactttacagacactttatccagtctctctccaagttcccccacgaatctgccagactgaagaaggcctgcgagggtatgataaatatataccctacagtgcagtacccgctggaagtgctgtgtctgcacctgatcgaaagcggaaacctcacggatgaagggcagcaatactgttgtagactggtggaaatggattcaaagtcaggcccagggctcattggcttaggcataaaggccctccaggataagaagtacgaggatgctgtccggaatctcacggaaggcctgaaagagtcccctgtgtgtacatcaggttggtaccacctagcggaagcccaggtgaaaatgcatcgcccaaaagaggccgtcctgagctgtagtcaagcacttaagatcgtggataacctcggcgctagtggtaatagcctgtatcagcggaatctttgtttgcatttaaaagcagaggccctgatcaagctgtccgattacgattcgtccgaagaagctatccggaccctggaccagattagtgacgccgacaacatacccggactgctcgtgttaaaaagcctcgcctataggaacaaggggtcattcgatgaggctgccaagatcatggaggacctcctgagctcttatccggatctagcagaagtccacgccctcgaggctctcatacactttactaaaaaagattatctacaggcagagaagtgttttcagcgcgctctagagaaggacacggaggtcgcagagtaccactatcagttgggactcacctactggttcatgggtgaagagacaagaaaagacaagaccaaggcactcacacattttttgaaggcagccagactggacacgtatatggggaaggtgttttgctacctgggccattattatagagacgtcgttggtgataagaatcgagctagaggatgctataggaaggcattcgagctggacgacaccgacgctgagtccggcgcagcagcagtggatctgtctgttgagctcgaggacatggagatggctttggccatcctgactactgtgacccaaaaagcgagtgcgggaactgccaagtgggcatggttacggcgtgggctatattatcttaaggctgggcagcattctcaggcggtggctgacctgcaggcagcacttcgggcagacccgaaagacttcaattgctgggaatcgctgggtgaggcttacctgtctcggggagggtacaccactgctctgaagagcttcaccaaggcctcggagttgaatcccgagagcatatactccgtctttaaagtagcagccattcagcaaatactcggaaaatacaaggaggcagtggctcagtatcagatgatcattaagaagaaggaagactatgtccctgccctgaaagggctgggcgagtgtcacctaatgatggccaaggctgccttggtcgactatctggacggcaaagccgtagattatatagagaaggcgctggagtatttcacatgcgcacttcagcaccgcgctgacgtgtcctgcttgtggaagctggctggggatgcctgtacatgcttgtacgcagtggcaccctctaaggtaaacgtacatgtgctgggtgtccttctgggccagaaagagggtaagcaggttctgaagaagaacgagctgctgcatctcggtggccgatgctacggcagagcactaaagttaatgagtacgagtaatacctggtgtgaccttggtattaattattaccgccaggctcaacaccttgcagagacaggctctaacatgaatgacctcaaggaactactggaaaaatccttgcactgtttaaaaaaagcggttaggctcgactctaataaccacctatactggaatgctctgggagtcgtcgcctgttattcagggattggtaactatgctctcgctcagcattgctttataaagtccatccagtctgaacaaattaacgccgtggcctggactaaccttggggtgctttaccttactaacgaaaacattgagcaggctcacgaggcatttaaaatggctcagtctctggatccaagttacctgatgtgctggatcggacaggctctgattgccgaagccgttgggtcgtatgatactatggacctgttcagacatacgaccgagctgaacatgcatacggagggcgcactagggtatgcctattgggtgtgtacaactttgcaagataaatcaaacagagaaaccgagctgtaccaatacaatattctgcagatgaatgctattcctgctgctcaggtcatcctgaacaaatatgtagagcggatccaaaattatgccccagccttcaccatgttggggtatttaaatgagcacctccagctcaaaaaagaggcagccaacgcataccaacgtgccatccttcttttgcagacagcagaggaccaggatacctataacgtggccatccgcaactacggaaggttgttatgctcaacgggcgagtacgacaaggccattcaagcctttaagagcacaccactggaagtgcttgaggacattatcggttttgccctcgcgctgtttatgaagggcctgtacaaggaaagctcaaaggcctacgagcgagccctgagcatcgttgaatccgagcaagacaaggcacatattctgacagcattagccatcacggagtataaacagggcaagactgacgtggctaaaactctgttatttaagtgtagcatcttgaaggagcccaccaccgagagtctgcaggcactctgcgcgcttggtctggctatgcaagacgccacactctcaaaggctgccctaaatgagctgcttaaacatataaaacataaagactccaattatcagcgctgtttgctaacgtctgcaatatatgcactccagggcagaagtgttgccgtgcagaaacagatatctaaagctgttcacagtaaccccggagaccctgccttgtggagcctgttgtctcgtgtggtcgcacagtacgcccaacgcaatgctaaaggaggagttgtcgctggcaacgttgcccacattctggattccaatcacggcaagaaggctctattgtacacagcagtcaatcagctcgcaatgggatcttcctctgccgaagacgagaaaaatactgcgctcaagacgatccaaaaggccgcactgctctcaccaggcgatcccgctatatgggccggactcatggctgcctgccatgcagatgacaagttggcactggtgaacaatacgcagccaaaaagaattgacctctacctggccctcctgagcgccgtgtccgcctctataaaagatgaaaagtttttcgagaattacaaccaatccttagaaaagtggtccctgtctcaggccgtcacagggctcattgatactggtcggatctccgaggcagaaaccctttgcacgaaaaatctgaagagcaatcccgatcagccagcggtgattctcctgttgaggcaggtccagtgcaagcccttactggagtcacagaaacccttacctgacgccgtactggaagaattacagaaaaccgtgatgtcgaattctacctctgtgcccgcatggcaatggctagcccatgtctaccagagtcaaggcatgatgagagcagctgaaatgtgctatcggaagagcctccaattagctagtcagcggggatcttggagtgggaagctttcatcactgctaagactcgctttgctggccctgaaggtgtgcatggctaatatcagtaacgatcactggccttccttagtgcaggaggccacaacggaagcacttaagctgtgcttttgccctctggccgtgcttcttcaagctttactccagttcaaacgaaagatgggggctcgcgaaactcgaaggctcctcgagcgggttgtgtaccaacctggttatccgaagagtatcgccagcacagccaggtggtacctgttgcgccacctgtacgcaaaggatgattacgaattaatcgacgtacttgttaacaatgctaagacccacggggacactagagcactggagctcaatcaaaggctgagctcccagtag

SEQ ID NO: 60256 - DNA, 288 bp, Artificial Sequence
  Description of Artificial Sequence: Synthetic coding sequence
atgagttccaaagaggttaagactgctttgaagagcgccagggacgcgattagaaacaaggagtacaaagaagccctcaaacactgcaaaaccgtgcttaaacaggaaaaaaacaattataacgcttgggtctttatcggggttgccgcagcagagttggagcagcccgaccaggcccagtccgcttacaaaaaggcggctgaactggaacctgatcagctgttggcgtggcaggggttggctaatctgtatgagaaatacaaccacatcaacgcaaaggacgactag

SEQ ID NO: 60257 - DNA, 1236 bp, Artificial Sequence
  Description of Artificial Sequence: Synthetic coding sequence
atggctgccgcatccccactgcgcgattgccaggcatggaaagatgctaggttacccttaagtaccacatcaaacgaggcctgtaagctgttcgatgcaactttgacgcagtacgtgaaatggaccaatgacaaatccctgggcggtatcgaaggctgcctcagtaagctcaaagccgctgacccgacttttgttatgggccatgctatggcaaccggtttggtcctaataggaacgggctcatcagtgaagcttgacaaagagttagatctggcagttaagacgatggttgagattagccggacacaacccctaacacgcagagagcaactgcacgttagtgcagtggagacatttgcaaatggatacgtgaaggggatatacagctttggtctaatggagaccaatttctatgatcaggcagaaaagctcgcaaaggaagctttgtctataaatcctaccgatgcctggtccgtgcataccgttgcccacatccacgaaatgaaggccgagatcaaggatggcttggagttcatgcagcactccgaaactttttggaaagatagtgacatgctggcctgccataattactggcactgggccctgtatctcattgagaaaggagagtatgaggccgcattgaccatctatgacactcatatacttccatctctccaggccaacgatgctatgctggacgtggtcgacagctgttctatgctgtatcgcctgcagatggagggggtatcagtgggtcagcgttggcaggacgtcctccccgtcgcccgaaagcattcccgagaccacatcctgcttttcaacgatgcccactttctgatggcaagcttaggggctcatgacccacagaccactcaagagttactgaccacactcagagatgccagcgagagccctggagagaattgtcagcacctgcttgctcgcgacgtaggcctccctttatgtcaggcccttgtcgaggcagaagatgggaaccccgacagagtgctcgagttactgctcccgatccgttataggattgtccaattggggggtagcaatgcacagcgtgatgtgtttaaccagttactgattcatgcagctctgaattgcacaagctcggtgcacaaaaacgtcgccaggagtctgctcatggaacgggatgcacttaagccgaattctcccctgacagaaaggttgatcagaaaagcagccacagttcaccttatgcagtag

SEQ ID NO: 60258 - DNA, 1410 bp, Artificial Sequence
  Description of Artificial Sequence: Synthetic coding sequence
atggccgctgcatctccactgcgggattgccaggcgtggaaggatgccagacttccactctcgaccaccagcaacgaagcttgcaagctattcgacgcgactctgacccaatatgtgaagtggaccaatgataagtcactgggaggcattgaggggtgcttaagcaaattgaaggccgctgatccaacattcgtcatgggccatgctatggctactggactagttttgatcggcacagggtcctccgtaaaattggacaaggaattagatttggccgtgaaaacaatggtggagataagccgtacgcagcccctaacacggcgagaacagctgcacgtgtccgccgtcgaaacctttgcgaacggtaattttcccaaggcttgtgagctctgggagcagatcttgcaagatcatccaacagatatgctggcactcaagttcagtcacgacgcctatttttacctgggatatcaggagcagatgagagattcagtggctaggatttaccccttctggacccctgatattcccctatcctcctacgtgaaagggatttacagcttcgggctgatggagaccaatttctatgatcaggccgaaaagctagccaaagaagccctttccatcaaccctaccgatgcctggagcgtgcacaccgttgcccacatccacgagatgaaagctgaaatcaaggatggactcgaattcatgcaacactctgaaacattctggaaggattcagacatgctggcatgccacaactattggcattgggctctgtacctaatcgagaagggagagtacgaggccgcactgactatttacgatacgcatatcctcccaagtttacaagcaaacgacgccatgctggacgttgttgacagctgttcaatgctttataggttgcagatggaaggagtctctgttggccaaaggtggcaagacgtgcttcccgtagccagaaagcatagcagagaccacatcctcttattcaacgatgctcacttcttgatggcctcattgggggctcatgacccgcagacaacccaggaactgcttaccacactgcgggacgcatctgagtctcctggagaaaattgtcagcatctgctcgcccgagacgtgggcctgcctctgtgccaggccctcgttgaggccgaagatggcaatcctgaccgggtgctggaactgctgttgcctatacgctatcggattgtgcagctcgggggaagcaacgcccagagggacgtgttcaatcagttgctcattcacgccgcactcaactgcacgagtagcgtgcacaagaatgttgctaggtccctgctcatggaaagagatgctctgaagcctaattctcccttgacagagcgtctcatccgcaaggctgccaccgttcacctgatgcagtag

SEQ ID NO: 60259 - DNA, 1263 bp, Artificial Sequence
  Description of Artificial Sequence: Synthetic coding sequence
atggactctagtcctagcctgcccttaataagaacccctgaatccagcctccacgaggccctggaccagtgtatgactgccttggatctgttcctcaccaatcagttttctgaggcgttgtcatacctgaaaccgcgaacaaaagaatctatgtaccactccctgacttacgcgaccattttggagatgcaagcaatgatgacatttgatccccaggacatcttactggcgggaaacatgatgaaagaagcgcagatgttgtgccagcggcacagacgtaagtcttctgtgaccgatagcttttcttcccttgtcaacagacctacactgggccagtttacagaggaggagattcacgctgaggtatgttacgctgagtgccttctccagcgggctgccctgacattcctccagggaagctcccatggaggtgccgttcgcccaagagctctgcatgacccaagtcacgcctgctcgtgccccccaggtcccggtcgtcaacatctgttcctgctgcaggacgagaacatggtctcctttattaaaggtggcataaaggtgcgcaactcctatcagacctataaagaactggattccctagtccaatcttcccagtactgcaaaggcgagaatcacccccacttcgaaggcggagtgaagctcggagtcggagccttcaatctgacactcagtatgcttcccactcgaatcctccgcttgttagagtttgtgggtttcagtggtaacaaggattacggactgctgcagcttgaggagggagcgtcagggcactccttccgctctgtgctgtgtgtgatgcttctcttgtgttaccacacatttttaaccttcgtactgggcacgggcaacgtgaatatcgaagaagccgagaaactattaaagccataccttaatcggtatccaaagggcgcaatcttcctattttttgccggacgaatcgaggttattaaaggcaatatagacgcggtgtccgacggcggaccaggccgtggctgggggtccctcggtgtctctcagacatcaagaaaatccggaacatgcgacatcctgcgggaccgcatcgactggggaaggggaggcggtcaggagaggacgaatcagagggccggtgctggggaggcacttctggcagagcaacctggcaaaactagagaggaggaggcctttgtagtgcctggtattctcactggcaggtatcgtactgctgccttgcagtggcgagaggtggagggtggagcctag

SEQ ID NO: 60260 - DNA, 1737 bp, Artificial Sequence
  Description of Artificial Sequence: Synthetic coding sequence
atgggtcagaaaggacacaaggattcattatatccatgtgggggtacaccagagtcctcgttgcacgaagccttggatcagtgcatgactgccctcgatctcttcctgactaaccaattctcagaggcgctgagttacctgaaaccccgaaccaaggagtctatgtaccactctctgacatacgcgaccattctcgagatgcaggcaatgatgactttcgatcctcaagatatactgcttgcaggcaacatgatgaaggaggcccagatgctctgtcagaggcatagaaggaagtccagcgtgacggactctttctcctctctcgtcaacagaccgaccctgggtcaatttaccgaagaagagatacacgctgaggtgtgctacgccgaatgcttactccaaagggcagctctgaccttcttgcaggacgaaaacatggtgtcctttattaaagggggtatcaaagtcaggaattcataccagacgtacaaggaattggattccctggtgcaaagctcccagtattgcaagggtgagaatcacccccactttgagggtggagttaaattgggtgtgggcgcatttaacctgaccctatccatgctgcccactcgaatattgcgactccttgagtttgtgggcttttccggaaataaagattatggcctcttacagctcgaggagggagcttcgggtcactcgttccggagtgtgctctgcgttatgctccttctgtgttatcatacgttcctcacctttgtcctggggactggaaacgttaatatagaggaggccgagaagttgcttaagccctacctaaacaggtacccaaaaggcgctatctttctcttcttcgccggtaggatcgaggttatcaaagggaacatcgacgcagccatccgccgatttgaggagtgctgtgaggcccagcagcactggaaacagttccaccacatgtgttattgggagctcatgtggtgctttacatacaaagggcagtggaagatgagttacttttacgccgatttactcagcaaagaaaactgctggtcgaaggcaacttatatttatatgaaggctgcttatctgtccatgttcggcaaagaggatcataagcccttcggcgacgacgaggtggagctcttccgagccgttcctggcctgaagctgaagatcgctggcaagtccctacccacagagaagttcgccattagaaaatctcggaggtacttcagcagcaaccccatatccctgccagtcccagcactggagatgatgtatatttggaatgggtatgccgtcatcgggaaacagccaaaattgacagatgggattcttgagattatcacaaaagctgaggagatgctggaaaagggaccagagaacgagtactctgtggatgacgaatgccttgtgaaactgctgaagggactgtgcctgaagtatctgggacgcgtacaggaggccgaagagaattttcggtcaatttccgcaaacgagaagaaaatcaaatatgaccactatctcatacccaacgcgctgctggagctcgcacttttattgatggaacaggatagaaatgaagaagctatcaagctgctcgagtccgccaagcaaaactacaagaactattcgatggagagccggacccattttcgcatccaggctgccacactccaagccaaatcaagcttggagaatagctcaagatccatggtgagcagcgtcagtctttag

SEQ ID NO: 60261 - DNA, 1746 bp, Artificial Sequence
  Description of Artificial Sequence: Synthetic coding sequence
atggccttcctaacaacttggaaggaagcagcgtcaggcaagtcggatcgaaggactcccgagtcaagcctccatgaagcactggaccagtgtatgactgctctagatttgtttctgactaatcagttcagcgaggcgctcagctacctgaagcccaggaccaaggagtcgatgtaccactctctgacttacgcgaccatcctggagatgcaggctatgatgacttttgatccgcaagacatactcctggcaggcaatatgatgaaggaggcccagatgctttgtcagcgccaccggcgtaaatcaagcgtaaccgattctttctcctctctggtgaatcggccaacacttggacaattcacagaagaagaaatacacgctgaggtgtgttacgcagagtgcctgctgcaacgagctgcgctgactttcctgcaggacgaaaatatggtgtcttttattaagggcggtatcaaggtgagaaattcatatcaaacttacaaagagctggattcgctggtgcagagctctcagtactgcaaaggggaaaatcacccacacttcgaaggaggtgttaagctaggtgtgggcgcatttaatctaaccctctcaatgctccccacccgcatccttcggcttctggagttcgttggttttagtgggaacaaagattacggtctgctccagctagaagaaggcgcatcgggacatagcttcagatctgtgttatgtgtgatgcttctgctgtgttatcataccttcctcacattcgttctcggtacgggcaacgtgaatatagaggaagctgaaaaattgttgaaaccgtacctaaaccggtatcctaaaggggcaatcttcttgtttttcgcaggccgtatagaggttatcaaaggtaatatagacgccgcaatcaggaggttcgaagagtgttgcgaggcgcagcagcactggaaacagttccaccatatgtgctactgggagctgatgtggtgtttcacttacaagggccaatggaaaatgtcctacttctacgccgatctgctcagcaaagagaattgttggtccaaggccacatatatctacatgaaagctgcttacttatctatgtttggtaaagaggaccacaaaccctttggcgatgatgaggtggagcttttccgggcagttccgggactgaagcttaagatagccggtaagtccctcccgactgaaaagttcgcgattcggaagtctaggagatatttttcatccaaccctatcagtctgccagtaccagcccttgaaatgatgtatatttggaatggatacgccgtgatcgggaaacagcccaaactgacagatggtattctcgagattattacaaaggccgaagaaatgctcgaaaaaggccctgaaaacgaatatagtgtagatgacgagtgcctcgtaaaattgcttaagggcctctgcctgaagtatctgggacgggttcaggaggcagaagagaattttaggtccatttcggccaacgagaagaagatcaaatatgaccactatttgattcctaacgcgctgctggagctcgctctgttgctgatggagcaggataggaatgaggaggccatcaagctcctggagagcgccaaacagaattacaaaaactattctatggagtctcggactcacttccgaatccaagctgctaccctgcaagccaaaagttccctggaaaacagctcccgaagcatggtctcatctgttagtctgtag

SEQ ID NO: 60262 - DNA, 1842 bp, Artificial Sequence
  Description of Artificial Sequence: Synthetic coding sequence
atgggccaaaaaggacacaaagatagcctgtatccgtgtggcggtacccccgagagcagcctgcacgaggccttagatcagtgtatgaccgcacttgacctgttcctaacgaatcagttttctgaggcactcagctatttgaaaccaaggacaaaagagtcaatgtatcactcccttacttacgcaacaatcctggaaatgcaggccatgatgactttcgacccgcaggatatactgctggcgggtaatatgatgaaagaagcgcagatgctgtgtcagagacaccggagaaaatctagcgtaacggactctttctcaagcctggtcaatcgccctaccctgggacagttcactgaagaagagattcacgccgaggtctgttatgccgagtgcctcctgcaacgggcagccctaacctttctgcagggctcttcacatggcggtgcagtgcgtcccagggcactccacgatccatcacacgcctgttcatgtccccctgggcctggcagacagcacctttttttgctccaggacgaaaacatggtcagctttatcaaaggcggtataaaggtgcggaatagttaccagacgtacaaagaactggacagcctcgtgcagtcaagtcagtactgcaagggcgagaaccacccacacttcgagggcggagttaagctgggagtcggggcattcaatctgacattatctatgctccccacccgcattctgcggctcctggaattcgtgggatttagcggtaacaaggattacgggctgctccaactggaagagggtgcaagcggtcattctttccggagtgtgttgtgcgtgatgctcctgctgtgttatcatacctttctcacattcgttctcggcacaggcaacgtgaacatagaagaggcggaaaagttgctcaaaccatatctcaatagatatccaaagggcgcaatttttctctttttcgcaggaaggatcgaggtgataaaaggtaacatcgatgctgccattaggagattcgaagagtgctgtgaagcccagcaacactggaagcagtttcaccatatgtgttattgggagcttatgtggtgctttacgtacaagggacagtggaaaatgtcatatttctacgccgatctgctgtcaaaggagaactgctggagtaaggccacatacatatacatgaaggcagcctatttgtccatgtttggcaaggaagatcacaagccattcggagacgacgaagtggagctgtttagggccgtcccgggtcttaaattgaagatcgccggaaagtcgctacctacagagaaatttgcaattaggaagtctcgacgttacttttccagcaatcccatctccctccccgtgcctgctctggaaatgatgtacatctggaacggctatgccgtaatcgggaagcagccaaaactcaccgatgggattctggagatcatcaccaaggccgaggagatgctggaaaagggcccagaaaacgaatactcagtggacgatgaatgtctggtgaaacttttgaagggcctgtgtctgaagtaccttgggagggtccaagaggccgaggagaatttcaggtctatctctgcaaatgaaaaaaaaataaagtacgaccattacctgattccaaacgccctgcttgaacttgccctgctgctcatggaacaggacaggaacgaagaagccataaagctgctcgagtcagctaagcagaactataagaactactctatggaatcgaggacacatttccgcatccaggcagcgactttacaggcgaagtcaagcctggagaactcttctagaagtatggtgtccagcgtatccctttag

SEQ ID NO: 60263 - DNA, 1734 bp, Artificial Sequence
  Description of Artificial Sequence: Synthetic coding sequence
atgacatctgccggtggcgctccaggagcacttcccgctggaacaccggaatcgtctttgcacgaagctttagatcagtgtatgacagcccttgatctgtttctgaccaatcaattcagtgaagccttatcctacctgaagcctcgtaccaaggagtccatgtatcacagcttaacatacgctacgatccttgagatgcaggcaatgatgactttcgacccacaagatatcttattggccggaaacatgatgaaggaggctcaaatgctctgccaaagacaccggagaaagtccagcgtgacagactccttttccagtctggttaataggccaacactgggacagtttacagaggaagaaattcatgcagaggtatgttatgctgaatgccttctgcaacgcgcagctctgacctttctgcaggatgagaatatggtgagcttcattaaagggggtattaaagttaggaattcatatcagacttataaagaactggatagcctcgtgcagagctctcagtactgtaagggtgaaaatcaccctcacttcgagggaggcgtaaaactcggagtaggagctttcaatcttaccctctccatgcttccaacaaggattctcagactcttagaatttgtaggcttttcgggaaacaaggactacggcctgctgcagttggaagagggggcatccggtcattcttttcgctccgtgctgtgcgtcatgctgcttctatgctaccacacatttctgacattcgttctcggcaccggtaacgttaatatagaggaggcagagaaactgttgaagccctacttaaacagatatccaaaaggcgctatcttcctgttttttgctggtcgtatcgaagtcatcaaaggtaatatcgacgcggctatccgccgtttcgaggagtgctgtgaggctcaacagcactggaaacagtttcaccatatgtgttattgggagctgatgtggtgtttcacctataaaggccagtggaaaatgtcctacttttacgctgacctcctatctaaagaaaattgctggtctaaggcgacatacatctatatgaaggcagcttacctgtccatgttcggcaaggaagaccataaaccattcggagatgacgaggtagaactgtttcgggcagtgcccggacttaagctcaaaatcgctggcaaatccctgcctaccgagaaattcgccatccgaaaaagccgacgctacttttcaagtaaccccatcagcttgcccgtaccggctctcgagatgatgtacatctggaacgggtacgccgtcatcggaaagcaaccaaaactgacagatggcatactggagataataacgaaagcagaggaaatgctggaaaagggacctgaaaacgaatactcagtggacgacgaatgcctagttaagctgctgaagggactttgtctaaagtacctggggagagtgcaagaggcagaggagaatttccgctccatctctgcgaatgagaaaaaaatcaaatatgatcactacctcatcccgaatgccctccttgaactggcactgcttctaatggagcaggataggaatgaagaagccatcaagttgcttgagtccgccaagcagaactacaaaaactactccatggaatcccgcacccacttccggatccaagcggctactctccaagctaagtcaagcctggagaattcaagtcgctccatggtgtcttctgttagtttatag

SEQ ID NO: 60264 - DNA, 339 bp, Artificial Sequence
  Description of Artificial Sequence: Synthetic coding sequence
atgaaggccgcttatctgtcaatgttcggcaaggaggaccataagcctttcggagacgatgaagtggaattgttcagagcagtgcctggcttgaaacttaagatcgctggcaaatcactcccgaccgagaaattcgccatcaggaaaagtcgaaggtatttctcctccaatccaatttctctgcccgtgcctgccctcgagatgatgtacatctggaatggctatgccgtgatcggcaaacagcctaagctcacagacgggatcctggagatcattacgaaagctgaagaaatgctggagaaagggccagagaatgaatacagtgtcgacgacgagtag

SEQ ID NO: 60265 - DNA, 666 bp, Artificial Sequence
  Description of Artificial Sequence: Synthetic coding sequence
atgaaggcagcatatctctccatgttcgggaaggaagaccataaaccatttggtgacgacgaagtggaacttttccgtgcagtccctggcctgaaactgaagattgccggaaaaagcctcccaactgaaaaatttgctattcgcaaatcacggagatactttagctcaaatcccatatccttgcctgtcccagccctcgaaatgatgtacatatggaacggctatgcagttattggcaagcagccaaagttaactgacggcattctggaaatcataactaaagccgaggaaatgctggagaaaggaccagaaaacgaatatagtgttgatgacgaatgtctggtcaaattactgaagggtttatgcttgaagtacctcgggagagtgcaggaggctgaggaaaatttcagatccatcagcgctaacgaaaagaaaatcaagtatgaccattatttgatccctaatgccttgctggaattggccttattgctgatggaacaggacagaaatgaagaagccatcaaattgctggaatccgccaagcaaaactacaagaattattccatggaaagccgaacccacttccgcatccaggctgctacattgcaagcaaagagttcccttgagaacagtagccgttctatggtttcttccgtttccttgtag

SEQ ID NO: 60266 - DNA, 1569 bp, Artificial Sequence
  Description of Artificial Sequence: Synthetic coding sequence
atgtctttcggggctagttttgtgagctttctgaatgcgatgatgactttcgaagaagaaaaaatgcagttggcctgtgatgatcttaaaaccaccgaaaagttgtgcgagtctgaagaagccggagtaattgaaactatcaagaacaagattaagaagaacgtggacgtgaggaagagtgctccctctatggttgataggctgcagaggcagattattatcgctgattgccaggtgtatctcgctgtcctaagcttcgttaagcaggaactgtcagcttatatcaagggcggatggatcctcaggaaggcgtggaaaatttacaataagtgctacctggatattaacgctctacaggagctgtatcagaagaagctgacagaggaatcattaacgtcagacgcagctaatgataaccacatcgttgctgaaggcgttagcgaggaaagcctgaatcggttaaagggcgctgtgagcttcggttatggtcttttccatctttgcattagcatggtcccgccaaatctgctcaaaattataaatctgctgggattccctggggataggctgcagggactgagttcactgatgtatgcgagcgaaagtaaagacatgaaagcacccttagccaccctggccttactgtggtaccacaccgttgtacggcctttcttcgctctggacggctctgataacaaagccggtctggacgaggcaaaggaaatcctgctcaaaaaggaggctgcatacccgaatagctccctctttatgttctttaagggcaggatccagcggctcgaatgtcagatcaactcagctctgacgtccttccacacagccctcgagttggcagtcgatcaaagggagattcaacacgtatgcctgtatgagatcgggtggtgctccatgattgaattaaactttaaggatgccttcgattccttcgagcgtctgaaaaacgagtccaggtggagtcagtgttattacgcttacctaacagccgtgtgccagggagcaaccggcgacgtcgacggagcacagattgtctttaaagaggtgcagaagctgttcaaaagaaagaataaccagattgagcaatttagcgtcaaaaaggccgagcgattcagaaaacagacaccaaccaaagcactgtgcgtgctggctagtatcgaggtcctgtatctctggaaggcgttgcctaattgttcctttcccaatttacagaggatgtcgcaggcttgtcacgaggttgatgattcatctgtcgtgggcctaaagtatctgctcctcggagcgatacataaatgtctgggtaactccgaggacgcggtgcagtactttcagagagcagtcaaagatgaactctgcagacagaacaacctctatgtgcagccatatgcctgttacgagctaggatgccttctgttggacaaacctgagaccgtaggcagaggaagggccctgttactccaggctaaagaggatttctctggctatgacttcgaaaatagactgcacgttcgcatccatgccgctctggcgtcccttagagagctggtccctcagtag

SEQ ID NO: 60267 - DNA, 1752 bp, Artificial Sequence
  Description of Artificial Sequence: Synthetic coding sequence
atggccggatccgagcagcaacgtcctaggcgcagagacgatggcgacagcgatgccgctgccgctgctgccgcacctcttcaggacgctgagctggctttggcaggcataaatatgcttctcaataatgggttccgggaatcagatcaactgtttaagcagtacagaaaccacagccccctgatgtcattcggagcctccttcgttagtttcttgaatgccatgatgaccttcgaagaagaaaaaatgcagctggcatgtgacgatctgaagaccaccgaaaagctgtgcgaaagcgaagaggccggtgtgatcgagaccatcaagaataaaatcaaaaaaaatgtggatgtgaggaaatccgcaccttcgatggtagaccggctgcagagacagatcatcattgctgactgccaggtctatcttgccgtcctttctttcgtgaaacaggagctgtccgcctacattaaggggggttggattctgaggaaggcgtggaagatttataacaagtgttacctggacatcaatgccctccaagaactttaccagaagaagctgacagaggaatctctgaccagcgatgcagcaaatgacaatcacatagtggccgagggtgtttccgaggagagtctgaaccgcttgaaaggagctgtgagcttcggctacggcctcttccacctttgcatctccatggtgccccctaaccttctgaagataatcaatctgctaggctttcctggagatcggctgcaggggcttagttctcttatgtacgcgtcagagtccaaagacatgaaggctccattagccactctggccctcctgtggtatcacacagttgtgcgcccatttttcgcgctggacggctctgacaataaagctgggctggacgaagctaaggagatccttttgaagaaagaagctgcttaccctaactcaagcctgtttatgttctttaaaggccgtattcagaggctggaatgccagatcaattccgctctcacatcttttcacaccgctttagaactcgcagtggaccaacgggagatccagcatgtgtgtctgtatgagataggctggtgcagcatgatcgaacttaattttaaggatgccttcgatagttttgaaagactgaagaatgagtcccgatggtctcagtgctattatgcatacctgacggccgtgtgccaaggcgcaactggcgacgtcgatggggcacaaatcgttttcaaggaggtgcagaaactgtttaagcgcaagaacaatcaaattgaacagttctccgtcaagaaagctgagcgcttcaggaagcagactccaaccaaggctctgtgtgtgttggctagtattgaggtcctttacttatggaaggccctccccaactgcagctttccaaacttgcagcgcatgtcgcaggcttgccacgaagtggacgattcctccgtggtgggcttaaagtatctcctgctgggggctatccacaagtgccttggaaactccgaagacgctgtgcagtattttcagagggccgtcaaagatgaactgtgtcgacagaataatctatacgtgcaaccctatgcctgttatgagctcgggtgcctcctgctggacaagcccgagaccgtgggccgaggaagagctcttctcctccaagccaaggaagacttctctggttatgacttcgagaacagactgcatgtgaggattcacgctgctctggcctctctgcgagaactagtgccgcagtag

SEQ ID NO: 60268 - DNA, 831 bp, Artificial Sequence
  Description of Artificial Sequence: Synthetic coding sequence
atgcatgccccatttcgaatctcttgtcaggtggtgtggctgttcaaaatatacctgctgatgtgtcagattaacagtgctttaacatcattccataccgcactggaattggccgtggatcagcgagaaatccagcacgtgtgcctctacgagattggctggtgctcaatgatcgagctcaattttaaagacgcctttgattcctttgagcgcttgaagaacgagtcacgatggtcccaatgctactacgcatatctaaccgccgtctgccagggcgcaaccggcgatgtggacggggcacagatcgtttttaaagaggtgcagaagctcttcaagagaaagaataatcagatcgagcaatttagtgttaaaaaggctgaacggttcagaaaacagacgccaacaaaggctttatgtgtcctggcatccattgaagtgctctatctctggaaggccctccccaactgttcctttcccaacctccagcgcatgtcccaggcatgccacgaggtagatgatagtagtgtcgtgggcctgaaatatttactgcttggcgctatccacaagtgcctggggaattcggaggacgccgtccaatatttccagcgggctgtgaaagacgagctgtgtagacagaataacctttacgtccagccatatgcatgttatgagttaggttgtcttttactcgacaagcctgagaccgtgggacgaggaagggcactcttgctgcaggccaaagaggatttcagcggatatgatttcgaaaacagactgcacgtgcgcatccatgccgctctcgcttcactaagggagctggtgccgcagtag

SEQ ID NO: 60269 - DNA, 231 bp, Artificial Sequence
  Description of Artificial Sequence: Synthetic coding sequence
atggcaggaagcgaacaacaaaggcctagacgacgtgatgacggtgacagcgatgccgctgcagctgccgctgcgcctttgcaggacgctgagcttgcccttgctggaattaacatgctcctcaataatggcttcagggagagcgatcagctgttcaagcaatatcgcaaatccttcctgacgagtgagaaaactagcgcactgccaggggagacacagagaaggctctag

SEQ ID NO: 60270 - DNA, 2631 bp, Artificial Sequence
  Description of Artificial Sequence: Synthetic coding sequence
atggccgaggaagagggcaggttgcatagcgttcagggactgctttcccttcaggacctgcagaacgtgaatacccccttaatgcgtaaactcgccaggctgaaattgggcctggttgaaatggcgctggacatgctgcagttcatctgggaggaggcccacggccagcagtcagaacagggttcattggaaaaactccttgctgactatcttcaaaatacctccgactacacatccgttgggttgcagtggttcactctcaagaggactctggcccacggggcactggctcaactaggaagcctgcagcctctgtctgttggatgtgttgagattagggcgcgtttgttggggctcgctggcagagcactgcacttgctcgccatgcaggccgatccagtgcacccaacttgctactgggaagcaggcccatccgtcggcgctaaattgtccggcttaaagtcgcttgagctggaggtggaagaagagggcgcaacaaaaagctcccgcgatcctcctgcatctcgcgctgcacctgaagaacactgcagaaggggcgaagatcttaagcggcgtatggtgcttgcccagcagtacctagcccaggcctccgaagtcttgcttcagtgtctccaggtcgcactgggttctgggctcctcgacgtcgctgccgctgcttccctggagatggtcgagtgtgtgggaaccctcgaccccgctacaacctgtcaatttctcgccctgtcccagagttgtagtgcatcagagactatgagggacgttctgcttgcagcgactgctaacacctcctctagccagctggcagcgctgttacagctgcagcatcagctccggtgtcaggacaggacaacaaccagcctgggagcccgagtggagcagcggctggctgccgttagtaaagcttggcagaatttgtgtgtaacggaacagcatttcaatcttctgaacgaaatgccccctactttttggatcctttttctgcacttatctggcgatagaagcagactctacggcgctgcctacgaaaagcctaaatttattactgcagccaagggcaaggtgcaagctgtgggagggagctgtaaagtgatgcggctggcgatcagccctaccgccttttcgcacttgttagcgtgcgctcagcagtttcggaaacaaactcaggcccaggtctattccgaggacatggctttgaatattggatccgagcctgaggggctgcaggtggaggagaaagagagaccagttcagcgactctcctcagtgctcggacccttggaagagctgctgcagccccttttcccgctgctgagcctgtcgaaggccagggttcagaccccagctgtagtggccgatagcggcaaaagcaagggcaaggataaggaacgaaaaacgagcactggccagcattcgacggtccagcctgaagtggcggataagatagtgttggtcgcagaccgccacctgctggagctgcccctggaggggctgagcgtgttcgatgagggcaccatttcttccgtatccagggaattcagtctgcagatgctgtggaaccggctgcacaaggaggagacagaaggcggtgtaaaaaaagagggcaggtcaagggatccgaaaaaacggagtctcgccaaaaaggggcgtaagggctctatacctcgaactatccctcccgattgcatcattgtagattctgacaacttcaagttcgtggtggacccatacgaggaagcccaggggccagagatgctgacacccgtaagtatcacacaggacattctcgaaagattccaagatacattcacatcccgttgggccggacatcttgggagtaagcacttcccctcacaggcccagtgggagcaggcccttggttcgtgcagtggcttcttcttctacggcatggagtcattcttgtctcacattttggtggaaaggctcgtcgccatgaacctgcaagaatgccaggttgccgttctgctggatctcgccagatcgtaccagtccctgaagagacacatggagtctgtggagcatcgcagatccgtggggcgatgggaggccaactggagaaattcagctagcccctccgaggatgaatggaggaggggcggagaaccaagacgcggtttttcagacttggagggacaagcagccgctgccccaaaactgcgcgctccatcacatcatgcccagttgggacctgtgtgggctgctgcccctagtcatagggtggtgcaggcttggacttgtctgccaagtgccgcaggggcaccggctctggcaagtgctctgggttctgctccactgcccacacatcctcatctgcctgcgcctataccttctagccaactagcgcttcctttcctcggcctgtcccccgcactgggggctgcctccgccagagacccccctcctgccacatctagaaaggccgctgcctggacatccagctccgcctgtctgtgtgccccatggggattacgacgcggatggtcttgcgtctcaagtcgaggacaagataaagggggactgcccctggctgccctggtgctttcctgtcttgaccagaagactatccagaccgtcagcctgtttcttatctag

SEQ ID NO: 60271 - DNA, 4593 bp, Artificial Sequence
  Description of Artificial Sequence: Synthetic coding sequence
atggacctggtcatcacccaggagctggcacgcgcagaatctcagcaggatgctgctagcctcaaaaaggcatatgagctgattaagagtgcgaatctcggcaagagtgagttcgatccctcagaatcatttagccctgacctttttgtgctgtgtgccgagcaggctctgaagatgaggcagccagaagtgtcagaggactgtattcagatgtacttcaaggtgaaagcgcctattacccagttccttggcagggcacacctgtgccgggctcagatgtgtgcacctaaatctgccgaaaacttggaagaatttgagaactgcgtcaccgaatacatgaaggccataaattttgctaaaggggagccgcgatattattttcttgtatataacgctagcgtgttgtattggcagatggttagacccttcctgaagcctggatatagacaccaccttataccctcactaagtcagatcattaatgtactttctcagactgaagaggaggataaagaatggagagccgaactaatgctggaactgctggagtgctatctgcaggccggacgcaaggaagaggccgcaagattttgcagcacagccgcaccctttatcaaatcacacgtcccccagaaatacagacagattttcagcgtgatggtacgccacgaactcatggacgagctgcagctaaaggaggagaaaaagaactctatctctttgtcagtcaccttttacatcaacatgcttaaggccaaagcggagcagaatgatcttcctggcgatatctcagtgatcctcaggaaggcgtaccggcatttgggtcattataatcaccagaggttcccttcaatttcagaggaaaagatgctgctgctgtttgaacttgctaggttctctttgacattgaagtgtatggagatctccagtgcttgtctctctgatctcaaaaaaatggagtccaaagaccccggaaagctgatcgaaatggagtgcctggagtgcgaaagtgaggcactcagactcgaaagtaaaatgaaagtgtataaccgcgcagctgtagaagctcagctcgacataatccagagactggacgtagccttgcagagagctgtgcggttgggcgaccctagagtgatacacgtggtgtgcgccactcaatggaacacgtgtctccccctgctccagcacaacttaagacaccatctccgtaaaccactggcaggcgtggccgacgtgcttgagaagctagactcgttgatgactctgcttcgatgtcaagtccatatggaaatggcacagatcgaagaggatgaagacagactggagccagccactgagcatctgcgtaaagcggctaggctggactctctcggcctgtatagggaccgtatccagatggcaagcacccggcttcgactatgtaccactctgtaccaggccccagagagagctgaggacaaggcaattatggcagtcgagcaagccaaaaaagccacccccaaagattccgtccggaagaaacgggcattgctggttaacgccggtctagccttggcccctgacgctttccagattgtgctggattccgaaaatgaggccaaggtcagcactgggaaaaaccgcggtagatttacatacctgtgtgccaaggcttggcaccacactgtctccgtggacaaagcagccggacacctccggagactcggtaatgaaaacgacaaagagcggattcaaatatgggcagaactagctaaggtggcccgaaagcagggagtatgggacgtctgtaggacagcttccaggttttgcctcttatacgataacgtcaaggtaaaaaaactgcgattgcgccgagggaagaaaaagagaggtcgagacggctccgtccaggatacatggtcacagcccgaggtggtgctacagaggcaagtctgtccggaccttctcagaaagttcgccgaagtgggtttcattcatgctgaggccacggtgcacctactgcggtcagaaggggtcgagcttaacgacagggcgatccccccagaggatctaagccaacaccccgcagggtatgtcccggagccgccagaggtcaatgccgagtggatcacatatagaacttggattgagagcttaagccgatgtgccatgaataactggcttcggagcgctgagattggccaggaaattcaagaggcctggattgtacaaaatgcggtggtctacgttttgaaccataaccatcacctcatcctcgccggtagacaaaaggagctggtcgacgctttataccacctgctttccatagtcaaagccacagggcatagcggggatccagtaatgctggttacattgtgtaatactctcgcccgaggcctgatcatttcttggatccctgtgcaggccgctgagaaatctaggaagttcatgcgccctaatgccttccactccccacttgacgccggagcaacctccgagattaagactgccgtggaggtgtgtgagttcgccctgaaccttacaaatggcagcgcgcctgaggaaaccgtgccgacaggcacccggcaacagttgatcgctacctgggtgaaagccaaacaactcctgcagcagcagatcggacctcgactgggcacagaagagcaggggaccaatgaggacgtgtctagtgtaacccgggttctcgtagccctcgaaatgtactcttgcaacggactgggtcttatggactttactgtaccatcgctggcccaactggtcaagatggcctcggagtgtaactggtccgaccccttggtggaactccaaacgttgaccagactaactcacttcgctcacgctgcccgagatcatgaaactacgatggcctgtgctcaccgggctctggagatgggcattaagtaccttaaaaagtttggccctgaggaatccaggctggtggcagagatgctctgtacggctaccgctattcagggcagatctataatggagaatttgaaaggtaggaaacagctgcggctggtggcagctaaggcctttacagagagcgcacgcttcggaggcattgctggttcaagtgccctggtgatgcttgccgctcggcactactggaatgcctggctcccgctgttgtctagtgcggtgtacagaaaaaaggcaaaaggagccctcaagagactgatcggcatcatcaataaaaccgaggcaagaaagcaggagaaaggcaagaccttactactgcaccagtggcccaccgccgattttcaaggcggaggcacaaccgaggggtatttcctcccaggagcagaggatgatctggcattgagggctgcactgtatggcctgttatttcacagtcatgcagaccaagatgactgggagggaggcttgaaagtgctcgacgaagccgtacaggtgttacccagaacagcccatcgcctgctcatcttcaagcacatggtgattgtaaaagcaaaactgggacagaactttagcatggaaatccagaagtttaaggccgagtctgaagactaccttgccagaatgtggcacagacttgcattaaattccccgtcagtctcaggagaactggcctgctacaataatgcgatccaggccctccaaaagcccgagatggaatggcaaaaggttgagtatctcatggagttcggccagtggcttcaccaccgtcattttcctttagaagacgtggtttttcacctcagatgggccgtagaaatccttttggctatgaaacctcccggtgacgttcctgaaccccagcccactccggatggcgaatatgtcgcagtagagatgcctcccaggtctccagtgtccgaagctgaagaggctgtcagtctggagcaattacgtagcgtgcgacagctcgaagcgttggccagggtgcacatcctcctcgcattagttctgagcccgggagccgagggatatgaggattgctgcttggctgcttacgcattcttccgacacatatggcaggtgtcattgatgactgcagggaagtcagtcttagagaaccggcctctggccgcaacaagttcacacttattgttgcctaagaaggagaaggaaaacgagagatctaaggaaaaggaaaaagaaaggtcaaaggagaaagaaaatgaacggagtaaagagaaagacaaggagaaaggaaaggaggaaaaagtaaaagaacccaagcagtcccagtcacccgctcctataaagcaactggaagatttgccaatgtccatcgaagaatgggccagctacagctgtcccgaggaggttctgtcagtgctgaagcaggaccgcagcgactctactgtgaacccctcctccatccaaaaaccaacctacagcttgtatttcctggaccatctggtcaaagcgctgcagaaaatgtgtctgcacgagttgacagtccctgtcctccagcttggagtgttgatcagtgactcggtcgttggatctaagggtctttcagacctgtatcacctaagatgggttcagctgctgttcaggagtgtgatctcacccaaacagaataaaaacaaacagcacgttaaggtcctgatcctatag

SEQ ID NO: 60272 - DNA, 1218 bp, Artificial Sequence
  Description of Artificial Sequence: Synthetic coding sequence
atggacctagtgattacccaggagctcgctagagccgaaagccagcaggacgccgctagcttgaaaaaggcttacgagctgattaaatccgccaacctggggaaatcagagttcgacccttcagagagttttagccccgaccttttcgtcctgtgcgccgaacaagcccttaaaatgagacaaccggaagtatctgaagattgtatccagatgtacttcaaagtgaaggcccctatcacacaatttctcggcagggcccacctgtgtcgagcccagatgtgtgcccctaaaagcgcggaaaaccttgaggagttcgagaattgtgtcacagagtatatgaaagccattaactttgcaaagggggaaccgcgttactactttttggtgtataacgcttctgtgctgtactggcagatggtgagaccttttctgaagcccggttacaggcaccatcttatcccttccctgtctcagattatcaatgtgctgtcccaaaccgaagaggaggacaaagaatggcgcgctgaactgatgctagaactgctcgagtgctatctgcaggctggcagaaaggaggaagcggcacggttttgttctaccgccgcaccgttcatcaagagccacgtgccccagaagtatcggcagattttttcagtaatggtacgtcatgagcttatggacgaactgcagctgaaggaggagaagaagaacagcatctctctcagtgtgactttctatattaacatgctgaaggccaaggcagagcaaaacgacctgcccggtgatataagcgtaatcctacggaaagcctacaggcacttaggccactacaatcatcagcgattcccttcgatctctgaggagaagatgctgctgctctttgagctcgccaggttctctctgactctcaagtgtatggagatcagcagtgcatgcctgagcgatctcaagaaaatggaaagtaaggtttcaggattcatgacactgctccctggcgatgaggcgcttctgacagtacaactagacaaacgtcagcgtaaagaagagcagtttacccggccacgccctcccggacttcggtctgtggtgggaacgctcccaagctttctccccgtgttttgtactgtggccgtaagatggtgccttcagttctacacctgtccattcctcttcaccttcctggttgccacgggcccacaacaccattcttgtttctag

SEQ ID NO: 60273 - DNA, 8147 bp, Artificial Sequence
  Description of Artificial Sequence: Synthetic coding sequence
atggacttggtgattacacaggagctagcgagagcagaatcccagcaggatgctgcatccctgaagaaggcttacgaactgatcaagagtgctaacctgggcaagtctgagttcgacccctctgaaagtttctcaccagatctgtttgtactgtgcgccgaacaggcactgaagatgcgacaacctgaggtctcagaagattgtattcagatgtattttaaagttaaggcgccaatcactcagtttctgggaagagctcacctgtgcagggcgcagatgtgtgcgccaaagagtgccgaaaacctggaagagttcgagaactgtgtgacagagtacatgaaagctattaattttgccaaaggcgaacctcgctactatttcttggtgtataatgcaagcgtgctttactggcagatggtgcgaccattcttgaagcccggatatcgccaccatctcataccaagcctgagccagattatcaacgtcctgagtcagacggaagaggaggataaagaatggcgtgctgagcttatgctggaactcttggaatgttacttgcaggcaggtaggaaagaagaagcagcccgattctgttcaaccgctgcaccttttatcaagtcacatgtccctcaaaagtatagacagatttttagcgtgatggtcagacacgagttaatggacgagctccagctaaaagaggaaaaaaagaatagcatctccttatccgtgactttctatattaatatgctgaaagccaaagcggaacaaaatgatttgccaggcgacatttctgttatactccggaaagcttacagacatctgggccattacaaccatcagaggttcccttccataagcgaagagaagatgcttttactgtttgagctcgccagatttagtttaacgcttaaatgtatggaaatctcatccgcatgtctctccgacctgaagaaaatggaatccaaggaccctggaaagctaatcgagatggagtgcctggagtgcgagtccgaggcactccggttggaatcaaagatgaaagtgtacaaccgggcagccgtcgaggcccagttagatatcatccagcgcctagacgtggcactccagagagccgtcaggctcggagacccccgtgtgattcacgttgtctgcgcaacccagtggaatacatgtcttcctctgctgcagcacaacctaaggcaccacttgagaaaaccactggctggggtagcggacgtgctggaaaaattggactctttgatgactttgctgcgttgccaggtccacatggaaatggcccagatcgaggaggatgaggacaggttagaacctgccactgaacacctacggaaagccgcacggctggattccttaggactctacagagaccggatccagatggcaagtacgcggctaagactgtgcactaccctctatcaagcaccagagcgcgctgaagataaggcaatcatggctgttgagcaggccaagaaagcaacaccaaaggactctgtcaggaaaaagagagcattattggttaatgcaggcctggcgttggcccctgacgccttccagatcgtgttggattcagagaacgaggcaaaagtgagtactggcaaaaatagaggcaggttcacatatctgtgtgccaaagcctggcatcataccgtgtcagttgacaaggccgcaggccatctcagacggttgggcaacgagaacgacaaagaacggattcagatatgggccgaattggcaaaagtggccagaaaacaaggagtctgggatgtgtgccgcaccgccagcaggttctgccttctgtacgacaacgtcaaagtcaagaagctccggttgcgaaggggtaaaaagaagcggggacgggatggctccgttcaggacacctggtcacaacctgaggtggtgttgcagagacaggtgtgtccagacctcttacgcaagttcgccgaggtcgggttcattcacgccgaggcaacagtccaccttctgagaagtgagggagtcgagctgaacgaccgcgctataccacccgaggatctaagccagcatcccgcaggttatgtgccagagcccccagaagtgaacgcggaatggatcacttaccgtacctggattgagagtctgtccaggtgcgctatgaataactggctccggtcggccgaaataggtcaagaaattcaagaggcctggatcgtccagaatgctgtggtatatgttctgaatcacaaccatcatctaattttagcgggacgccagaaagaactggtggacgcactgtatcatcttttgagcatcgtcaaagctaccggccactctggggatcctgttatgctggtaactctatgcaatacattggcgagggggctcatcatctcatggatccccgtacaggctgccgagaagtcaaggaagttcatgcgaccgaacgcgtttcactctccactcgatgccggagccacttcagaaattaagaccgctgttgaagtgtgtgagtttgccctgaatttaactaatgggtcagcccctgaagagaccgtccctactgggactcggcagcaactgatcgcaacatgggtgaaggctaagcaattgctgcagcaacagatcggcccaagactgggaaccgaagagcaaggtacaaacgaagatgtgtcctctgtgaccagggtcctggtggccctagagatgtatagctgcaatggtctgggcctaatggactttactgtgccatccctggcacagctggtgaagatggcgagcgagtgtaattggagcgacccactcgtcgagctccagactttgactcggctgactcatttcgcacatgccgctagagaccacgaaactactatggcctgtgcacatcgggcactggaaatgggaatcaaatacctaaagaaattcgggccagaggagtcaaggctcgtggccgagatgctgtgtaccgcgacggcaatccagggacggtccataatggaaaatctaaaaggtagaaaacaactgcgcctcgtggctgctaaagcgttcaccgaatccgcacggttcggcggaattgcgggatcttctgctttggttatgctcgccgcacgacactactggaatgcttggctgcccttgctctcctcagcagtctataggaagaaagctaagggggctctgaagagactgattgggattatcaacaagaccgaggcccgaaagcaggaaaaaggaaaaactttgctcttacatcagtggcccactgcagactttcagggcggaggcactactgagggctatttcttgcccggagccgaggacgatctcgctctcagggcagccctctacggactcctgtttcactcccatgccgaccaggacgattgggagggcggactgaaggtgcttgacgaggcagtgcaggttctcccaaggaccgctcatcggctgctgatcttcaaacatatggtgattgtgaaggccaaacttgggcaaaatttcagcatggaaattcaaaagtttaaggctgaatcggaggactacctcgcccgaatgtggcacagattggctctgaacagcccctcagtgtccggcgaactagcttgctacaacaatgccatccaggccctccagaaaccggagatggagtggcaaaaagtggagtacttgatggaattcggacagtggctgcaccacaggcatttccctttagaagatgtagttttccacctgaggtgggccgtggaaatcttactggccatgaaaccacccggagacgtgcccgaacctcagccaactcccgacggagagtacgtggcggtggagatgccccctcgctctcccgtctcggaagccgaagaggccgtctccctggaacagctgcgaagcgtgcgacagctcgaagccctggcccgagtacatatcctgttggccctggtattatctcccggagccgaggggtacgaagattgctgcctagccgcttacgccttttttcgccacatttggcaggtgtccttgatgacggcaggcaagagcgtgcttgaaaacaggccgctggcagctacttcctcacacctgttactgccaaaaaaggaaaaagaaaacgagcgctccaaggagaaggagaaagagcgctcaaaggaaaaggagaatgagagaagcaaggagaaggataaggagaagggtaaggaagagaaggtcaaggaacctaagcaaagtcaatcccctgcaccaatcaagcaactcgaggatctccctatgtctatcgaggaatgggcatcgtacagctgtcccgaggaggtgctcagtgtactgaaacaggacaggtccgattcaaccgtgaatcccagcagcattcagaaacctacttattcactgtatttcttggaccatctcgttaaagccctgcaaaaaatgtgcctccacgagctcacagtacctgtgttacagctcggagttctgattagcgactccgtggtgggctctaagggcctgtccgacctctaccatcttagactggcccacgcatgttccgagctcaagctgcgggaagctgcggctcgacatgaggaggctgtgggccaagtgtgtgtcagtgagctcgagcaagcgagttgcagaaaagaaattgctcttaagaaggagaagaataaagaaccactgctcgaagaaagtctgccagctctgaatgagcaaaccctccctgtccaacccggtgaaatcaaacctttagacgctaaagacaagatactgaaaatgaacggagaaacaggcagggatcttgatggcaccagctttccccacctgtggatgttgaaagccgaggttctgcttgagatgaatctctatcagcctgcaaggctcctcttatctgaagcatatttggcatttcaggagcttgacgagccatgtgccgaggcgcaatgtttactcctgctggcacaactggccaacaaagagaaaaactacgggcaggctaagaagatgattgctcaggctcagcatcttggaggatcagaggaattttggtataattcgactctgacactggccgaggcccttctgagtatggagcactccggtagagaggctaccgtatgtcatattttccagaagctgatcaatgcattcaaaatccttaaaaaggagagaccaaatcgcttgcctctgctggagttcatgatcacggacctcgaagcaagatgcctctctctgagggttcgcgtggcgcagcatagcgcggtgaccgaacctacagaatgttccctcctattgaaagaaatggatgatggtcttcttgaaatagagaggaagtttatagattgcggatgcaaagaaaactgcgtggatgtaaagctggaacgcgcaaagatcaaacgcctgcgtgctcaaaacgagaaggacgaggaacagaaaacagcatactacctggaagcttacggcctggcacagggagccgtagcagaggaagaagggcgtctgcattcaatacaggggctttatgggttggctcagggagccatggctgaggaggaggggaggttacacagcgtgcagggcctgctgtcattgcaagacctgcaaaatgttaatacacctctgatgcgaaagctcgctcgcttaaaacttggactcgtggagatggctctggatatgctgcagtttatatgggaagaggcccacggccagcagagcgagcaaggaagcttggaaaagctgttggccgattatctacagaacacttccgactataccagtgtcgggctgcagtggttcactctcaagagaaccctggcccatggggctctggcccagctgggaagtttgcagcccttaagtgtcggatgcgtggaaatcagagcccgactgttgggactggcaggcagagccctccacctccttgcaatgcaggctgaccccgtgcatccgacatgttactgggaagcaggaccgtcagtcggagcaaagctctcagggctgaaatctcttgagttggaggtggaagaggaaggcgcaacgaagagttcccgcgatccgccagcctccagagcagccccagaggaacattgcagacggggtgaggatctgaagcggaggatggtgcttgctcaacaatatctcgctcaggcctcggaggtgctgctccagtgtctgcaagtggccctagggtctggcctcttagatgtggctgctgccgctagcttagaaatggtagagtgcgtgggcactttagatcccgcaaccacttgccagttcttagccctctctcaatcatgtagcgcctctgagaccatgagagacgtcttgctcgccgcaacagctaacacttctagcagccaattggcagcactgctccagctacagcatcagctgcgttgccaggaccgtacaacaacgtccctgggggctagggtggagcagcggctagcggctgtttctaaggcttggcagaatctgtgcgtaaccgaacagcattttaatcttctgaatgagatgcctcctaccttttggatcctgttcctgcatctttctggcgatcgctctaggctgtatggcgctgcctatgaaaaaccaaagtttatcaccgccgcaaaaggcaaggttcaggcagtggggggatcctgtaaagtcatgcggctggctatcagccccaccgctttttctcatctgctggcctgcgcccagcagttccggaagcagacacaggcacaagtttattccgaagacatggccttgaatatagggtcagagcctgaaggccttcaggtggaagagaaggagaggcccgttcagaggcttagcagcgtgctggggccattggaagagctgttgcagcccctcttcccattgctatccctctctaaagcgcgagtgcagacaccggcagtggtcgccgacagcgggaagtctaaaggcaaagataaggaaaggaaaactagcaccgggcagcactccactgtgcagcctgaagtcgccgataagatcgtgctggtagccgatcggcatctgctggagctacctctagaaggcctcagtgtgtttgatgagggcacaatttctagcgttagtagagagttttctctgcagatgctgtggaatagattacacaaagaagagaccgaaggtggcgtgaagaaggagggaagatcacgcgatcccaaaaagcggagcctggcaaagaaagggcgtaaggggtccatccctagaaccatcccgccagattgcataatcgtcgactcggacaatttcaagtttgtcgtagacccttacgaagaggctcaaggtccagagatgcttacgcccgtgtctatcacccaggacattctggagcgcttccaggatacattcactagcagatgggcaggtcacctcggatctaaacactttcccagccaggctcaatgggagcaggccctggggagctgcagcgggtttttcttttacggtatggagtctttcctctctcacattcttgtggaacgcttagtagcaatgaatctacaggagtgtcaggttgctgtactcctggatttggcccgatcataccaatcattaaagcgccacatggagtccgtggaacatcgccgttcagttggcagatgggaggccaactggaggaacagcgcaagcccttctgaggacgagtggaggaggggtggcgagcctcgcagggggttcagtgacttggaaggccaagctgctgccgctccaaaactcagagccccatcacaccacgcccagcttgggcctgtatgggccgcagctccctcccaccgagttgtgcaggcttggacatgtctgccttccgccgctggtgcacccgctttggcaagtgccctgggctcagccccacttccgactcacccacatctccccgctcccatcccgtcaagccagctcgcgttgccttttctcggcctcagcccagcactcggggcagctagcgcgagggatcctccaccagcgacttcccggaaggccgcagcttggacaagcagttcagcttgcctgtgtgcgccttggggactgagaaggggatggagctgtgtctcatcaaggggacaagacaagggtggcctgcctctggccgcactggtgctgagttgtttggatcaaaagaccatacagacagtgtctctctttctcatata

SEQ ID NO: 60274 - DNA, 1563 bp, Artificial Sequence
  Description of Artificial Sequence: Synthetic coding sequence
atgatgaagtattacgacctggccaaattcaccatctaccagatcgctgagatggataagggcctgtccgagttgtcgccaatgcagcaagcactgatctattctttttgcgaaaaccacgataaagccattgaagtgcttgatggcatcagctggaaccgcgctgaaatgacaatgtgtgcccttctggccaaggtgcagatgaaggccaaacgcacgaaagaagcagtggaagtcctgaagaaggccttagacgctatctcccacagtgataaggggccagacgccacagccatatccgctgactgtctatataatctcggcctgtgctatatggaggaaggcaacttacaaatgacatacaaactggccattactgatcttaccaccgctatttccatggataaaaacagttacactgccttctacaatcgagcactctgttacacaaagattagggaactccagatggcgctgactgattacggtattgtgcttctgttggatgccacggaaaccgttaaactgaacacatttctaaacagaggtctgatttacgtcgagcttggacaatacggatttgcattggaggattttaagcaggccgctctcatctcaaggacgaatggtagcctgtgccacgccaccgctatgtgtcaccaccgcattaacgaatttgaggaagctgtcaatttcttcacgtgggctctcaaaattaatccatgtttcttggacgcctacgtgggcaggggaaattcttatatggagtacgggcacgatgaagcaaccaaacaagcccagaaagattttttgaaggcactacacattaacccagcctatattaaagcccgtatctcattcgggtacaacttgcaggcccagggaaaattccagaaagcatggaatcatttcactattgccatagacaccgacccaaaaaactatttggcatatgagggccgagctgttgtatgtctccagatgggcaataactttgcagcaatgcaggatatcaatgccgcaatgaagatttctaccacagcagagttcttgaccaacaggggtgttatccacgagtttatgggacacaaacagaacgccatgaaggactatcaggacgctattaccctgaacccgaaatattctttagcttattttaacgcaggaaatatttacttccatcatagacagttttcacaggcctcagactatttctccaaggccctcaagtttgaccctgagaacgagtacgtgcttatgaatcgagccataactaataccattctgaaaaagtacgaagaagcaaaggaggattttgcgaacgtgatcgaaagctgccctttttgggccgctgtatatttcaaccgcgcacacttttactactgcctcaaacagtatgaactggctgaggaagatttaaacaaggctctgtccctaaagccaaatgatgcactggtctacaattttagggctaaggtgcgcggtaagatcggcttaatcgaggaggcgatggccgattacaatcaggctctcgacctggaggattacgcctctgtgatctag

SEQ ID NO: 60275 - DNA, 1611 bp, Artificial Sequence
  Description of Artificial Sequence: Synthetic coding sequence
atggacaaaggcttaagcgagctttctcccatgcagcaggctctgatatactcgttctgcgagaaccacgacaaggctatcgaggtgttggatggcataagttggaaccgagccgaaatgacgatgtgcgcccttctggctaaagtgcagatgaaggccaaacggactaaggaggccgtggaagtgttaaagaaggcactggatgcaatttcgcacagcgataaagggccagacgcgactgctataagcgcagattgtctgtataacctcggcctatgctacatggaggaggggaacctgcagatggcatttgactccttcactaaggcggtgaaggccaacccggatttcgccgagtcattttaccaacggggactatgcaaagtgaagttgcacaaggactccagtatcctcgatttcaatcgggcaattacacttaaccccaagcactatcaggcttacctgagcagagttgccttctatggcctgaagggtcgctacagcaaggccatacttaactgtaacaaggccataaaaatttacccagagtctgtccgagcctacctgtacagaggggtgttgaaatactacaataaaacctacaaactggccatcaccgatcttaccacagcgatcagtatggacaaaaatagttacacagctttctacaacagagccttgtgctatactaagatcagggaactacagatggctttgactgattacggaattgtccttctcctggatgccaccgagaccgtcaaactgaatacctttctgaaccggggtctgatctatgtcgaactgggtcagtatggtttcgctctggaagatttcaaacaggccgcacttatctcaagaactaacggatccctctgtcacgccacagccatgtgtcaccaccggatcaatgaatttgaggaagctgtaaatttctttacctgggctctgaaaatcaacccttgctttctagatgcttatgtgggccgtggaaattcatatatggaatatgggcacgatgaggccactaaacaggcccagaaagatttccttaaagcactgcacatcaacccagcctacatcaaggcccgaatctctttcggttataacctccaggcacagggaaagttccagaaggcctggaatcacttcacaattgccatcgacaccgatcccaaaaattatctggcatacgaaggccgagccgtcgtgtgtctgcaaatgggcaacaactttgccgcaatgcaagacattaacgccgctatgaagatcagcacgactgcagaattcttaaccaatagaggggttatccacgagtttatgggccataaacagaatgcaatgaaggattatcaggatgctatcacactgaaccctaaatactccctcgcttacttcaatgctggaaacatctattttcatcatcgacagttctcgcaggaggaatccctggggctcgcctggagtctgagcctggacagtttcctgagaaccggtggtgccactttcagctccggtgtaaacccgctgcagacattacacaggcggatgtcaatcctctctcctctccccccaacctgccctagggatgaaatggactttacaagttag

SEQ ID NO: 60276 - DNA, 1563 bp, Artificial Sequence
  Description of Artificial Sequence: Synthetic coding sequence
atgatgaaatactatgacctggccaaattcactatctaccagatcgccgagatggacaagggcctgagcgagctttccccaatgcaacaggcgctgatttactcattttgcgaaaatcacgataaggccatagaagtcctggatgggatctcttggaaccgggcagagatgaccatgtgtgccctcttagcaaaggtccagatgaaagctaaacggactaaggaggccgttgaagtgctgaagaaagccctggacgccatctcccattccgacaaaggccctgacgctaccgcgatctccgccgactgcctgtacaatctgggactgtgttatatggaggaaggaaacctccagatgacctacaagctggcgataactgatctgacaacagctatcagcatggacaaaaattcctacaccgccttctataatcgagccctctgttatacaaagattcgggagctgcagatggccctcactgattacgggatagtccttctcctagacgcgacagagacagtcaagcttaatacctttctgaaccggggactgatttacgtggaattgggccagtatggtttcgcacttgaggattttaaacaagctgctctgattagccggaccaatgggagtctttgccatgctactgccatgtgccatcacaggatcaatgagttcgaagaggcggtgaacttcttcacatgggctctgaagattaatccatgcttccttgacgcatacgttggtcgtggaaacagctacatggagtacgggcacgacgaggctacaaagcaggcccagaaggatttcctcaaggctttgcacattaatcccgcttatataaaagctaggatcagttttggctataacctgcaggcacagggcaaattccagaaagcctggaaccactttaccatcgctatcgatactgaccccaaaaactatcttgcctacgaaggcagagcggtggtgtgcttacagatggggaacaatttcgctgcaatgcaggatattaacgcggctatgaaaattagcacaacagcggagtttcttacaaatagaggagtcatccatgagttcatgggtcacaaacaaaacgctatgaaagattaccaggatgcaatcacactgaaccctaagtatagcctcgcctacttcaatgctggcaacatttattttcaccacagacaattctcacaagcctccgattatttttccaaagctctcaagtttgatcctgagaacgagtatgtgctcatgaaccgggctataaccaatacaatactgaagaagtatgaagaggcaaaggaggatttcgctaacgtgatcgaatcttgtccattttgggccgcagtctacttcaaccgggcacatttttactactgtttaaaacagtatgagctcgctgaagaggaccttaataaggctctttcgttgaaacctaatgatgcactggtctataatttcagggccaaggtgcggggaaagataggactgatagaagaggccatggccgattacaaccaggcgctggatcttgaagactatgcctcggtcatttag

SEQ ID NO: 60277 - DNA, 2532 bp, Artificial Sequence
  Description of Artificial Sequence: Synthetic coding sequence
atggccacaaagaaagcaggaagtaggctggagaccgaaatcgaaagatgtagatcggagtgtcagtgggagagaatcccggaactggttaaacaactgtccgcgaagctcatcgctaatgatgatatggccgagctattactcggagaatcaaaactcgagcagtacttgaaagaacaccctcttagacagggggcttctccccgtggcccaaagcctcaattgacggaagtacgcaaacatctcaccgccgctctcgacaggggcaatctgaagtccgaattcctacaggaaagtaatttaattatggcaaagcttaattatgtggagggtgactacaaggaagccctgaatatttatgcaagagtgggtttggatgatctacctctgaccgctgtgcccccatatcgacttcgcgtgattgcagaagcttatgctacaaaggggttatgtctggagaagttacctatctcctctagcacaagcaatttgcacgtggatagagagcaagacgtcatcacttgctacgaaaaggccggtgacatcgccctgctttacctccaggaaattgaacgtgtgatcctttctaacatacagaacagaagccctaaacctggccctgccccacacgatcaggaactaggtttctttttggagaccggtttgcaaagagctcatgtcttatattttaaaaacgggaacctcacccgcggagtcgggcgtttccgtgagctcctcagagcagttgaaacccggaccacccagaacctgcggatgacaattgcgaggcagctcgcagaaatcttgttacgcggtatgtgcgagcagtcctactggaacccactcgaagaccccccttgccagtctcctcttgatgatccccttagaaagggcgctaatacaaagacctacacactgacaaggcgggcacgagtctattccggtgagaacatattctgtcctcaggaaaacacagaagaagccctgttactgttgttgatatctgaatcgatggccaaccgggacgccgtgctgtcccgcatcccagagcacaaaagcgatcgcttaatcagcttgcagtcggcgtcagtcgtttacgatctgctgacgatcgcccttgggaggagaggccagtatgagatgctgtccgaatgcctggagcgagcaatgaaatttgctttcgaggaattccacctttggtaccagtttgccctgagcctcatggctgcaggcaagtctgctagggccgtcaaggtgctcaaggagtgtatccggctcaagccggatgacgccaccatccccttgctcgcggctaagttgtgtatgggatccctgcattggctggaggaagccgagaaattcgcaaaaacggtggttgatgttggagaaaagacaagcgaatttaaagccaaggggtatcttgcgttaggtctgacgtattcactccaggctactgacgcgagtctaagagggatgcaagaggtactccagaggaaagcactgctcgctttccagagggcccattccctatcacctaccgatcaccaagccgctttttacctggctttacagttggcaatatctcgccagatccccgaagccttgggctacgtgagacaggccctgcagctccagggtgacgatgcaaacagcctgcacctgctggctctactgctgtcagcacagaaacattatcacgatgcacttaacattatcgatatggccttgtctgaatacccagaaaacttcatactcctattttccaaggtcaagcttcagtcgctgtgcaggggccctgacgaagccctgctaacatgcaagcacatgcttcagatatggaagtcctgttacaacctcaccaatcctagcgacagtgggagggggagttcccttctcgacaggaccatcgcagacagacgtcaactcaacaccattacgctgcctgactttagcgatcccgagaccggatccgtacacgcaacaagcgtcgctgcatccagggtggaacaagccctgtctgaagtcgcatcctcactgcagagttcagctccaaagcaagggcctctccacccatggatgaccctagcccagatctggctgcacgcggctgaagtgtatatcgggattggaaagccagctgaagccacagcctgtactcaggaagcggctaatctgttccctatgtctcacaacgttctgtacatgcgcggacagatcgcagagctgagaggaagcatggatgaagcacggaggtggtacgaagaagctctggctatttcccccacccacgttaaatcaatgcaacgcctcgctctgattttgcatcagcttggcaggtattcactggcagagaaaattttgagagatgctgtccaggttaactcgacggcacatgaagtctggaacggattaggcgaggtgctgcaggcacagggtaatgacgcagctgctacagagtgttttctcactgccctggagctcgaagcatcctccccggctgtcccttttaccatcatcccaagggtgctgtag

SEQ ID NO: 60278 - DNA, 2583 bp, Artificial Sequence
  Description of Artificial Sequence: Synthetic coding sequence
atggcaaccaagaaagccggatctcggctggaaaccgagattgagcggtgcaggagcgaatgccagtgggaacgtatcccagagcttgtgaaacaattgtctgctaagttaattgcgaatgacgacatggccgagttgctcttaggagaatctaaactggagcaatatctaaaggagcatccccttcggcaaggcgcaagcccgagagggcctaagcctcagcttaccgaggtccgaaagcatctcacagccgcactcgataggggaaatttaaagtccgagtttttacaggaaagtaacctgatcatggccaagctgaattacgttgaaggtgattacaaggaggccctgaatatttacgctagggtaggactcgacgacctgcccctgaccgccgtccctccgtaccgtctgcgtgtgatcgctgaggcttacgctactaaggggttgtgtctggagaagcttccaatcagctctagcactagtaatctgcacgtagaccgagagcaagacgtgataacttgttacgaaaaagcaggtgacattgcacttctttacctacaggagatcgaacgggtcatattatctaacattcagaacagaagcccaaaacccggacctgcaccacacgaccaggagctcggcttctttctcgagaccggactccaaagggcccatgtgttgtacttcaagaacgggaatctcactagaggtgttgggaggtttcgagagctcctgagagcggtcgagactaggacaacacaaaatctgaggatgaccatagcaagacaactggccgagattttactcagaggtatgtgcgaacaatcctattggaatcccttagaggatccaccatgccagagccccctcgatgaccctctcaggaaaggcgctaacacaaagacctacactctgaccagacgggctagagtgtattccggcgagaatatattttgcccccaggaaaatactgaagaggccctgttattgctacttatttccgagagcatggctaatcgagatgccgtcctgtctagaatcccggagcataagagtgatcgcttgatctccttacagtcagcgtccgtggtatacgacctccttaccatcgcacttggcagacgaggccaatacgagatgctttctgaatgcctggagcgggctatgaaattcgcttttgaggaattccacttgtggtaccaatttgccctgtcattgatggccgctggcaagagcgccagggccgttaaagttctcaaagaatgcatccgtctcaagcccgatgacgctactattcctctgttagctgctaaattgtgtatgggcagtctgcactggcttgaggaagctgagaagtttgccaaaacagtcgtagatgtgggagagaagacatctgagtttaaagccaagggctacctggctctggggctgacatattcgctacaggcaactgacgcatctctgcgtggaatgcaggaggtcttgcagagaaaggctcttcttgcgtttcaaagggctcattcactgagccccacggaccatcaggccgcattctacctggcgctgcagctcgcgatctctaggcaaattcccgaggccctgggttacgtgcggcaagcgttgcagctgcagggggacgacgctaattcattacacttacttgccttgctgctgagcgcccagaagcattatcatgatgctctcaatatcatagatatggcactgtctgaatacccggagaatttcatcctcttattctctaaagtcaagctgcagagcttgtgtcgcggtcctgacgaggccctgttaacctgcaaacacatgctccagatctggaagagctgctacaacctgaccaacccctccgactcaggtcgaggctcttcactgctggaccgcaccatcgccgaccggaggcaactgaacaccataactctgcccgatttttctgacccggagaccggaaacagtccagaagcatacttccatggttttccaagcctcttctcagtgtcaagtgtccatgctaccagcgtggctgctagccgcgtagagcaggcactgagtgaggtcgcgagctcgctgcagtctagtgcaccaaagcagggaccgctgcatccctggatgacgttagcccagatttggctgcatgccgctgaagtctacataggaattggaaagccggcagaggccaccgcatgtacacaggaagcagctaatctgttccctatgagccacaatgtcctctacatgcgtggacagatagccgagctgcggggtagcatggatgaggctcggaggtggtatgaagaagctttggcaatcagccccacccatgtaaagagcatgcagcggctcgcgctgatcctccatcagctcggaaggtactctctggcggagaagattttgagagatgccgtgcaggtgaattcaactgcccatgaggtttggaatggcttaggggaagtgctgcaggctcagggtaatgacgctgctgcaaccgagtgcttcctgaccgctcttgagctggaggcctctagtcctgccgtgccctttacgatcatacccagggtgctctag

SEQ ID NO: 60279 - DNA, 1257 bp, Artificial Sequence
  Description of Artificial Sequence: Synthetic coding sequence
atgacaattgctcgccagctggccgagatcctgctgagaggcatgtgtgagcaatcttactggaatccgctggaagaccccccttgtcagagccctctggatgaccctcttagaaagggtgcaaacacaaaaacttacaccctgactcgtcgcgctcgggtgtactcaggagaaaacattttctgccctcaggaaaacaccgaagaggctttattactcctgttaatctccgagagtatggccaatcgggacgctgtcctgtctaggattcctgaacacaaatcagatcgacttatatctctgcagagtgccagtgtcgtttatgatctcctgaccatcgccctcggccgacgtggacagtacgagatgttatctgaatgtctcgaacgagcaatgaaattcgcgtttgaagagtttcacctctggtatcagttcgccctgtccctgatggccgcagggaagtctgctcgcgctgtgaaagttctgaaggaatgcatccgcctcaagcccgacgacgctaccataccgctcttggctgctaaattgtgcatgggctcacttcactggctcgaagaagccgagaagttcgcgaagactgttgtggatgtgggtgagaagacttcggaattcaaggccaaaggatacctggctctgggactaacctactctctgcaggccacagacgcctccctgcgtggtatgcaggaggttcttcagcgtaaagcactccttgcatttcagagggcacatagcctctcgcccactgatcaccaggccgctttctacctggccctgcagctggccatcagcagacagattccggaggcactcggctatgtgaggcaagccctgcagctgcaaggtgacgacgctaattcgctccacctgctggctctcttactgtccgctcaaaagcactaccacgatgcccttaatatcatagacatggccctttctgagtaccccgaaaattttatcctgctctttagcaaagtgaagttacagagcctttgtcggggaccagacgaagctctgctgacatgcaagcatatgctgcagatttggaagtcatgctacaatctcaccaacccgagcgactcaggacggggttcctcactcctagatcgtactatagcagaccggaggcagttgaatacaatcactctccccgacttctcggatccagaaacgggcaaccagtgcagttggattgctttcggagagatgctggtagacatggggattcagtgcatatag

SEQ ID NO: 60280 - DNA, 993 bp, Artificial Sequence
  Description of Artificial Sequence: Synthetic coding sequence
atccctgaggccctgggatacgtaaggcaagccctccagctccagggcgatgacgcaaatagtcttcatctccttgcgctgctgctttcagcgcaaaagcattatcatgatgctctaaacatcatcgatatggccttgtccgagtatccagagaattttattctgctgttctcaaaagtaaagcttcaatcactgtgccgcggtccggatgaagccttattgacctgtaaacacatgttgcagatttggaagtcttgttacaatctcaccaacccgtccgactctggcaggggttcctcccttttggaccggaccattgctgaccgccgacagctgaacacaatcacacttccagacttcagcgaccctgagactggtaattccccagaagcatactttcatgggttcccatccttattttctgtcagcagcgtccacgctacatccgtggccgcttcaagagtggaacaggccctctcagaagtcgccagttcactgcagagctcagcccctaagcagggtcccctgcacccttggatgaccctcgctcagatttggctgcacgccgctgaggtgtacattgggatcggcaagcccgcagaggctacagcatgcactcaagaggccgctaacctcttccccatgagccacaatgtactctacatgcgcggacaaatagcagagctacggggaagtatggatgaagccaggaggtggtatgaggaggccctggctatctctcccacgcacgttaagtccatgcaacgactggccctcatcctccatcaactgggcagatatagcctcgccgagaagattcttagggatgccgttcaggtgaactctactgcacatgaagtgtggaacgggctgggcgaagtgctacaggctcagggtaacgacgcagctgccacagagtgctttctgacggcactcgaactcgaagcctcctcacccgctgtgccattcacaatcattccacgggtgctgtag

SEQ ID NO: 60281 - DNA, 720 bp, Artificial Sequence
  Description of Artificial Sequence: Synthetic coding sequence
atgcagagaggcgcactgtcacccgttcttatgcttagcgctgcaccagagcctccaccgagaccaccgcctgccttgagtcctccgggaagcggccctggctcagggtcccgccacggaagtgccagaccaggtccaacccccgaaccgagcgggtctctgggggctgctttagatagctccttgagggccgctgtggcctttaaggccgaggggcagagatgctacagggagaagaagttccgtgaggctatcggtaaatatcaccgtgcccttctacaactgaaagccgcacagggcgctcgccctagtgggttgcccgctcctgcacccggacccacgtccagcccaggccctgccaggctgagcgaggagcagcgcagactagtggaatcgaccgaggtagagtgttacgacagtctgacagcctgccttcttcagtcagaactggtgaattacgagcgggtccgcgagtattgtctcaaggtgctggagaagcaacagggaaatttcaaggctacatatcgcgcaggtattgcattttatcacctgggagattatgccagggcgcttcggtacctgcaggaagcgcgtagtagggagcctaccgatactaacgtgctcagatatattcagttgacacagctgaaaatgaatagatgcagcctgcagcgagaagacagcggtgctggctcacagacccgcgatgtcattggatag

SEQ ID NO: 60282 - DNA, 516 bp, Artificial Sequence
  Description of Artificial Sequence: Synthetic coding sequence
atggaaaaacggcttcaggaggctcagctgtataaggaagaaggcaaccagcgatatcgcgagggcaaataccgagacgcagtgagccggtatcatagagccctactccagctccggggactggacccctctttaccctcacccctgccaaacttgggacctcaaggtcctgctttgacacctgagcaggaaaacattctccacactacgcaaactgattgttataataatctcgctgcctgtctcctccagatggagccagttaactacgagcgcgtgcgagagtatagccagaaagtccttgagcggcaacctgataatgccaaagctctctaccgggctggtgtagcattttttcacctacaggactacgatcaagctagacattacctgttggcagccgtcaacagacagccaaaagacgccaacgttcgcaggtatctgcagctcacacagtcggagctcagtagttatcacagaaaggaaaaacagctgtatctgggtatgttcggttag

SEQ ID NO: 60283 - DNA, 648 bp, Artificial Sequence
  Description of Artificial Sequence: Synthetic coding sequence
atgctcaacaaggaagaagaactggagcttcttgaggccttgtggagtttctcaaccagccctgcccattcactgttactccccggtaggggcggtgctggccctatcgaaaggcggaagcccgtttctcaggcattctccagaccccaacagtttttgagcagggccttgctcgagttcttcggcaaaagccaccctcccccacacagactctttcgaaagtctttgaacgttggtttacattattcccacatccctttcctgacgacctgtctgcatttcctccggaagagactccagaagggggaagtgggtctctcggtcgaaacttctaagccacaggtgcctgtggggggtcttagccgcaaaaaagtcccccaggagccttgggccaccgttatggagaaaagactacaagaggcacaactatacaaagaggaagggaatcagagatatcgcgaaggcaagtatagagacgcagtaagcaggtaccaccgagcactgctgcagctcagagggctggatccttccctgcctagtcctctcccgaaccttggccctcaggggcctgccttgacccctgagcaagagaacatcctgcacaccacacaaacagactgttataacaacctggctgttgtcaaatag

SEQ ID NO: 60284 - DNA, 423 bp, Artificial Sequence
  Description of Artificial Sequence: Synthetic coding sequence
atggagaagcggctgcaggaggcccagctgtacaaggaggagggaaatcagcggtatcgagaagggaaatatagggacgctgtgtcccggtaccatagagccctgttgcaactacgtgggctggatccatccttgccaagtccgctgcccaatctcgggcctcagggacccgctctgacaccggaacaggagaatattctccatactacccaaacagactgctacaacaatctcgcggcttgtctcttgcaaatggaaccagtcaattacgagcgcgttagggaatacagccagaaggtgctggagcgacagcccgataacgctaaggccctatatcgcgctggtgttgcctttttccacctgcaggactacgatcaggctcgtcattaccttctggccgctgtgaaccggcaaccaaaatag

SEQ ID NO: 60285 - DNA, 516 bp, Artificial Sequence
  Description of Artificial Sequence: Synthetic coding sequence
atggagaaaaggctgcaagaggctcagctgtataaggaggaaggaaaccagcggtacagggaaggcaaatacagggatgccgtctcacggtaccaccgtgcgctgttacaacttcgcggattggatccgtccctgccatcaccactgcccaaccttggaccacaggggcctgctcttacacccgaacaggaaaacatactgcacactactcagaccgattgttataacaacttagccgcatgcctgctccagatggaacctgtgaattacgaaagagtgagagagtattctcaaaaagtgctcgagcggcagcctgacaatgcgaaagccctgtaccgggcaggtgtcgcgtttttccacctccaggactacgaccaggctcggcactacttattagctgctgtgaatagacagcctaaggatgcaaacgtcaggcgttatcttcaacttacgcagagtgagttaagtagctatcataggaaggagaaacaattgtatctggggatgtttggttag

SEQ ID NO: 60286 - DNA, 6002 bp, Artificial Sequence
  Description of Artificial Sequence: Synthetic coding sequence
atgttccgaaacagcctgaagatgctgctaacaggcggtaaatcttctcgaaaaaacagatcttctgatgggggaagcgaggagccccctgaccgccgtcagagtagtgtcgacagcagacagtctcggagtggacaaggaggaatatccacagaatccgactgcgcctttgagccagattatgctgttcccccactgccagtctctgagggcgacgcggaacaggagttgggacccccaccttctgttgatgaagcggctaacactctgatgacccgtctcgggtttctgctgggcgaaaaagttaccgaagtacagccaggcgatcagtactctatggaagttcaggatgagaatcaaaccagcgccatcacccagcgcatctccccatgttcaaccttgacaagctcaactgcgtccccacccgcttccagtccctgcagcacgcttccgcctattagcacaaacgcgacagccaaggattgcagttacggcgctgtgacgagcccaacgtcaaccctcgaaagtagagattcaggcattattgccactttaacttcatatagtgagaatgtcgagagaacaaagtatgcaggtgaaagtagcaaagaactcggtagcggagggaatattaagccgtggcagagccagaagagtagtatggattcttgcctctatcgtgtggacgagaatatgacagcgagcacatattccctcaataagatccccgaacggaatcttgagacagtcctgtcccagtctgttcagtcaatacctctatatctcatgccacgacctaatagcgtggcagcaacctcttctgcccacttggaggatctcgcctaccttgatgaacagaggcacactcctctgaggaccagtctcagaatgccgagacagagtatggggggtgcgcgtactcagcaggatctgagagtcagatttgcaccatacaggccccctgatatttccttgaagccactcctatttgaggtccccagcatcactaccgagtcggtcttcgtcggaagagactgggtgttccacgagattgacgctcaactccagagcagtaacgcgagtgtcaaccagggggtggtcatcgtcgggaacattgggttcgggaagacagccataatcagcaggcttgtagctctgtcttgccacggaaccaggatgcggcagatcgcgtcggactcaccacatgcttccccgaagcatgtcgatgctaatcgcgagctgcctctgacacagcccccttccgcccatagtagcattacctctggttcctgccccggtacgcctgaaatgagaaggcggcaggaggaagcaatgcggagactggccagccaggttgtcgcataccattattgtcaggccgataatgcctacacctgccttgttccagaatttgtgcataatgtagccgctctactgtgccgaagcccgcaactcacagcttaccgagaacagctcctgagggagccgcatctacagtcaatgctctccctcagatcctgtgttcaagatccgatggcctcattccggcgaggcgtgctggaaccattagaaaacctgcacaaggaaaggaaaatacccgacgaggacttcatcatcctgatcgacgggttgaatgaggccgagtttcataaaccggattacggtgatactatcgtctcatttctgtcgaaaatgattggcaaattcccaagttggctaaagctgatcgtgaccgtcagaaccagcttgcaggaaattacgaagcttctgcctttccaccgtattttcctagatcgcctggaggaaaacgaagccattgaccaagacctacaggcctacattctgcataggattcactcatccagtgagattcagaacaacatttctctcaacgggaaaatggataatactacgtttggtaagctctcctcacacctgaagacactaagccagggatcttacctctatctcaagctgacattcgacctgatcgaaaaaggctaccttgtcctgaaaagttcctcttataaggtggtccctgtgagccttagcgaggtttatttgctgcaatgtaacatgaagttccctacgcagtcctcctttgacagagtcatgcctctgctgaacgttgctgtggcgagtctgcatcctctgacagatgagcatatctttcaagcaatcaatgccggatctatcgaaggaactctggagtgggaagattttcaacagaggatggagaacctcagtatgtttcttatcaaaaggcgcgatatgactagaatgttcgtgcacccttcgttccgggagtggctcatctggagagaagaaggagaaaagacaaaatttctgtgtgaccctcgatccggccacaccctgctcgcattctggttctcgcgacaggaaggaaagctgaatcgccagcaaactattgagctgggccaccacatactcaaagcccatatttttaaaggactgtcaaaaaaagttggggtgagcagtagtatccttcaaggtctctggataagttactccactgagggactgagtatggctctggcttcactgagaaatctttacacacccaacatcaaagtttctcggctcctgatcctgggcggagcaaacatcaattatcggacagaggttctcaacaatgctccaatcctttgcgtgcagtcccacctcggatacacagaaatggtcgcgctcctgctggagtttggcgcaaacgtagacgccagctctgagtctggcctcaccccgctggggtatgcggcagccgctggatacctttctatcgtggtgcttttatgtaagaagcgggcaaaagtggatcacttggataaaaatggccagtgcgccctcgtccacgcagctctgaggggccatctcgaagtggtcaaattcctgatccaatgtgactggactatggccggtcagcagcagggagtgttcaagaaatctcacgccatccagcaggccctgatcgcagcggcatctatggggtacactgaaatagtgagttatttgcttgacctgcctgagaaggacgaagaggaagtcgagagagcccagatcaacagctttgactctctttggggggaaaccgccttgactgcggcagcgggacgcggaaaactcgaggtttgccgtcttctgctcgaacagggcgctgctgtggcccagcctaaccgcaggggtgctgtgccactcttttctacagtcaggcagggccactggcagatcgtcgatctgctactgacccacggagccgatgtaaacatggctgacaaacaggggaggacacctcttatgatggctgccagcgaaggacatctgggcaccgtggattttcttcttgcccagggggcttctattgcccttatggataaggaaggcctaacggcgctgtcctgggcatgcctgaagggccatctctcagttgttagaagccttgttgacaatggggctgccactgaccacgccgacaaaaacgggagaacccctcttgatctggcggcattctacggagacgccgaagttgtgcagtttctggtagaccacggggcaatgatcgagcatgttgattattctggaatgagaccactcgaccgggcagtcggctgcaggaacacctctgtggtcgtgaccctgctgaaaaagggggctaagataggctgtcagacactgccctcccgcccaaggggtccagccacgtgggccatggccacgagcaagccagacatcatgatcattctattatccaagctgatggaggagggagatatgttttataagaagggcaaggttaaggaggctgcacaacggtatcagtacgctctaaaaaagttcccacgggaagggttcggcgaagacctgaaaaccttccgagagctcaaggtctctttactgctgaatctgagccgctgccgtcgcaagatgaacgattttggaatggccgaagagtttgccacaaaagccctggagctgaagccgaagtcttatgaagcttactatgccagggccagggccaagcgctcctctcgccagtttgctgccgctctcgaggacctgaatgaagcgattaagctatgtcccaacaatcgcgagatacagagactgcttctgcgagtggaagaggaatgcagacagatgcagcaacctcagcaaccgccacctccaccgcagcctcagcagcagcttcccgaggaagccgagcccgagcctcagcatgaagacatctacagcgtgcaggatatcttcgaagaagagtatctggaacaagatgtggagaacgtgagcatcggattgcagacagaggcccgaccctcccaagggttacctgttatccagagtccacccagcagccctccccaccgagacagcgcctatatttcctcatcaccactaggttctcatcaagttttcgacttccgatcctcgagttccgtaggaagccccacaaggcagacataccaaagtacatctcctgccctttcccccacccaccagaatagccattacagaccttcccctccgcacaccagtcctgctcatcaaggcggtagctataggttctccccacctccagtgggaggtcagggaaaggagtacccttcaccaccaccatcgcccctccgcagagggcctcagtaccgcgcaagtcctccagctgaaagcatgagcgtctatcggtcccagagtggctctcccgtgcgttaccagcaagagaccagtgtgagccaactacctggcaggcctaaatctcccctgagcaaaatggcccagcgaccataccagatgcctcagttgccggtcgcagtccctcaacaggggctcagattacagcctgccaaggcccagattgtgagatccaatcagccgtcccccgctgtgcattccagcaccgtcatccctactggcgcttatggacaggttgcgcacagcatggccagtaaatatcagtcatcacaaggagacatcggggtatctcagtctagacttgtgtatcagggttcaattgggggtattgtgggtgacgggaggcctgtgcagcatgtgcaggccagtctgtctgcaggcgcaatctgccagcacgggggactgactaaagaggacctcccccaaaggcccagtagcgcttatcgaggaggagtgcgctattctcagacaccccagataggcagaagtcaatcagcatcatattatccggtctgccactcaaagcttgatctggagaggagcagctctcagctgggttcacctgacgtgtctcacttaattcgtcgacctatctccgtgaatcctaacgaaattaagccccacccacctacccctaggccgcttttgcattcacagtcggtgggcctgaggttctcaccctcttcaaacagcatcagctcaacctccaatcttacccctacgttcaggccgagctcttccatccagcagatggaaattccactgaaacccgcatatgagcgctcttgcgatgagctatctccagtgagtcccacacaaggcggatacccatccgagccgacaaggtccaggactacccccttcatgggcattatcgacaagaccgcacggacccagcagtaccctcatctgcaccaacagaatagaacttgggcagtttctagtgtggatacagtcctctctccgacaagcccgggaaatctgccccaacctgagtcattttccccgccatcgagtatcagcaacatcgcattttataacaaaactaacaacgctcaaaacgggcacctcctggaggatgactactactcccctcatggcatgctggcaaacggatcacgtggcgacctgctcgagagggtgtctcaggcctcgagctacccagatgtgaaagtggcacgcaccctgccagtggctcaggcatatcaggacaatctttacagacagcttagccgcgactctagacaggggcaaacctctcccatcaagccaaagcgcccatttgtagaatccaacgttta

SEQ ID NO: 60287 - DNA, 5972 bp, Artificial Sequence
  Description of Artificial Sequence: Synthetic coding sequence
atgtttcgcaactcactcaaaatgctcctcactggaggcaagagcagcagaaaaaaccgttcttctgacggcggatcagaagaacctccggacaggcgccaaagcagtgtggactcgcggcagagtaggtcaggccaaggcggaatttccaccgagagcgactgtgcatttgaaccagactacgccgtgccgccactgcccgttagcgagggcgacgcggaacaagagctcgggcctccaccctcagtggatgaagctgctaatacgctgatgacaaggttggggtttctgctgggcgagaaggtgaccgaggtccagccaggtgatcagtattcaatggaagtgcaggatgagaatcagactagtgccataactcagcgaatatcaccttgctcaacactgacttcctcaacggcatcccccccagcctccagcccatgctccaccctccccccaatctccactaatgcaactgccaaagactgctcctatggagccgtgacgagccccacctctacattggaatcaagggatagcggaatcatcgccacgctgactagttactcagaaaacgtcgaacggaccaaatacgcaggggagagctcaaaagagcttggatccggaggcaacattaaaccttggcagtcacagaaatcaagtatggatagctgtctatatcgggtcgacgaaaatatgactgcctccacgtattctctgaataagatacccgagcggaacctcgagactgttttgagccaaagtgtgcagtctattcccttgtacctaatgccgcgtcccaatagtgttgccgcaacctctagtgcacatctggaagacctggcatatctggatgagcagaggcacacgccactccggacgtctctccgaatgcctcgacagtccatggggggagctcgcacacaacaggatctccgcgtgcggtttgccccatatagacctccggacatatccctcaagcctttgctgttcgaagtaccctcaatcacaaccgagagtgtgttcgtgggaagagactgggtgtttcacgaaatcgatgcacaactgcagtcttccaacgcttctgtcaaccagggagtggttatcgttgggaatatagggtttggcaaaactgccatcatctcgcgcttggtggcactttcttgccatggaactcgcatgcgacaaatcgccagtgattccccgcatgcgtcgcccaagcacgtggatgcaaatagggagttgcccttgacccaacctccgtcagcgcactctagcatcacgagcgggtcttgcccaggcacgcctgagatgcgcaggaggcaggaagaggccatgcgaaggctcgcttcccaggtggtggcctatcattattgccaggctgacaacgcttacacctgcttagttccagagttcgttcataacgtagcggctctgctgtgcagatcaccccaactgaccgcctaccgagaacagttgctgagggaaccccacctacaatcgatgctgtcacttcgcagttgtgtgcaggacccaatggcgtcattccgcagaggagttctggagcccctcgagaacctccacaaggagagaaagatccctgacgaggactttattatactgatcgacggactcaacgaggctgaattccataagccagactatggggacacaatcgtttccttcttgtcaaagatgatcgggaagttcccttcctggctgaagctgatagtcacggtccggacaagcctgcaggagatcacaaaactgttgccttttcatcggatctttctcgatcggcttgaagaaaatgaggctatcgatcaggacctgcaagcctacatcctgcatagaattcattcatctagtgaaattcagaacaacatatctcttaatggcaaaatggataacactacgtttgggaaactgtccagccacctgaagacccttagtcagggtagctatctttatttgaaacttacattcgacctgatagagaaaggttatctggtgctcaagtcttcttcttataaggtggtccctgtaagcctctccgaagtctacttactccagtgtaatatgaagttcccgacacagtctagctttgaccgtgttatgcccctgctgaacgtggccgtggccagccttcaccctctaactgatgaacatatttttcaggccataaacgccggatctatcgaaggtactctggagtgggaggacttccaacaacgcatggaaaacttatcaatgtttctcataaagaggcgggatatgaccaggatgtttgtccatcccagctttagagagtggctaatatggcgtgaagaaggtgagaagaccaaatttctgtgtgaccctagaagcggtcatactttgttggctttctggttctctcgccaggagggcaaacttaaccgtcaacagactatagagctcgggcaccacattctcaaggcccatatctttaaaggtctgagcaagaaggtcggagtgtcttctagcatacttcagggactctggatcagttacagcacagaggggctctctatggcccttgccagcctgcggaatttgtacactcccaatatcaaagtttcccgattgttaattctcggaggcgctaatataaattataggactgaagtgcttaataatgcccctatactgtgtgtgcagtctcatttgggttacactgaaatggtggccctgctgctcgagttcggcgcaaatgtcgacgcgtcatctgagagtgggttaaccccgttgggctacgctgcagctgctggctatttatccattgtagttttgctgtgtaaaaaacgtgcaaaggtggaccatctggataagaatggccagtgcgcactggtgcacgcagccttaaggggtcacttagaggtcgttaaattcctcattcagtgtgattggaccatggcgggtcagcagcaaggcgttttcaaaaaatctcatgcgattcaacaagcgctcatagccgctgcctcaatgggatatactgagatagtcagctacctgcttgacctgcctgaaaaggacgaggaggaggtggaaagggcccagattaacagtttcgactccctctggggagaaacagccctgaccgctgctgctggcagaggaaaacttgaggtatgtaggcttctcttagaacagggggcagccgtggcacagcccaatagacggggagctgtaccacttttctcaacagtgcgtcaggggcattggcagatcgtcgatctgctcctgacccatggcgctgacgtgaatatggccgataagcagggacggacacctcttatgatggccgcttctgaggggcacctgggaacggttgacttcttattggctcaaggcgcttctattgccctgatggacaaagagggactcacggcgctcagctgggcctgcctgaaaggacacctgagcgtagtgcgctcattggttgataatggagccgcaacagatcacgcagacaaaaatggcaggactccactagatctggctgccttttacggggatgccgaggtggtccagtttctcgtggaccatggcgctatgatcgagcacgtggactactcagggatgcgacctctggatcgcgcagttggatgccgcaatacatctgtcgtagtgacactgctgaaaaagggtgctaagatcggcccagctacgtgggctatggcaactagcaagccggacatcatgatcattcttctctcaaaactcatggaggaaggggacatgttttataaaaagggaaaagtgaaggaggccgcacagcgttaccaatacgccctgaagaaatttccacgagaggggttcggcgaggatctcaagaccttccgggaactgaaagtgagtctgctcctcaatctatcacggtgtagacggaaaatgaatgattttggtatggccgaggaatttgcgaccaaagcacttgagctgaagccgaagagttacgaggcatattatgctagagctagggcgaagcggagttctcggcagttcgccgctgccctggaggatctaaatgaagccataaagctatgtcctaataaccgggagatacagcgcctgcttctgcgagtggaagaagaatgccggcagatgcagcagccccagcagccccctccaccccctcagccccagcagcaacttccagaagaagccgagccagagccccagcacgaagatatctactccgttcaagacatcttcgaagaggagtacctggaacaggacgtcgagaacgtgagcataggcttgcagacagaggctcgaccatcccaaggattacccgttattcagtccccgccatcaagtcccccacatcgggactctgcctacatcagttctagtccgctgggctcccaccaggtatttgatttccgctcttcttcgtcagtcggaagtcctactaggcaaacataccagagcacttccccagctctgtcgcccacacatcaaaatagtcactatcgaccctcccccccacatactagtcccgcacaccaaggcggatcctacaggtttagtccaccgccagtggggggacaaggtaaggagtatccttccccaccaccgagccccttacgaaggggacctcagtaccgagcatccccacccgctgagtcaatgagtgtatatagatcgcaatctggtagccctgtgagatatcagcaggagacctcggtgtcacagctgccaggccgtcccaaaagtcctctgtccaagatggcgcaaagaccctaccagatgcctcagcttcctgtggccgtgccacagcagggtctgcgcctgcagcctgcaaaagcacagatagtgcggagtaaccagccttcccccgctgtgcatagtagtaccgtgattccaaccggagcttatgggcaggtggcccacagtatggcatccaaataccagtcatctcaaggcgatataggtgtgagccagagcagactggtgtatcaaggatccatcgggggaatcgttggagatgggagaccggtgcagcatgtgcaggcgtctttatctgcaggggctatctgtcaacacgggggtctgaccaaagaggatctgccgcagcgtccttccagcgcttaccgcggaggggtaagatattcgcagacaccacagatcggcaggtcacagagtgcaagctattatcctgtgtgccactcaaaactcgatctggagcggtctagttcccagttaggcagcccagatgtgagtcatcttattagaagacccatctcagtcaacccgaacgaaataaagcctcatccccctacaccccgaccgcttctccactcacagagcgtcgggcttcgattttctccgtcctccaactccatatcttccacgagcaacctcacccccacatttcgtccttcctccagtattcaacagatggaaatacctctgaaaccagcttatgaacgttcctgtgacgagctatcccctgtatcccccacccagggaggatacccatctgaacctacaaggagccggaccaccccgttcatgggcatcatcgacaagacagcacgtacgcagcaatatccacatttgcaccagcagaaccgaacttgggctgtttctagcgtggacacggtgctttctcccaccagccccggtaatctccctcaaccggagagtttctccccaccgtcctctatctctaacatagcgttttataataaaacaaacaacgcccagaacgggcatctgctggaggatgattattatagtcctcacggcatgctggccaacggctcacggggagacttgctagagagagttagtcaagctagtagctatcctgatgtcaaggtcgccagaacactgcctgttgcccaggcttatcaggataacctctacaggcagttgagcagagattctcgccaaggtcagaccagccccatcaagcctaaacgccctttcgtagaatctaatgttta

SEQ ID NO: 60288 - DNA, 468 bp, Artificial Sequence
  Description of Artificial Sequence: Synthetic coding sequence
atgagcgatagcgaccttggggaggacgaaggactcctctccctcgccggtaaaaggaagcgcagagggaacctgcctaaggagtccgtgaagatcctgcgggactggctttacctgcacaggtataatgcttaccctagcgaacaggagaagctgtcactgtccggccaaaccaacttgagtgtcctgcaggatgaatttctcgacgtgatttactggttccgccagattatcgctgtggttctgggcgtaatctggggcgtcctccctctgagggggttcttgggcatcgccggtttctgcttgattaacgccggtgttctctacttgtacttctcaaactatctacaaatcgacgaggaagaatacggcggtacctgggaactgactaaggagggatttatgaccagtttcgccctctttatggtaatctggatcattttttatacagcaatccattacgactag

SEQ ID NO: 60289 - DNA, 1398 bp, Artificial Sequence
  Description of Artificial Sequence: Synthetic coding sequence
atggaaaatcaggagttcctgagctccagcgccccttctgaagttaccgacgggcaggtgagtacagaaatctccacatgtagcgaggtattccagaaaccaatagtactgaggatcttggatacccatcgcgaactggaggagtctgaggaccccgaaaagcacgagaatcccgaagagccagaggaggttcgggagcaagatcagcgggacgaatcggaagaatgtgatgaacctcacgagagctacgaaccacacgcaccctatgcaccacacaagccaagagactcttatgctccgtatgaactgcatgggcctcacgctgcgcctaagttattgaaggctcgggaaccccgacagctgcgacacaccagagagccccgaaagtcacgcgaggccaaggaaacagagctgttaccaagcgctgccgtgatgatttcacccagcctgataaccagagcaccgccaaggccacagctttctttcttgggagctaacccagtttcttgtgacttcgtcagaaagtgtttcagttctcgtaagaggacaccaaatttgtcgaaaccgaagaagcagtggggaactcccgaccggaaactcttctggggtaatcaggaccccattcggcctgtgagccagggcgcactaaaggcccagctgaccaagcggttggagaacctggcacaacctaaagaagtgtcatgtcactatgtgccaaacagagcccaatactaccatagttgcggcagggagtctgttatctgggagattacaccaccagcgctatttcggcagcccagtaaaaggatccaacgtctttctcaacccaacgggttcaagaggcagtgcttgctcaatcgccctttctctgataattcagcccgagattctctccggataagtgatccctcccctcgcattctgcagctgtccgtcgcaaagggcacagacccaaattaccacccttccaagaagatgcagacaaagatctcgctgtcgaccttgagcgcaattgccacacccaggataatcgaactggcacaccctcgaataaaattagaagggttatgttatgagagacagcgctctgagctccctatcagacccgtgccccctgccgctatgatagcaaagccctcccctaggaccatcgccttagccaagtctaagtcggtgcatcaggactatttgcctgaccgcgatgcacattggcccgtgagttatgctaccacgcactctaaggcttcccctcgaattcaggaactcgccaatccaaacaagcgagccccagtgcggattgtgtattacgaccctgatgtcttcaagactaaacccgctgcgctgaaggcccagtgctcacaaagaatatgggaactgagtcaacccctaactaggtag

SEQ ID NO: 60290 - DNA, 318 bp, Artificial Sequence
  Description of Artificial Sequence: Synthetic coding sequence
atggctcagggcctgatagaagtggagcggaaattcctgccgggacctgggactgaggagcggctccaagaattgggcggaactctcgagtatcgggtgactttccgcgacacttactatgacacacctgagctgagcctgatgcaggctgatcattggctgcgacgccgtgaagattctgggtgggagttgaagtgcccgggtgccgcaggcgtgctgggccctcacactgagtacaaagagcttactgccgagccgacaatcgtggcacaactgtgtaaggtgtgtctccatcgtaggcagcaccaacctagttag

SEQ ID NO: 60291 - DNA, 753 bp, Artificial Sequence
  Description of Artificial Sequence: Synthetic coding sequence
taatacgcactgccaaatgccagctggtgttctgatatgctgagcctgtatcaggaatttttagaaaagacgaagagttcagggtggattaaactgccatcatttaagtctaatagggatcatatcagggggctgaaactgccttctggacttgcagtttccagtgacaagggagactgccgcatcttcacacggtgcatacaagtggaaggacagggattcgagtatgtcattttcttccaacccacacagaagaagagcgtgtgtctttttcaacccggatcatacctggagggcccacctggcttcgcccatggcggatcacttgccgcaatgatggatgaaaccttctccaagacagcttttcttgccggtgaggggctctttactcttagcctgaatattcggttcaagaatcttattcctgtcgatagtcttgtcgtcatggacgtggaactcgacaaaatcgaggatcagaaactgtatatgtcatgcatagcgcacagctcgtggaaaaagagtctgcccagcaactctcactgcgcctgccggagagctacagcaagtcccgcatgtctgctccccccagcctcgcctgcatgtctgctgcccccagccagccccgcatgcctgcttccacccctccctgcctcgtgccttctgcctccactcccggcaagctgtctcctccccccactacccgcttgggatccatccaaaagtcgtgaagggagctcctcatctaattggtag

SEQ ID NO: 60292 - DNA, 402 bp, Artificial Sequence
  Description of Artificial Sequence: Synthetic coding sequence
atgagagatctcagcgaacgtcgtttgggccagccagaactgaaagccgaacagcaaatgccgctggagcctgttcgcgctcggctctccgtgggcttggcctgctgctgtagccatactaccgcggaggccagctctctggaacacggagacaaagtattcggtcagggtttcccctcccccctggaggagatcaagcgattgctgaaaatttctcgagctctccaggccaggtccgtgccatcgactcaggagaaggcgaaatgtcttagcggcgagcctggccagcctgaaggtaaggggcaagaaacctatcctgggccaggaaaggttgaaggtaaagccgaacctgctatgaggaaggacgatgtgtgccccggtatgaagtgtatctcaggctag

SEQ ID NO: 60293 - DNA, 402 bp, Artificial Sequence
  Description of Artificial Sequence: Synthetic coding sequence
atgcgcgacctgtcagagagacggctcggacagccagagttaaaggcggagcagcagatgcccctggaacctgtccgagctcgtctgtcggttgggctggcctgttgttgctctcataccacagcggaagcttcatccctggagcacggcgacaaggtctttggacaaggatttccttctcccctcgaggaaatcaaaaggctgctgaagattagccgagccctccaggcgagatccgtgccatctactcaggagaaggcgaagtgtttatctggagaacctggacaaccggaaggaaagggacaggaaacctatcctggtcccggaaaggtggagggaaaagcggagcccgcaatgcgcaaagacgacgtttgtccgggaatgaaatgcatttctggatag

SEQ ID NO: 60294 - DNA, 1551 bp, Artificial Sequence
  Description of Artificial Sequence: Synthetic coding sequence
atgccaagttcaacaagcccagaccagggcgacgacctggagaattgcattcttcgtttctcagacttggatctgaaggatatgtctctgatcaacccatcatcttcgctcaaagctgaactggacggcagcacaaaaaagaaatactccttcgcaaaaaaaaaagcctttgcactcttcgtcaaaacaaaggaggttcctactaagagatcttttgagtgcaaggaaaaactgtggaagtgctgccggcagttgtttactgaccagacctcgatacataggcatgtcgctacccagcatgccgatgaaatttaccaccaaaccgcctccattctaaaacagcttgctgtgacactttccaccagtaaatccctctcctcggctgatgagaaaaacccgcttaaggagtgtcttccccactctcacgacgtttccgcctggctgccagatatcagctgttttaatcccgatgagttaatctctggacagggaagtgaggaaggtgaggtcttgctctattattgttatcatgatctcgaggaccctcaatggatctgtgcttggcaaacggccctgtgtcagcacctccacctgacgggcaagatcaggattgcagccgagggtataaatggcaccgtggggggttccaaactggcaacacgcctttatgtggaggtaatgttgtcttttcctcttttcaaggatgacttgtgtaaggacgactttaagacttcaaagggcggtgcccactgctttcctgagttgcgggtcggagtgtttgaggaaatcgtgccgatgggcatctccccaaagaagatttcatacaagaagccaggaatccacctgtctcccggagaatttcataaggaggtcgagaaattcctctctcaggccaaccaagaacagtcagacaccatcttacttgactgcagaaatttttatgaaagcaagatcggaagattccagggctgtctggccccagatatacggaaattttcctatttcccctcttacgtggacaaaaacttggaactatttagggagaagcgagtccttatgtactgtactggcggtatccgctgtgaacgcggatctgcctatctgaaggcgaaaggcgtgtgtaaggaggtgttccagctaaaggggggtatacacaagtacttagaggaatttccggacgggttttataagggaaaactcttcgtcttcgatgagaggtatgccctctcatacaactcagatgtcgtttctgagtgcagttactgtggcgctcggtgggatcagtataaactctgttcaacaccacagtgccggcagcttgtcctaacatgtccagcctgccagggtcagggctttacagcatgctgtgtcacttgccaggataaggggagccggaaggttagtggccctatgcaggactctttcaaagaagagtgcgagtgcaccgctcgcagaccgagaattccgagagaactcctgcagcacgtcagacagcccgtctccccggaaccagggcctgatgcggatgaagatgggcctgtgttgatgtag

SEQ ID NO: 60295 - DNA, 504 bp, Artificial Sequence
  Description of Artificial Sequence: Synthetic coding sequence
atggatctgtgtttggccgacagctctgtgtcagcccctgcaccccaccgccaaggaatccatctttccccgggtgaattccataaagaggtggagaagtttctttcacaggcaaaccaagagcagtccgataccattttgctcgactgccggaatttttatgagtccaaaattggcagatttcaggggtgtcttgcccctgacattagaaagttctcatattttcctagttacgtagacaaaaatttggagctgttccgggaaaagagggtgctgatgtattgcacagggggtattcgttgcgaaagaggcagcgcatatctgaaagcaaaaggcgtctgcaaagaggtgtttcagttgaaagggggaatccacaagtacttagaagaattcccagatggattctacaaaggcaaactgtttgtatttgatgagcgatatgccctgtcctataactctgacgtggtgtctggcaggtctgcgcaggcccagagtcccaactag

SEQ ID NO: 60296 - DNA, 219 bp, Artificial Sequence
  Description of Artificial Sequence: Synthetic coding sequence
atgctgtcatttcctctgtttaaggacgatttgtgtaaagacgatttcaaaacatcgaaggggggagcccactgcttccctgagctccgggtgggggtgttcgaggaaattgtgccaatgggcatctcccccaagaaaatctcctacaaaaagccgggaatgttagcgtttagacgcctctgtttcaatagccaggggcagaatctgatcgataaatag

SEQ ID NO: 60297 - DNA, 504 bp, Artificial Sequence
  Description of Artificial Sequence: Synthetic coding sequence
atggatctctgccttgcagactctagcgtctccgctcccgctcctcatagacaggggattcacctgagtccaggggagtttcataaggaagtggaaaagtttctctcacaggcaaaccaggaacagagcgataccatactcctggattgcagaaacttctatgaaagtaaaattggcagattccagggctgcctcgcaccagatatcaggaaattctcctacttcccttcatatgtagataagaacctcgagctttttagagagaagagagtgctcatgtactgtaccggaggaatcaggtgcgaaaggggaagtgcctatctcaaggcaaagggagtatgtaaagaggtgtttcagcttaagggcggaatccataaataccttgaagaattcccagatggattctataagggcaaactgtttgtctttgacgagcggtatgcattgtcctacaactccgatgtagtaagcggcaggtccgcccaggctcagtcgcccaactag

SEQ ID NO: 60298 - DNA, 648 bp, Artificial Sequence
  Description of Artificial Sequence: Synthetic coding sequence
atgctgagctttccccttttcaaagacgacctatgtaaggatgacttcaagaccagtaagggaggcgcacattgttttccagagctccgggtgggagtctttgaggagatcgtcccaatgggaataagtcccaaaaagatatcttacaagaagcccggaattcatctaagccctggcgagttccataaagaagtggagaagtttctgtcccaggcaaaccaagagcagagcgatacgatcctgcttgactgccgcaacttctacgaaagcaaaattgggcgatttcaggggtgcttggccccagatattagaaagttttcctactttccctcatacgttgacaagaatctagaactgttccgggaaaagagagtgctaatgtattgcactggaggaatacggtgtgagaggggaagtgcctaccttaaggcaaaaggtgtatgcaaagaagtgttccaactgaagggcggaatccacaaatacctggaggagtttcctgacggcttttacaaggggaaattattcgtgttcgacgagagatatgccttgagctacaacagcgatgtggtctccgagtgctcctactgcggcgcaaggtgggaccaatacaaattgtgctctactcctcaactggacactttaccttag

SEQ ID NO: 60299 - DNA, 339 bp, Artificial Sequence
  Description of Artificial Sequence: Synthetic coding sequence
atgtacgtctttattatgatggccttccccagctcccccgagtgcagctactgtggtgcacggtgggaccagtacaaactgtgctccacaccacaatgtcggcagctggtgctgacctgccctgcatgccagggccaagggtttacggcgtgttgtgtaacttgtcaggataagggcagcaggaaggtgtctggtccaatgcaggattctttcaaggaggaatgtgaatgcacggcgagaaggccccgtatccctcgcgagctcctgcaacacgtccgccaacctgttagccccgagcctggtcccgatgcagatgaagacggacctgtcctcatgtag

SEQ ID NO: 60300 - DNA, 711 bp, Artificial Sequence
  Description of Artificial Sequence: Synthetic coding sequence
atgtcagaagctcctcgggcagagacttttgtgtttctcgatctggaagcgaccggcctccctagcgtcgaaccagagattgccgagctgtctctgttcgccgtgcacaggagctcactggaaaacccagagcacgacgagtcaggtgctctggtgcttccccgagttttggacaagcttactctctgcatgtgtcccgaacgcccatttaccgccaaggctagtgagattacggggttaagctccgaggggctggccaggtgccgaaaagccggtttcgatggcgcagtggtccgaacactgcaggcatttttatctcggcaggccggacccatatgcttggtggcacacaatggattcgattatgactttcccttactatgcgctgagcttcgcaggctgggggctcgtctaccacgggatacagtatgtttagacacactccccgctctccgcggactggacagggcccatagccacggcacacgagccaggggacggcaagggtacagtctggggagcctgtttcataggtacttccgggcagagccttccgcggctcattctgccgaaggcgacgtgcacactcttcttctcatctttctacatcgcgcagccgaacttctggcatgggcagatgaacaggccaggggctgggctcatattgaaccaatgtatctgcctcccgacgacccttctttagaagcctag

SEQ ID NO: 60301 - DNA, 2232 bp, Artificial Sequence
  Description of Artificial Sequence: Synthetic coding sequence
atgctccactttaatagatgccatcatctcaagaagatcacccagaaatgcttttccagcattcacgtcaaaacagacaaacacgcgcagaggtttctgtctaggacctttgcattggctgagctccgcaagtcctggtactctacacacagcctggtgggagacaaaaatatcatactgatgggccctccgggtgcgggaaaaaccactgtggggagaattatcggccaaaagctgggatgttgtgttatcgatgtggatgatgatattctcgaaaaaacctggaacatgtcagtttcagaaaagctgcaggacgttggtaacgaacagttcctggaagaggaagggaaggccgtcctgaatttctccgcctcaggatctgtcatatcactcaccggatcaaatcctatgcatgacgctagcatgtggcacctgaagaagaacggcattattgtatatctagacgtgccgcttcttgatctgatctgtcgactcaagctcatgaagacggacagaatcgttgggcagaacagcggaacctctatgaaggatctgttaaaattcaggcgtcagtattacaagaaatggtatgacgcacgggtgttctgcgagtctggtgctagccccgaagaagtggctgataaggtgcttaatgccattaagcgataccaagatgtagactctgaaacattcatctctaccagacacgtctggcctgaagactgcgaacaaaaggtctccgccaaatttttcagcgaggcggtcatagagggactcgcatctgatggcggacttttcgtgcccgctaaggagttccctaagctctcatgcggagaatggaagtcactagttggggcaacctatgtcgagcgcgctcaaattctgctggaacggtgtatccaccccgctgacatacctgctgcccgtttaggagagatgattgaaactgcttatggggagaattttgcttgttctaaaatagcaccggtccggcatctgagtgggaaccaatttattttggagttgtttcacggaccaaccggctcctttaaggatctgtctttgcaactcatgcctcacatatttgcccactgtattccaccatcttgtaattacatgatccttgttgccaccagtggagatacagggtccgccgtgctcaatgggtttagtcgtctgaacaagaacgacaaacagcgtatcgccgttgtggctttttttcccgaaaatggagtgtcagacttccagaaggcgcagatcatcggctctcagcgagagaacgggtgggctgttggcgtggaaagcgacttcgatttttgccagactgccattaagcgtatcttcaatgactctgatttcaccggcttcttgacagtggaatacggcacaatcctgtcatcagcaaacagtataaactggggacgcctcctgcctcaagtcgtgtatcacgccagcgcatatttggacttagtttctcagggcttcatatccttcggatcaccggtggatgtgtgcatcccaacaggcaattttggaaatatcctcgccgctgtgtatgccaagatgatgggcattcccatcaggaaattcatatgcgcttcgaaccagaatcatgtgctgaccgactttatcaagacaggccactacgacctgcgggagaggaaactcgcgcagacctttagcccgtccatcgatattctgaagagctcgaatctggaaagacatctgcatttgatggcaaataaggatggccaactgatgaccgaactgtttaataggctggagagccagcaccacttccaaatcgaaaaagctctggtggaaaagctccagcaggattttgtcgcagattggtgtagcgagggggagtgcctagccgctattaacagcacctacaatactagcggctatatcctcgatcctcacacagcggtagccaaggtggttgccgatcgcgttcaggacaagacatgccctgttatcatctcatcaacggcacattattctaagtttgccccagcaattatgcaagcgctaaagattaaagaaattaatgagacgagctcttcccagctttacctcctgggatcctataacgccctccccccactgcacgaagcactgctcgagaggacgaagcaacaggagaagatggagtaccaagtgtgcgctgctgatatgaacgtgctaaaaagccatgtggagcaattagtgcagaaccagtttatttag

SEQ ID NO: 60302 - DNA, 2232 bp, Artificial Sequence
  Description of Artificial Sequence: Synthetic coding sequence
atgttacacttcaatcgctgccatcacctgaaaaaaattacacagaagtgcttttcctccatccacgtgaaaactgataaacacgctcagagattcctgtcaaggaccttcgctctggcagaactgagaaaatcttggtatagcacccacagccttgtgggcgacaaaaacattattctaatgggcccaccaggagctggaaaaaccaccgtgggcaggattattgggcaaaagctcggctgttgtgtgattgatgtggacgatgacatactggaaaaaacctggaacatgagtgtaagtgaaaaacttcaggacgttgggaacgagcagttcctggaagaagaaggtaaggcggtactgaattttagcgcgtctggatccgtgatctcactgaccggctctaatcccatgcatgacgcgagtatgtggcatctgaagaagaatgggattattgtttatttagatgtgccacttctggacctgatatgccgtctcaagttgatgaaaactgaccggatcgtagggcagaatagtggcaccagcatgaaggacctactcaagttcaggcggcagtattacaagaagtggtatgacgcccgagttttctgtgaaagtggcgcttccccggaagaagtagccgataaagtgcttaacgcaatcaagcgctaccaggatgtggacagcgagacatttataagtactaggcacgtctggcccgaagactgcgaacagaaggtctccgccaagtttttttccgaggctgttattgagggtctcgcttcagatggcggtctgttcgtcccagctaaagaatttcccaaactctcttgtggtgagtggaaatctctggtgggcgcaacctacgtggaaagggcgcagatcttgctggaacgctgcattcaccctgcggacatccccgctgcacggctgggtgaaatgatcgagaccgcgtacggtgagaattttgcgtgttcaaaaattgctccggtgaggcacttgagcggcaaccagtttatcctcgagctgtttcacggccctaccggcagctttaaggacctctcacttcagctcatgccccatatcttcgcccactgcatcccaccatcatgtaattatatgatcctggtggctacatcaggggatactggatccgccgtgctcaacgggtttagccggctgaacaagaatgataagcagaggatcgccgtggtggcattctttcccgagaacggagtgagcgactttcagaaggctcaaatcattggctctcaaagagagaatgggtgggctgtgggcgtggagagtgatttcgatttttgtcagactgccatcaaaagaatctttaacgacagcgatttcaccggttttttaacggttgagtatggcacgatcctcagttccgcaaacagcattaattggggcaggctgctgccgcaggtggtctaccacgcttctgcctacctggacctcgtatcacagggattcatttccttcgggtcccccgtggatgtgtgtatcccaactggcaattttggaaacattctagcagccgtctacgccaagatgatggggattccaattcgtaaattcatttgtgcttccaaccagaaccacgtcctcacggatttcatcaagactgggcattatgacctgcgcgagagaaaactggcccagacttttagccccagtattgatattctgaaaagttctaacttggaacgccacctgcaccttatggccaataaagatggacagcttatgaccgaactctttaatagactggagtctcaacatcactttcagatcgagaaagccttggtcgaaaaactgcagcaggactttgtcgccgattggtgttctgagggggaatgtctcgctgccatcaattccacttataacacttcaggatacatactggaccctcatactgcagtcgctaaggtggtcgcggacagagtccaggataagacatgtcccgtcatcatttcttccaccgctcactacagtaagtttgcacccgctatcatgcaagcgctcaaaataaaagagattaatgaaacatcttcctctcagttatacctcctgggtagttacaacgccctccccccattgcacgaggccctcctggagcgaacgaagcagcaggaaaagatggagtatcaggtgtgcgcggctgacatgaacgtccttaaaagccacgtcgagcagctcgttcaaaatcagttcatatag

SEQ ID NO: 60303 - DNA, 2301 bp, Artificial Sequence
  Description of Artificial Sequence: Synthetic coding sequence
atggcagctgaggccttggcagctgaagccgtggcatctcggctcgagaggcaggaagaagatatacgctggttatggtctgaagtggagagattgagggatgagcagctgaatgcaccatattcatgccaggctgagggaccctgcctcacgagagaggtggcacagcttcgcgctgaaaactgtgatctccgacatagactgtgctcgctccgattgtgtctggccgaggaaagatctaggcaggccactttggaaagtgctgaattggaggccgctcaagaagccggagctcagcctcctcccagccagagccaggataaagacatgaaaaaaaaaaagatgaaggagtccgaagcagacagcgaagtgaagcatcagccaatcttcatcaaggagaggctgaagctgttcgaaattttgaagaaggatcaccagctgctcctggcgatttacggcaagaagggcgacacctctaacattattactgtgagggtcgccgatggtcagaccgtgcagggtgaggtgtggaagaccaccccataccaggttgccgcagagattagccaggagctcgctgagagcactgtaatagcaaaggtgaatggggaactctgggatctggaccgtccccttgaaggggatagttctctcgagttactgacattcgacaatgaggaggcccaagcagtttactggcactcttccgcacacattctgggagaagccatggaactttactacggcggacacctttgctatggccctcccatcgagaacggcttctactatgatatgttcatcgaagatagggctgttagttcaaccgagttgtctgctcttgagaacatatgtaaggccatcatcaaagagaaacagcccttcgaacgtctcgaggtctctaaggagatcctcctggaaatgtttaaatacaataagtttaagtgtaggatccttaatgaaaaagtgaataccgcaacgaccactgtctaccgctgcggtcccctgatcgatctttgtaaagggcctcatgtcagacatactggcaaaattaagaccatcaagatcttcaagaactctagcacctattgggaggggaatcccgagatggaaactctgcagcgcatttacggtataagcttccccgataataaaatgatgcgggactgggagaagttccaggaggaggccaagaaccgagatcacagaaaaatcgggaaagaacaggaactgtttttttttcacgacctaagcccaggaagctgcttctttttaccaaggggcgcattcatttacaacactttaaccgactttatccgagaagagtatcacaaaagggacttcactgaagtcctgtcacccaacatgtacaactcaaagctttgggaagcgtccgggcactggcagcactactccgaaaacatgtttactttcgagatcgaaaaagacacctttgccctgaagcccatgaactgcccaggacattgcctcatgttcgcccatcgtccgaggtcatggagagagatgcctatcaggttcgccgactttggagtcctacaccgaaatgagttatcggggacactgtcaggactcacacgggttcgacggtttcaacaggatgacgcacatatcttctgtacagtggagcagatcgaggaggagattaaaggttgcctccagttcctgcagagcgtatactccacattcggcttctcctttcagctcaacttatctacccgccctgagaatttcctgggcgagattgagatgtggaacgaagccgagaaacagctgcagaattcactaatggattttggcgaaccatggaaaatgaatcccggagatggagcattctacgggccaaaaatcgatataaaaataaaagacgcgataggtcgttatcatcagtgcgccaccattcagctagactttcaacttcccataaggttcaaccttacatacgtgtcgaaagacggggatgataagaaaagacccgttattattcaccgggctatcctgggcagcgtagaacgtatgatcgcgatcttgtccgagaactatggtggaaagtggcccttttggctgtcccccaggcaagtcatggttattcccgtaggaccaacgtgcgagaaatatgcactgcaggtcagtagcgaatttttcgaagaaggctttatggccgatgtcgacctcgaccattcctgtactttgaataagaaaatcagaaacgcacagttggcgcagtacaattttatactggaccggttcctgcctagcgtttggcaggaagcgtggctttag

SEQ ID NO: 60304 - DNA, 4830 bp, Artificial Sequence
  Description of Artificial Sequence: Synthetic coding sequence
atgttcccaaagtctaatctgactgttacttgctgggtgtggcgcagcatgcggaagctgtttctcttgttgtccctgcttctgagccacgcagcccacctagaaggaaagaaggacaatcagttcatatggaaacctgggccttggggaagatgcacgggggattgcgggccaggcggagtccagtctcgcgctgtgtggtgttttcacgtggacggttggacctcccatctcagcaactgcggagagtctaacaggcctccaaaagagagatcttgcttcagagtatgcgactggcattctgatctctttcagtgggaggtttccgactggcaccattgcgtgctcgtgccttacgctcgaggagaggtaaagcctaggacagccgaatgtgtgactgcccagcacggcttgcaacatagaatggtgagatgcatccagaaattgaaccgtaccgtcgttgctaatgagatctgtgaacatttcgccctgcagccaccaactgaacaggcatgtctgatcccttgccctagggactgcgtggtttccgagtttctcccatggagtaattgttcaaaggggtgcggaaagaaacttcagcaccggactcgagccgttatcgctccgccactgttcgggggattgcagtgtcccaacttgacggagagcagggcatgtgacgctcctatcagttgtccactgggagaagaggagtacactttcagtttgaaggttggcccatggtctaaatgcagacttccccatcttaaggagatcaatccgtctggacggaccgtcctggatttcaactctgacagcaacgagcgcgtaacctttaagcatcagtcgtacaaggcccaccatcactccaaatcttgggccatcgagattggatatcagacccgacaggtgagctgcactaggtcagacgggcagaacgcaatgctgtccctgtgcctgcaggattctttcccccttaccgttcagtcatgcataatgccgaaggactgtgaaaccagccagtggtcctcatggtcaccatgtagcaaaacctgtcgctcagggtccctcttgccaggcttccggtcccgcagccgcaacgtaaaacacatggccatcggcggaggcaaggaatgcccagaattgcttgaaaaggaagcttgtatagtagaaggggaactgttgcaacagtgccctaggtactcctggcgcacgtccgagtggaaggaatgtcaggtgtctcttctcttagaacagcaggacccccattggcatgtaacagggcctgtgtgcggcggtgggattcaaactcgggaggtctattgtgcccagagcgtcccagccgctgccgcactgcgggcaaaagaggttagtaggcccgtggagaaggctttgtgtgtgggcccagcccctttaccctcccagctgtgcaatatcccctgcagtaccgactgcattgtctcaagctggtcagcatggggtttatgtatccacgaaaactgccacgatccccaggggaaaaaggggttccgtacccggcagagacacgtcctgatggagagtacggggcctgcagggcattgccctcatctggtggaaagcgtgccatgcgaagatccgatgtgctaccggtggcttgcctcagaaggcatttgtttccccgatcacggtaagtgtggcctggggcacagaatactcaaagctgtttgccagaacgacaggggtgaggacgtgtctggatcattgtgccccgtgccacccccacctgagaggaagtcttgcgagatcccctgcaggatggactgtgtgctgtccgagtggaccgaatggtcatcctgtagccagtcgtgttctaataaaaattctgatgggaagcagacacggagtcgaaccatccttgccctggctggagaagggggtaagccttgccctccatcccaagccttgcaagaacaccgcttatgtaacgaccattcatgtatgcagctccactgggaaacaagtccctggggaccttgctccgaggatacactggtgaccgccctcaatgcgacgataggctggaacggtgaagcaacatgtggcgtcgggattcagacacgcagggtgttttgcgtcaagtcccatgtgggccaggtaatgacgaagcggtgtcccgacagtactcggccagagactgtcagaccctgttttctgccttgcaaaaaggactgtatagtgaccgctttttcggaatggacaccttgtccaaggatgtgtcaggcagggaatgctactgttaaacagtcccggtaccgtataatcattcaggaagctgccaatggtggccaggaatgccccgacactctgtatgaggagcgcgagtgcgaggacgttagcctgtgccccgtctatcgatggaaaccccagaagtggtctccatgcattcttgtccctgagtcagtgtggcagggaatcacggggtccagtgaggcgtgtggcaagggtctccagacacgtgctgtctcctgcatctcggatgacaatagaagcgcagagatgatggagtgcttgaagcagacaaacggcatgccactgctggtccaagagtgtactgtgccctgccgggaagattgtactttcacagcttggtccaagttcacaccgtgctccacaaattgcgaagcgactaaaagtcgcaggcgccagctgacaggaaagtcaagaaagaaggagaagtgccaggattccgacctgtaccccttagtggagaccgagctgtgtccttgtgacgagttcatcagtcagccttatggcaactggagcgattgtatcctccccgagggcaggcgcgagcctcatcgcggactccgagtccaagccgacagcaaagaatgcggcgagggactcagatttcgggctgtcgcatgtagtgataagaatggtcgcccagtggacccgtctttttgtagctcttctggctacatacaggaaaaatgcgtaattccctgtccattcgattgcaagctcagcgactggtcctcatggggatcatgtagctctagctgcggcataggagtcaggatccgatctaaatggttgaaggaaaaaccatataacggcggtcggccatgtccaaaactggacctgaaaaaccagaatgctcaagtgcacgaggccgtaccatgctactccgagtgcaaccagtactcctgggtcgtggagcactggtccagctgtaaaattaacaatgaactgcgatctctccggtgcgggggaggaacacagtcaaggaagattcgctgcgtgaataccgccgatggcgaaggaggagcagtagatagcaatctgtgtaatcaggacgagatcccacctgaaacacagagctgcagtctgatgtgcccgaatgagtgcgtgatgagcgagtggggcttgtggtcaaagtgtcctcagtcttgcgaccctcacacaatgcagcgaagaacgaggcatcttctgagacccagcctgaattcccgtacctgtgcagaggacagtcaggtgcaaccttgcttactgaatgagaactgcttccagtttcagtacaatttaaccgagtggtcaacatgccagcttagcgagaatgcaccttgcggccaaggtgtgcgaacccgcctgttgtcatgcgtttgcagcgacggcaaacccgtctccatggaccagtgcgaacagcataacctagagaagccccagcggatgagcattccatgtttggttgaatgcgtggtgaattgtcagctgagtggatggacagcatggaccgagtgttcacagacatgtggccatggcggtaggatgtccaggaccagatttatcatcatgcctacacagggggaaggccgtccgtgcccgaccgagttgactcaggaaaaaacttgccccgtgactccttgctacagctgggtactgggcaactggtccgcatgcaagctcgagggcggagattgtggcgaaggcgtccagattcggtcgctgagctgcatggttcactcaggttctatctcccatgccgctgggagagtggaggacgctctgtgtggggagatgccttttcaggattccattctgaagcagctctgtagcgtcccatgcccaggggactgccatcttactgagtggagtgaatggagtacctgcgagctgacttgtatcgacggcagatcttttgagactgtgggcagacagtcaaggtcacggacttttatcatccagagttttgagaaccaggactcctgtccacagcaggtgcttgagactcgcccatgtaccggtgggaagtgctaccactatacctggaaggctagcctctggaataataacgagcgcaccgtctggtgtcaacgtagcgatggcgtgaacgtgactggcggttgttcaccacaggccagacctgccgctatcagacagtgtatacctgcatgtcgcaaacccttctcatattgcacccagggcggagtgtgtgggtgtgagaaagggtacaccgagatcatgaaaagcaacggtttccttgattactgtatgaaggtgcccggatctgaggataaaaaggctgatgtgaaaaatctgtccgggaagaaccggccagtgaatagcaaaatacatgacatctttaagggatggtctctgcagcccctagacccagatgggagagtgaaaatatgggtatacggcgtgtctggcggagcatttctgatcatgatcttcctgattttcacctcctaccttgtgtgtaaaaaacctaaaccccatcagtctaccccccctcagcagaagcctctgactcttgcctatgatggcgatctggatatgtag

SEQ ID NO: 60305 - DNA, 4737 bp, Artificial Sequence
  Description of Artificial Sequence: Synthetic coding sequence
atgcacaacacagcagacgaagtggtcttgtaccataagttggctgggccttggggacgctgcaccggcgattgtggccctggtggtgtgcagagccgagcagtgtggtgcttccacgtcgatggctggacttcacatttgtccaactgtggcgagtctaatcggccaccgaaggaacgctcgtgttttagagtgtgcgattggcacagtgatctattccagtgggaagtttccgactggcaccactgtgtcctggttccatatgcccgaggagaggtgaaacctaggacagctgagtgcgttacagctcagcatggcctacagcaccgaatggtacgctgcatccagaagttaaatcgaaccgttgtcgccaacgaaatctgtgagcatttcgccctccagccacccactgagcaggcttgcctgatcccctgtccaagagactgcgtggtctcagaattcctgccatggtctaattgttcaaaagggtgcggcaaaaagctgcaacacagaacacgggcagtcatagccccacctctgtttggcggtctgcagtgccctaacctaactgagtctcgcgcttgtgacgcgcctatatcttgccccctcggtgaagaggagtacaccttctctcttaaggtgggcccttggtccaaatgtaggctaccccacctcaaggaaattaacccctccggcagaaccgttctggactttaattctgatagtaacgagcgtgtgactttcaagcatcagtcctacaaggcccatcaccactccaagagctgggctatagagatagggtatcaaacacgccaggttagctgcacaagatcggacgggcagaatgctatgctttcgctctgtctccaggatagcttcccgctcaccgtgcagagttgcattatgccaaaggactgcgagacctcgcagtggagttcttggtccccgtgttcaaaaacatgcagatctgggagtctcctcccaggattcaggtctaggtctcgcaatgttaagcatatggcaattggaggcggaaaagagtgtccggaactattagagaaggaagcctgtatcgtggaaggggagcttcttcaacaatgtcccagatacagctggaggaccagtgaatggaaggagtgccaagtgtctttgctgctcgaacaacaggatcctcactggcacgttactggtcccgtgtgtggaggcggaatccaaacacgtgaggtctattgcgcacagagcgtgcccgctgctgccgcattgcgggcaaaagaagtaagccgacctgtggagaaagcactgtgcgttgggcctgcccctttaccctcacagctatgcaatattccatgttccacggactgcatagtcagcagctggtctgcctggggcctgtgtatccatgagaattgccatgacccccagggaaagaaggggttcaggacaagacagagacatgttctgatggagtccacaggtccagccggtcattgcccccaccttgtggagtccgttccctgcgaagaccccatgtgttatcggtggttggctagcgaagggatttgctttccagaccacgggaagtgtggcctggggcaccggatcttaaaggccgtctgtcaaaacgaccgcggtgaggatgttagcggatcactttgtcctgtcccaccccctcccgaacgcaagtcatgtgaaattccatgtcgcatggactgcgttctgtcagaatggacagagtggagctcatgtagtcagtcctgttccaacaaaaactctgatggaaagcagacgcgcagcagaactattctggccttggccggtgagggcggaaagccttgccctccgtcacaggccctccaggagcatcgcctttgcaacgatcattcctgcatgcaactacactgggaaacgagcccttggggcccatgtagcgaggataccctcgttacagccctcaatgcaacgattggctggaatggggaggcgacctgtggggttggaattcagacaagacgggtgttctgtgtcaagtcccacgttggacaggttatgacaaaaaggtgtccagatagtactagaccagagacggtgcgcccttgcttcctgccatgtaaaaaggactgcatcgtcacagccttcagcgagtggaccccttgtcccaggatgtgtcaggcgggtaacgctaccgtgaagcagtcaaggtatcggatcattatacaagaagctgccaacggcggacaggagtgtcctgacactctctacgaagagagagagtgcgaggatgtgtcactctgtcccgtttataggtggaaaccccagaaatggagcccctgcatccttgtcccagagtccgtttggcaagggattacaggctcctcagaagcctgcggaaaagggctgcagaccagggctgtcagctgtattagtgacgacaaccgcagcgctgagatgatggagtgcctgaagcagaccaacggcatgcctctgttggtgcaggaatgtacagttccctgcagagaagactgtacttttactgcttggtccaagtttacaccctgttctacaaactgtgaggctacgaagagccgcagaaggcaattgacagggaagtcccggaagaaggagaagtgccaagattccgacttatatccactggttgaaaccgagctgtgtccttgcgatgagttcatcagtcagccctatggtaactggtctgattgcatcctgcccgagggaaggcgcgagccccatagaggcttgagggtgcaagccgatagcaaggaatgcggagaaggcctgcggttcagggcagtggcttgctccgacaaaaacggccgtcccgttgacccgagcttttgtagttcgagtggctatatccaagagaaatgcgtgattccatgcccattcgattgtaaactatcagattggtctagctgggggagctgctccagtagctgtggaataggcgtgaggatcagatccaagtggctcaaagagaagccatataacggcggtaggccttgtcccaaacttgacctgaagaaccaaaatgctcaggtacacgaagcagttccgtgctactctgagtgcaatcagtacagctgggtggtggaacattggagctcctgcaagatcaataatgagctccggtccctgcgttgcggcggtggaacacaatcacgcaaaatccgctgcgtcaacaccgccgacggtgaaggcggagcagtggactccaatttatgtaaccaggatgagattcccccagaaacccagagctgttccctgatgtgccctaacgagtgtgtaatgagcgagtggggcctgtggagcaagtgtccacaaagctgcgacccccataccatgcagaggcgcaccagacatctgttaagacccagtctgaacagcaggacatgtgccgaggactctcaggttcagccttgtttgctgaatgaaaattgcttccaatttcagtacaaccttacagagtggagtacctgccagttatctgaaaacgcgccatgtggccagggggtgcggactcggctcttgagctgtgtttgctccgatggcaaacctgtatctatggaccaatgcgagcaacacaacctagagaaacctcagaggatgagcattccctgccttgtggagtgtgtcgttaattgtcagctatcgggatggactgcatggacggagtgttcacaaacctgtggccatggcggacggatgtcaagaactagatttataatcatgcccactcaaggagaaggacgaccttgccccacagagttgacccaggagaaaacttgtccagtgacaccctgctatagttgggtgctgggcaactggtcagcatgtaaacttgaaggcggtgattgcggagagggggtgcagataaggagtctctcgtgtatggttcactcagggtctatcagccacgccgctggaagggtggaagatgccctgtgtggagaaatgccgttccaggactcaattctgaagcagctttgcagcgtgccttgtcctggcgattgtcatctcaccgaatggtctgagtggagcacatgcgaattgacctgtatcgatggaagatcctttgagacagtcggcaggcagagccggtcacggaccttcataatacagtccttcgaaaatcaggactcctgccctcaacaagtcctggagacgcgaccttgtactggcggtaaatgttatcactatacctggaaggctagcctttggaacaataatgagaggacagtctggtgccagcgatcggatggggtgaatgttactggcggatgtagtccccaggcgcgaccagctgcgatcagacagtgcattcccgcttgtagaaaacctttctcttactgcacccaggggggtgtttgtggctgtgaaaaaggctacacagaaattatgaagtctaacggcttcctggattactgcatgaaggtgccagggagtgaggacaagaaggctgatgtaaaaaacctctcgggtaagaatagacccgtcaatagtaaaattcacgatatcttcaagggctggtccctccagcccctggaccctgatgggcgtgttaagatttgggtctacggcgtatccggcggagcatttctgatcatgattttcctcatcttcacatcttacctggtatgtaagaagccaaagccccaccaatccacacccccacaacagaagccgctcaccctcgcctacgatggcgacctggacatgtag

SEQ ID NO: 60306 - DNA, 1002 bp, Artificial Sequence
  Description of Artificial Sequence: Synthetic coding sequence
atggtacgctgcattcagaagctgaataggaccgtagtggccaacgaaatctgtgagcatttcgccctacagcctcccaccgaacaggcctgtctgattccttgtccgcgagactgtgtggtgagtgagttcctgccatggtctaactgctcaaaagggtgtggaaaaaagctgcaacaccgaactcgcgcagtgatcgccccacccctgttcgggggtctccagtgcccgaaccttacggagagtagggcttgcgatgctccgataagctgccccctgggggaagaggagtacacctttagtctgaaggtgggaccttggtccaagtgtcgattacctcaccttaaagaaatcaacccctcaggcagaacagtactggacttcaactctgattctaacgaaagagtcacattcaaacaccagagctataaggctcatcaccattcaaaatcttgggccatcgagataggctaccagacacggcaggtgagctgtacaaggagtgacgggcagaatgcgatgctgagcctgtgtctccaggatagctttcctttgacagttcaatcctgtattatgccaaaagattgtgaaaccagccaatggtctagctggtccccttgttctaagacttgtcgatccgggagtctcctgcctggattccgctcccgcagccggaatgtgaaacatatggcaatcggcggaggtaaggagtgccccgaactgctggagaaagaggcttgcatagtcgaaggcgagctgctccaacagtgccccaggtattcatggagaactagtgagtggaaggagtgccagcaggtcttcggaactataacgaatgagttgtatggagcttccgtccaaatggccctgatgtctcaggaggcggcaccactaagacctgtgcttcttccttttggttccgccttccagccagccgaaaatttgtctccaactgtgcatagggtcgagtcagtggtggtgcgtcgggcaatacagcgatag

SEQ ID NO: 60307 - DNA, 1062 bp, Artificial Sequence
  Description of Artificial Sequence: Synthetic coding sequence
atggccgctcccgcacagcaaactacacaacccggtggaggaaaacgcaagggtaaggcacagtatgtgctggccaaacgagccaggagatgcgacgccggtggaccgaggcaactcgaacccggactccagggtattcttataacatgcaacatgaacgaaaggaagtgcgtagaggaagcgtattcactgctcaacgaatatggggatgatatgtatggccctgaaaaatttaccgacaaagaccagcagccttcagggtctgagggggaggacgacgacgccgaggccgctctcaagaaggaagtcggcgacattaaggctagcacggagatgagattacggcgattccagtccgtcgaaagtggtgccaacaatgtcgtgttcattagaacactgggcatcgagccggagaaactggtccaccatatcctgcaagacatgtacaagacgaagaagaagaaaacccgggtaatcctacgcatgttacctataagtgggacctgcaaggccttcctggaggacatgaagaagtacgccgagacatttttagagccatggtttaaagcacccaacaagggcacctttcagatcgtctataagagcagaaataacagtcatgtaaacagagaggaagtgatccgtgaactggccggtatagtgtgcacactgaattcagaaaacaaagtggatctcactaacccccagtacacagtggttgtggagatcattaaggctgtgtgctgcttatccgtggttaaagattatatgctgttccggaagtataaccttcaagaggtcgttaagtctccgaaagatccatcccagcttaactcaaagcaggggaatgggaaagaggccaaattggagtcagctgataagagcgaccagaataatacagccgaagggaaaaataatcaacaagtgccggaaaatactgaagaacttggccagaccaagcccacgagcaatccacaggtcgtgaacgaagggggtgccaagccagaactcgcctctcaagctacagagggcagcaagagcaacgagaacgacttctcctag

SEQ ID NO: 60308 - DNA, 1062 bp, Artificial Sequence
  Description of Artificial Sequence: Synthetic coding sequence
atggcggctcccgctcagcaaacaacccaaccaggcggaggaaaaaggaagggaaaagcacagtacgtactggcgaaacgggctcgcaggtgcgatgccggtgggcctaggcaactggagcctggcctccaaggtatactcattacttgcaatatgaacgagagaaagtgtgtggaagaggcgtactccttgttaaacgaatacggggatgatatgtacgggcctgaaaaattcacggacaaagaccagcagccttcaggatcagagggagaagacgatgacgctgaagccgcattgaagaaggaggtcggggacattaaagccagcacggagatgagattaaggaggttccagagcgtggagagcggggctaacaatgtggtgttcatacgcactctgggcattgaacccgagaagctggtacaccatatcctgcaagacatgtacaagaccaagaagaagaagacccgcgtaatccttaggatgttacctatctctgggacctgcaaggctttcttggaggatatgaagaagtatgcagaaaccttccttgagccttggttcaaggccccaaacaaaggcaccttccaaattgtgtacaagagccggaacaacagccacgtgaatagggaggaggtgatccgggaacttgctggtattgtgtgtacgttgaacagcgaaaataaagttgatctgaccaacccccagtacactgtcgtggttgagattattaaggcagtttgctgcctgagcgtggtgaaagattacatgttgtttcggaagtacaacctccaggaggtggttaagagtcccaaggatcccagccagctgaatagcaaacaaggcaatggtaaggaggccaaactggagtcagctgacaagtccgatcaaaacaacactgccgaaggaaaaaacaaccagcaagtacccgaaaatacggaggagttgggccagacgaagcccacttccaaccctcaggtggtgaatgaggggggagcaaaaccagaactggctagtcaggcaacagagggctccaagagtaatgagaacgacttttcatag

SEQ ID NO: 60309 - DNA, 1320 bp, Artificial Sequence
  Description of Artificial Sequence: Synthetic coding sequence
atggccgcaatgctccctctgcttgattcaggttgttcaagagaggccggtcaggaggccggactggggcgagtcagcctacacccgttccacgactgcaggcctgcactcggccctggggcagccagaaatgaagcctcgcgaccagcgaggggtggtaggaggagctatcccacatcaccagtgagggctggggacaggcggggtaggcagcaacagcgtagaaacgtatcacttagttctcagttcgcacatacaatggcagctccggctcagcagacaacacaacccggaggtggaaagaggaagggcaaggctcagtacgtgctggccaagagggcccgaaggtgtgacgccggtggacctcggcagctcgagcccggactgcaagggattctgatcacttgtaatatgaacgaacggaagtgtgtggaagaggcttacagccttctgaacgagtacggtgatgatatgtatggaccggagaagtttactgataaggaccagcagccatcaggctctgagggcgaagatgacgacgccgaggctgcgctcaaaaaggaggtgggggatattaaggcctccacagaaatgagacttcggagattccagtctgtcgagtcaggtgccaacaacgtggtcttcattcggactctcggaattgagcccgagaaacttgtccaccatatcctccaggacatgtacaaaacaaagaagaagaagactcgcgtgatccttaggatgctgccaatcagtggaacttgtaaagcctttttagaagatatgaaaaagtacgccgagacctttttagagccttggtttaaggctcccaacaaagggacctttcagatcgtctacaaatcacgtaataattctcatgtgaacagagaggaggttattcgtgaattggctgggatcgtctgcactctgaacagcgagaataaggtggacctgactaaccctcagtataccgtggtggttgaaataatcaaggcagtgtgctgcttgtccgtcgtaaaagattacatgttgttccggaagtataacctccaggaggttgtgaaatctcccaaggatccttcacagctgaacagcaaacagggcaacgggaaggaggcgaaacttgaatcggccgataagtccgaccaaaataacacagctgagggcaagaataaccagcaagtcccagaaaatactgaggagctgggacaaactaaacccacatccaaccctcaggtcgtaaatgaagggggagcaaaacctgagttggccagtcaagctaccgaaggctccaagagcaatgagaatgacttcagctag

SEQ ID NO: 60310 - DNA, 1524 bp, Artificial Sequence
  Description of Artificial Sequence: Synthetic coding sequence
atgtgtgacattgaggaggcgactaatcaacttcttgacgtgaatttgcacgagaatcaaaagtccgttcaggttacagaaagtgatctggggtctgagagcgagctgctcgttactataggagcaacggtgccgacaggcttcgagcaaaccgccgctgatgaagttcgtgaaaagcttggttcatcttgcaagatttctcgggaccgcggaaaaatctatttcgtcataagcgtcgagtcacttgcccaggtccactgtttgaggagtgtggataatctgttcgtggttgtgcaggaattccaggattaccagttcaagcagaccaaggaggaggtacttaaggatttcgaggacctcgctggcaagctcccctggagcaatcctttgaaggtgtggaaaattaatgccagttttaagaaaaaaaaagcaaagagaaagaagatcaaccagaacagttctaaggagaagataaataacgggcaagaagtaaagatagaccagcgcaacgtaaagaaagagttcaccagtcacgctctggactcacatatcctggattactacgagaaccccgctatcaaagaagatgtgtctacactaataggcgacgaccttgcctcctgcaaggatgaaacagacgagagcagtaaggaagagactgagccacaggtgctgaagtttagagtcacctgcaaccgagcaggggagaaacactgctttacctctaacgaagccgctagagacttcgggggagctgtgcaagactatttcaagtggaaggccgacatgaccaactttgacgtggaagtgcttcttaacatccacgacaatgaggtcattgtcggcatcgctctgacagaagaatcattacaccgcaggaatattacccactttggtcctacaaccctgaggagcacactggcatatggtatgttgaggttatgcgacccgttgccgtacgacatcatcgtcgatccgatgtgcggcaccggagctatcccaattgaaggggctacagaatggagcgattgcttccacatcgcaggcgataacaacccgctggccgtcaatcgcgctgcgaacaacattgcttccttactcacaaagtcccagattaaagaaggcaagccaagctggggtttaccaattgacgcagttcagtgggatatttgtaacctgccgctgcggacggggtcagttgacattatcgtgacagacctgcccttcggtaaacgcatgggttccaagaagaggaactggaacctgtaccccgcttgtctgcgtgaaatgtcacgagtgtgtaccccgacaacaggcagagcagtccttcttacacaggacaccaaatgttttacaaaggctctgtcaggaatgcgacacgtgtggcgaaaggtcgacacagtgtgggtcaatgtcgggggattgcgggcagctgtttatgtacttatacgcacaccacaggccttcgttcacccaagtgagcaggatggcgaacggggaaccctttggcaatgtaaagagtag

SEQ ID NO: 60311 - DNA, 126 bp, Artificial Sequence
  Description of Artificial Sequence: Synthetic coding sequence
atgtgcgatatcgaggaagccaccaatcagctgcttgacgtaaatttgcacgaaaatcaaaagagtgtgcaggtgactgagtcagacctgggctcagaatcagagctgctcgtcacaatcggatag

SEQ ID NO: 60312 - DNA, 372 bp, Artificial Sequence
  Description of Artificial Sequence: Synthetic coding sequence
atgtgcgacatagaggaagctacaaaccaactgcttgatgtgaatttacatgagaaccaaaagagcgttcaggtgaccgaatccgatctagggtctgaatctgagttactggtcacaatcggggctaccgtaccaacagggtttgagcagaccgctgccgatgaggtccgggaaaagctagggtccagctgtaaaatttcgcgcgataggggcaagatttattttgtcatttcagtagagtcactcgctcaggtgcactgtttgaggtctgtggataacctgttcgtggtagtccaggaattccaggattatcagttcaagcagaccaaagaagaagtactgaaggactttgaggacttagccggtaaatag

SEQ ID NO: 60313 - DNA, 1524 bp, Artificial Sequence
  Description of Artificial Sequence: Synthetic coding sequence
atgtgcgatattgaggaggcaactaatcagttgctggacgtaaacctgcacgagaatcagaaatccgtccaagtgactgaaagcgatctaggaagcgagagcgaactcctagtcactatcggtgcgactgtgcccaccggttttgaacagactgctgcagacgaagtgcgagagaagctgggatcttcctgcaaaataagtcgggataggggaaaaatctatttcgttatcagcgtggaaagtctcgctcaagtccactgtttacgttccgttgacaacctgttcgtcgtggtgcaggaatttcaggattatcagttcaaacagaccaaggaggaagtcttgaaagattttgaggacctagctggtaagctaccctggtctaaccctttaaaggtttggaagataaacgcgtcattcaagaagaagaaggctaaacgcaagaagattaaccagaactcttcaaaagaaaagatcaataacggtcaggaagtgaaaattgaccagcggaacgtaaagaaggagttcaccagccacgcactggatagccacattctcgactactacgagaatcctgctattaaggaggacgtctccaccttaatcggggatgacctggctagttgtaaagatgagacagacgaaagttccaaagaagagaccgaacctcaagttctgaaattccgagttacatgtaaccgcgctggggaaaaacattgcttcacgtctaatgaggccgcaagggacttcggcggagccgtccaggactatttcaaatggaaggccgacatgacaaatttcgatgtcgaagtgctcctgaacatccacgacaacgaggttattgtgggtattgctctcactgaggagtcgcttcacagaaggaatataacgcactttggtccaaccaccttgaggagtaccctggcatacggcatgttacgactgtgtgaccccctgccctatgacattatcgtggatcctatgtgcggtaccggcgctattcctattgaaggtgcaaccgagtggtccgactgttttcacatagcaggggataataatcccctggccgtcaatagagcagctaataatatagcctctctactcaccaagtcacagattaaggaaggtaagccatcctgggggcttccaatcgacgcggttcagtgggacatctgcaacctgccgctccgaacaggctcagtggacatcatcgtgacagatctgccctttggcaagcggatgggcagcaaaaagaggaactggaatctgtatccggcttgtctccgagagatgtctagggtgtgcacacctacaaccggcagagcagtattgctcacccaggataccaagtgtttcacgaaggctctgtcaggtatgagacacgtatggcggaaggtggatactgtgtgggtcaacgtgggaggtcttcgggctgccgtctacgtgttaattcggactccacaggcctttgtgcatccatccgagcaagacggcgaacggggtactctgtggcagtgcaaagagtag

SEQ ID NO: 60314 - DNA, 1524 bp, Artificial Sequence
  Description of Artificial Sequence: Synthetic coding sequence
atgtgcgacattgaggaagcgactaatcagttacttgacgtgaatctgcacgagaaccagaagagcgtccaggtgaccgagagtgatctcggctctgagagtgagctactggtaactatcggcgcaaccgtgcccaccggctttgagcagaccgcagccgacgaagtgagggaaaagctaggaagtagttgtaaaatctctcgggatcgcggaaagatctactttgtgattagcgtcgaatctctcgctcaggttcattgtcttcgatccgtagataacttattcgtagtggtgcaggaattccaggattaccagtttaaacaaacaaaggaagaagtgctgaaggattttgaggatttagcgggtaaactcccgtggtctaaccccttaaaggtgtggaagatcaatgccagcttcaagaaaaaaaaagcaaaacggaaaaaaattaaccagaactcatctaaagaaaaaataaacaacggtcaggaagtgaagatcgatcaacggaacgtgaaaaaggagttcactagtcacgctctcgacagccacatcctcgactattatgagaacccagcgataaaagaggatgtgtcaaccctgataggagatgaccttgctagctgcaaggacgaaacagatgagagcagcaaggaggaaaccgagccacaggttctgaagttccgcgttacctgcaatcgcgctggagaaaagcattgctttacaagtaacgaggctgcacgagattttggaggcgctgtgcaagactactttaagtggaaggcggatatgacaaattttgatgtggaagtgctgctcaatattcacgacaatgaggtaatcgttgggatcgccctgaccgaagagagtctgcacagaagaaacattacccacttcggccctacaacactcaggtccaccctggcctacggcatgctgagactgtgtgaccctctgccttatgacataatcgttgacccgatgtgtgggacgggtgcgattcccatagagggcgctacagaatggtctgactgcttccacatcgccggtgataataatcccctggctgtgaatcgggctgccaacaacatcgccagcctcctgactaaatctcagatcaaggagggcaagcccagttggggactgcctatcgatgctgttcagtgggatatctgcaacttacctctacgtaccggatctgtggacataatagttactgatctccccttcggtaaaaggatggggagcaagaagagaaactggaatctttatcccgcatgtcttagggagatgtcacgcgtgtgtacacccacaactgggagggctgtccttcttacccaggacacaaaatgctttaccaaagctttgagcgggatgcgacatgtgtggcgaaaggttgacaccgtgtgggttaacgtcggcggattgcgggctgcagtgtatgtcctgataaggacgccacaggccttcgtgcatccctccgaacaggacggagagcgcggaactctgtggcagtgtaaagaatag

SEQ ID NO: 60315 - DNA, 1566 bp, Artificial Sequence
  Description of Artificial Sequence: Synthetic coding sequence
atggaggcctcggtgctgtccccaaccagttgggaaaaaagaagggcatggctgagacagtcgaggaattggcagacacaagtgttggaagaggaggcggctgcagcactgcaggatgttcctgacccggagcccagcagcttagacgacgtttttcaagaggggaacccaatcaataaaattgaagattggctgcaagattgtggctactccgaggaaggattctccgaggaagcaggccagtttatctacaatggtttttgtagccacggtacctcatttgaggacgacctgacactgggcgctgaggctacgctactggccgcaaacgggaagctttttagcagatctttcctagaaactgccaggccttgtcagctgctggatcttggatgctcactggcatcgtccagcatgacaggaggcactaataaaacatccagcagcattagcgaaatcctcgacaaagtgcaagaggacgccgaggacgtactgttttccctgggcttcgggcaggaggaccataaggataccagccgtattcctgccagatttttcacaactcccagtcaggctaaggggatagacttccagctgttcctgaagagccaggtgaggagaatcgagatggaagacccttgtctgatgctggccagcaggtttaagcaagtgcagacccttgccgtgactgccgacgcattcttctgcctgtactcatatgtctctaagacccccgtccagaaattcactcctagccatatgttctggaactgcaatcaccccaccgatgtcccgtcaatcagaattctcagtcgagagcctgaacctcagagcccacgtgacaggctccgcaaagctatatcgaagatgtgcctgtacacttgtcctagagaccgcccaccaccccctcacaacactcctaaacggaattccctggatcaggtcgtgttagaagtgatggataaggtgaaagaagaaaagcaattcctgcaacaggattctgacctgggtcagttttctcaggaggatcccgttccacctgcagaaggcaagaaattgccaacgtccccctacccgtgtgtgttctgttgcgaagaggagactcaacagcggatgtctacagtcctcgccccaagccaaacccttgatagtaatccaaaggtgccatgctgtacccattccctgcccattgaggacccacagtggtctaccgatcctgcccagattagacgggagctgtgctccttgcccgctacaaacactgaaacccaccccgctaaagacgagacattttggaagagaaagtctcgggctcgcaagagtctttttcagaagaatctgatgggaaggaaggtgaagtccctggatctctctattactcaacaaaagtggaaacagtccgtcgatagaccagagctgcgaaggagcctgtctcaacagccacaggataccttcgacctggaagaggtgcagtccaacagtgaagaggaacaaagccagagccgttggccctctagaccacgacacccacatcatcatcaaacgttcgcaggaaaggatagctag

SEQ ID NO: 60316 - DNA, 1152 bp, Artificial Sequence
  Description of Artificial Sequence: Synthetic coding sequence
atgactggaggaactaataagactagctcatcaatatcagagattctcgacaaagtgcaggaagatgctgaggatgtcctcttttctctcggtttcggccaagaagaccataaggacacctcacgcatccctgccaggttctttactacccctagccaggccaaggggattgacttccagctgttcctgaaaagccaggtccggagaatcgagatggaggatccatgcctgatgctggcgagcagattcaagcaggtgcagacactagctgtcactgctgacgcctttttttgcttatattcctacgtcagtaagactccagtgcagaaattcacaccatcccacatgttctggaattgtaaccaccctactgatgtaccgtctattcgaatactcagccgcgaacctgaaccacagagccctcgtgacaggctgaggaaggcaattagtaagatgtgcctatacacctgccctcgtgaccgcccaccccctccccacaacacaccaaagcgtaactccttggaccaagttgtgctcgaggttatggacaaagtgaaagaagagaaacaattcttgcagcaggactctgatctaggccagttttctcaggaggatcctgtgccgccagcagaggggaagaagctccccacatctccctacccatgcgttttttgctgtgaagaggagactcagcagcgtatgtccacggtgctcgctccaagccagaccctggactcgaatcctaaagtgccatgttgtacacacagcctgcccatagaggacccccaatggtcaaccgaccctgcccaaatccgcagggagttatgctcgctaccagcaaccaacacagagacccatcctgccaaggacgagaccttttggaagcgcaaatctagagcaagaaaaagcctgttccagaagaacttgatgggcagaaaagtgaagtctctcgatttgtcaatcacacagcagaagtggaagcaatccgtggaccggccagaacttcgcaggtctctttctcaacagccgcaggacacgtttgatctggaagaagttcaatctaactccgaagaagagcaaagtcaatccagatggccatctagaccaagacatccacaccaccatcagacctttgccggaaaagattcatag

SEQ ID NO: 60317 - DNA, 249 bp, Artificial Sequence
  Description of Artificial Sequence: Synthetic coding sequence
atggaagcttccgttctgagccccaccagttgggagaagaggcgcgcatggctgcggcagagtaggaattggcaaactcaggtgctggaagaagaggccgctgcggcactacaggacgtacccgatccagaaccaagtagcttggatgacgttttccaagagggcaatcctataaataaaatcgaggattggctgcaggattgtggttactctgaggaaggattttccgaggaggcagggcagttctag

SEQ ID NO: 60318 - DNA, 147 bp, Artificial Sequence
  Description of Artificial Sequence: Synthetic coding sequence
atggaagcttcggtgctgtcccctacttcctgggagaaacggcgtgcctggttgaggcagagccggaattggcagacacaggtgctggaggaagaggccgctgctgccttgcaggacgtccccgaccctgagccctcgagtctctag

SEQ ID NO: 60319 - DNA, 138 bp, Artificial Sequence
  Description of Artificial Sequence: Synthetic coding sequence
atgtccgataaaccagatctgagtgaggtcgagaaattcgatcgctccaagctgaagaagaccaacactgaggaaaagaacacactgccgtctaaagagacaatccaacaagagaaggagtgtgtacagacaagctag

SEQ ID NO: 60320 - DNA, 588 bp, Artificial Sequence
  Description of Artificial Sequence: Synthetic coding sequence
atgcccaatttccttggcctccatcgagcacggtccttcactgtgctgtgcttctggagcacagctgacgtcttgaacgccagtggacccagacgacagtggcacccactcgctagttgctcgagttggagccgtcctcagagccaaggaagtaccccgggagttctgtgcaaaaccggcatgggaagggagcccatacctgaaacccagtgtcacttcgccaactctatgtgtagtctccacgtgtcagttccatatttcggcaatagtccgaacatctcaaatttcttcagatggagcttggcactttccccaagacagtggtgtgacctgggtagtctgcaaccaccatcccctagattcaagggatttagttgtttgagcctaccgagcagctgggattatcgcagggctccctccccagccaacttctgtattcttgtcgagatgggcttccaccacgttggccaggccgatctggagcttctgactagcgccgatctaccgacctccgcctcgcagtccgccggtataaccggggtgagccatcatgcgtggcctcagaccctcagtctcctgttatactag

SEQ ID NO: 60321 - DNA, 795 bp, Artificial Sequence
  Description of Artificial Sequence: Synthetic coding sequence
atggccccaactggactgctggtagctggcgcatccttcttagccttcaggggactgcactggggacttcgcaggttgcccacacccgagtccgccgctcgggaccgctggcagtggtggaacttgtgtgtttctctcgcccattctctcctgagtggcaccggggcactcttggggctgtctctgtacccacagatggcggcagaccccatccacgggcatcctaggtgggccttagtacttgtcgccgtatcagtaggttacttcctcgccgatggggcagacctcctctggaatcagaccctggggaaaacatgggatctactgtgtcatcatctcgtcgtggtttcttgtctgtccaccgctgttttgagcggccattacgtaggcttttcgatggtgagtctcctgctcgaacttaatagtgcttgcctccatttacgcaaactactgctgctgtccaggcaagctccttctttagcattctcagtgacctcatgggcctctctggccacgttggccctatttcgtttggtcccgctcggctggatgtctctgtggctgtttagacagcatcaccaggtacctttagctctagtgaccctagggggaatcggactggtcacagtgggcataatgtccatcattctggggattcgtatactagtcaacgacgttctgcagagccgtcctcacccccctagccccggacatgaaaagacacggggtaccaggacacgtcgtgacaacgggcctgtcacttccaactcctccaccctctcactaaaggattag

SEQ ID NO: 60322 - DNA, 3561 bp, Artificial Sequence
  Description of Artificial Sequence: Synthetic coding sequence
tgatgcgccgcaccagctcccctcacgagtgcggaacgcgagctgcagcagataaggatcaatgaggtgaagacggagattagtgtggagtctaagcatcagactctacagggactggctttcccactgcagccggaggcccagagggccttgcagcaactgaaacagaagatggtgaattacatccagatgaaacttgatttggaaagagagactatcgaactggtgcacaccgaacccacagacgttgctcagctcccaagtcgggtaccaagagacgccgctagataccacttctttctctataaacacacacatgaaggagaccctttggagtcagttgtttttatttacagtatgccagggtacaaatgctccattaaagaacgcatgctttattcttcctgcaagtcccgccttctggactcagtcgaacaggactttcacttggagattgctaaaaagggcttctgtagaagtgccctgcatccattaagcctgctggtccaggccatcatgcttgctatgacactggcactggggaccctcccagctttcttaccttgcgagcttcagccccatggactggtaaactgcaattggttgttcctgaaaagtgtccctcacttctctatggcagcacccagaggcaatgtgacaagcttgtcccttagcagtaaccgtattcatcatttgcatgattccgatttcgcccatttgccctctctgaggcatctcaacttaaagtggaattgtcctcccgtaggcctgagtcctatgcatttcccatgccatatgacgattgagccaagtacctttctagcagttcccaccttggaagagctcaacctgtcttacaacaacattatgacggtacctgctttgccaaaaagtctcattagtttgagcctgtctcacactaacatcttgatgttagattcagcttctctcgccggtctgcacgccttgcgattcctctttatggatggcaactgctattacaaaaatccttgtcggcaggccctggaggtagctcctggtgctttgctgggacttgggaacctgacccacctctcgctgaaatataataatctcacagttgttccccgaaatctccccagctctctggagtatctcctcttgagctacaataggattgtgaaacttgccccagaggacctggccaacctgactgccctccgcgtgctggacgtggggggaaactgcaggcggtgcgaccatgccccaaatccgtgtatggagtgtcccagacactttccacaattgcatccagatactttcagccatctctccagactcgagggactggtgctgaaagattcaagtctgtcgtggctgaatgcatcctggttccggggtctaggcaacctgagagtgctggatctctcggagaattttctctataaatgtatcacaaagacgaaggcctttcagggccttacccagttacgaaagcttaacctgtcctttaattaccagaagcgagtctcctttgcgcatctgagcctggccccatcctttgggtccctcgtagctcttaaggagctggatatgcacggtatatttttcagatctctggatgaaactacgctccgccctctggctcgcctcccaatgctccagacactgagactccaaatgaatttcatcaaccaggcgcagcttggaattttcagggcgttccccggactgagatatgttgacctgtcagacaataggatttctggcgcaagtgaactgactgcaaccatgggcgaagctgacggcggtgagaaggtgtggctccagcccggagacctcgcaccagcccctgttgataccccgtcatcagaagactttcgaccaaattgttccacactgaactttaccctggatctatccaggaataatctggtcacggtacaacctgagatgtttgcccagctgtcacaccttcaatgcctcaggctctcgcacaactgcattagccaagccgttaatggctctcagtttctgcccttaaccggcttgcaggtgctcgatctttctcacaataaactggatctataccacgagcatagcttcacagagctgccgaggctagaagccctggatttgagctacaattcgcagccatttggcatgcagggggtaggacataacttctcctttgtcgcacatctgcggaccctaagacacttgagtctggcacacaacaacatccacagccaagtgtcacagcagctgtgctctaccagtttaagagctctggatttcagtgggaacgccttggggcatatgtgggcagaaggcgatctgtatctgcacttcttccagggcctctcaggcctgatctggcttgacctgtctcagaatcggcttcatacactgttgccccagaccctgcgcaatcttcccaagtctcttcaagtgctgcgactacgtgacaattacttggccttcttcaaatggtggtcactgcacttcctgccgaagctggaagtcctagatctggctggtaaccagcttaaggctcttactaacgggtccctgcctgccggtacaaggctccgcagactggatgtatcttgtaatagcatcagtttcgtggccccaggtttctttagtaaggcgaaggaactcagggaactgaacctgtctgccaatgcccttaaaacagtggaccatagctggttcggaccgctcgcctcagcccttcagatacttgacgtgtctgccaacccgcttcactgtgcatgcggcgctgctttcatggacttcttacttgaggtccaggctgcggtgcccggattgcccagtagagtaaagtgtgggagtccgggtcagctgcagggattgtctatttttgcccaagacttacgtctgtgcctcgatgaagcgctgtcttgggattgtttcgccctgagccttctggcagtggccttaggcctaggcgtcccaatgctacaccacctatgcggatgggacctgtggtactgcttccacctatgtctcgcttggttgccttggcgaggcaggcagtcgggcagagacgaagatgcccttccatacgatgctttcgtggtgttcgataaaacccagagtgcggtcgcagactgggtgtataatgaacttcggggacagcttgaagaatgccgaggccgatgggccttgcggctgtgcctagaggagagagattggctgcccggtaaaacgttatttgaaaacttatgggcgagcgtgtacggctccaggaagaccttgtttgtgttggctcacacagacagggtctccggcttattgagggcatcttttctcctggcccagcagaggctgctcgaggatcgaaaggacgtagtcgtgcttgttattctgtccccagacgggaggcgatcccgatacgtgagattgcgtcagcggctttgccgccaaagcgtcctgctatggccacaccagccctccgggcagcgctctttctgggcccagctaggtatggctttgacgagagataaccatcacttttacaatcgcaacttctgtcagggacctacagccgaatag

SEQ ID NO: 60323 - DNA, 1113 bp, Artificial Sequence
  Description of Artificial Sequence: Synthetic coding sequence
atggcgggagctgaaaattggccgggtcagcaactcgagctcgacgaggatgaagcctcctgctgtcggtggggggctcagcacgcgggagcccgtgagctggccgctctctactctccgggaaaaagactgcaagagtggtgctccgtgatcctgtgcttcagtctgatcgcacacaacctggttcacctgcttctgctagcccgatgggaggatactccactcgtgatccttggggtcgtcgcaggcgcattgatcgcggatttcctcagcggtttagttcactggggagccgacacctggggctctgttgagcttcctatcgtcgggaaagctttcattaggcctttcagagagcaccacatcgatcctaccgccataactcgacacgatttcatcgagaccaacggagacaattgtcttgtcacactgctgccgctgctgaatatggcgtataagtttagaacccactcccccgaggccctcgaacagctctacccctgggagtgctttgtcttttgcctcatcatttttggaacctttaccaaccagatccacaagtggagccatacatacttcggccttccgcgatgggttaccctgctgcaggactggcacgtgatattacctagaaaacatcatcgcatccatcacgtgtctccccatgaaacatacttttgcatcaccacaggtgtgaaggtccctagaaactttcgcctgctggaagagctagaggagggtcagaagggcgtgggagacggcaccgtgtcttgggggttggaggacgatgaagacatgaccttgacaagatggacaggcatgatcatcggccctcccagaacaatatatgagaacaggatctacagcttaaaaatcgaatgcggtccgaagtatcccgaggctcctcccttcgtcaggttcgtcaccaaaatcaatatgaacggggtgaattcgagtaatggggtggtcgatcccagagcaatcagcgtgctagccaaatggcaaaatagctacagcatcaaggtagtcctccaggagttacgtcggctaatgatgtctaaggagaacatgaaattgccccagcccccagaggggcagtgctactccaactag

SEQ ID NO: 60324 - DNA, 978 bp, Artificial Sequence
  Description of Artificial Sequence: Synthetic coding sequence
atggcccacttcgtccagggaacctccaggatgatcgcagccgagagctctacagaacataaagaatgtgctgagccttccacccgcaagaacttgatgaactctttggaacagaagattcgttgtctggagaaacagcgaaaagagttgctcgaagtaaatcagcagtgggatcagcagttccggtcgatgaaggagctgtacgagaggaaagttgctgaattaaagaccaagctcgatgccgcagagcgatttctaagtacacgagaaaaggaccctcatcaaaggcaacgcaaggatgaccgccagagagaagatgatcgccagagagatctaacccgagatcgattgcagcgggaggagaaagagaaagaaaggctcaacgaagaactgcatgagctgaaagaggaaaataaacttttgaaaggcaagaacacacttgcaaacaaggagaaagagcactatgaatgtgaaattaaacggctgaataaggccctccaagatgcccttaacattaaatgtagttttagtgaggattgcttgagaaaatcaagggtggaattctgccatgaggagatgagaacagaaatggaggtgctaaagcagcaggtgcagatctacgaagaagattttaagaaagagaggtctgacagggagaggttgaatcaggagaaggaggaactccagcagattaatgagactagtcagtctcagcttaatagactaaatagtcaaatcaaggcctgtcagatggagaaagaaaaactcgagaaacaactcaaacagatgtattgcccgccttgcaactgcggcttggtgttccatctgcaggacccctgggtgcccactgggccaggagctgtgcagaaacagagagagcatcctcctgactaccaatggtacgctctggaccagttgcctccagacgtgcagcacaaagccaacggactctctagcgtgaaaaaagtccatccttag

SEQ ID NO: 60325 - DNA, 978 bp, Artificial Sequence
  Description of Artificial Sequence: Synthetic coding sequence
atggctcactttgtgcaagggaccagtaggatgatcgctgcagagagctcaactgaacataaggaatgtgcagaaccttccacaagaaagaacctgatgaacagcttggagcaaaaaatcagatgtctcgaaaagcaaaggaaggagcttctggaggtgaatcagcaatgggaccagcagtttcggagcatgaaggaactgtacgagcgcaaggtggccgaactcaagactaagttagacgcggctgagcggttcctgtcaacacgagagaaagacccgcatcagaggcagcgcaaagacgacaggcagcgtgaggacgatcgacagagagacctcacaagggaccgactccagcgcgaagaaaaagaaaaggaacgattgaacgaggaactgcacgaactgaaggaagaaaacaagctcctaaagggaaagaacacgcttgctaataaagagaaggagcactatgaatgtgaaattaagcggctgaataaagccctccaggatgctctcaatatcaaatgtagcttttcagaggattgcttgcggaaaagtcgcgtcgaattctgccatgaggaaatgcggacagagatggaagtactgaagcagcaggtgcagatctacgaagaagacttcaagaaggagagatccgaccgtgaaaggcttaaccaggaaaaagaggaactccaacaaataaatgagaccagccagtcccagttgaacagactaaattctcaaatcaaagcgtgccagatggagaaagagaaactggagaagcagcttaaacagatgtactgtccaccgtgtaattgcggccttgttttccatctgcaggacccatgggtccctacgggaccaggtgccgtacagaagcagcgagaacatccgcctgactaccaatggtatgccctggatcagctgcccccagatgtgcagcataaagccaacgggctgtcaagcgtgaagaaggtccatccctag

SEQ ID NO: 60326 - DNA, 1110 bp, Artificial Sequence
  Description of Artificial Sequence: Synthetic coding sequence
atgaacaagaacgagaagcatgacgacaaactcgtaatgttcacaaatcaatcggaagacagcgagcgatgtgagtccatggagctcgataaaaagatccaggaccttatcgaacgaaacgccagtcctcaccccaaacgctttacgccagaagccatgccaacacatcggaacctttgcagcttgaaaacacctggcaaaacagcgtctatggcacacttcgtccagggcactagcagaatgattgcagccgagtcctcaaccgagcacaaagaatgcgccgaaccatcaactaggaagaatctcatgaactcattagagcaaaaaatcagatgtttggagaagcagcgcaaagagctccttgaagtgaaccagcagtgggaccaacagtttcgctctatgaaggagttgtacgagagaaaagtcgccgagctgaagacaaagctggacgccgctgagagattcctttccacaagggaaaaggaccctcatcagcgccagcggaaggacgaccggcagagagaggacgatcggcagagagacttaacaagagatagactgcaacgcgaggagaaggagaaagagcggcttaatgaggaattacacgagctgaaggaggagaacaagctcctgaagggtaagaacacgttggccaacaaggagaaggagcattatgagtgtgaaatcaagaggctgaataaagcactgcaagacgcactgaatatcaagtgctctttctcggaagattgtctgcgcaaaagcagggtcgaattctgccacgaggagatgcgcacagagatggaggtcctcaaacagcaggttcagatctacgaagaggacttcaagaaggaaagaagcgaccgcgagaggttgaatcaagagaaagaggagctgcaacagataaacgagacatcacaaagtcagcttaaccgcttaaatagtcaaatcaaggcctgccagatggaaaaagagaagctagagaaacaactgaaacagatgtactgtcctccatgtaactgcggcctggtttttcatctccaggatccttgggtcccaaccggtcccggagccgtccagaagcagcgggagcacccagtgtatccccagtag

SEQ ID NO: 60327 - DNA, 1029 bp, Artificial Sequence
  Description of Artificial Sequence: Synthetic coding sequence
atgtcggaggagtcagattctctgaggacaagcccctccgtcgcctcattaagcgagaacgaactgcccccaccacctgagccaccgggatacgtgtgctccctgacggaggacctcgtgacgaaagccagagaggaactccaggagaaaccggaatggagactgcgcgatgtccaggcactgcgcgatatggttaggaaagagtatccaaacctttcgacatcattggatgatgcgtttctgctgcgcttccttcgcgctcgcaagtttgattatgacagggcactgcagctgctcgtgaattaccactcttgcaggaggagctggcctgaggtttttaacaatctgaaaccctctgctctcaaggacgtgctggcgtcagggtttctgactgtgctgccacacacagacccccgagggtgtcacgtcgtgtgcattcgcccagatcgatggattcctagtaattatcccataacggagaatattagagcgatctacctgaccctcgaaaaattgatacaatccgaggagacccaagtcaacggaatagtcatcctggctgattacaaaggtgtttcccttagtaaggccagccacttcggtcctttcatcgcaaaaaaggtgatcggaatcctacaggatggttttccaatccggataaaagctgtccacgttgtaaatgagccacggatcttcaagggcatcttcgctatcatcaaaccctttctcaaagaaaagatcgctaaccgcttctttcttcatgggagcgacctaaacagtctccacacaaacctacctcgcagcatccttcccaaagagtacggcggtacggccggagaattagatactgcaacatggaatgctgtgctactggcatccgaggatgactttgtgaaagagttctgccaacctgtgcccgcttgcgactccatccttggccagactctgctgcctgaagggttgacctcagacgcccagtgcgatgattccttgcgggctgtgaaaagccaactgtattcctgctattag

SEQ ID NO: 60328 - DNA, 1029 bp, Artificial Sequence
  Description of Artificial Sequence: Synthetic coding sequence
atgtctgaggaaagtgactcactgcggacttccccttcggtggcctccctgagtgagaacgagcttccacctcctcccgaaccacccggatacgtgtgcagcttaacagaggatttggtgacaaaggcaagagaagagctgcaggaaaaacccgagtggcgcctgagggatgtgcaagctctgcgtgatatggtgaggaaggagtatcctaaccttagcacttccctcgacgacgccttccttctcaggttcctgcgagctcgtaagtttgactatgatagagcactccaactattggtgaattatcactcctgcagacgtagctggcccgaagtgttcaataacctcaaaccatcagctctcaaggacgtcctggcatctggcttcctcacggtgttacctcatacagacccacgcggatgccacgtcgtgtgtatccggccagaccgctggattcctagcaactatcctattactgagaacatccgcgctatttacctcactctcgagaagctgatacagagcgaagaaacccaggtgaacggtatcgtgatactggccgattacaagggagtatcactgtcaaaggcatcccacttcggccctttcattgccaaaaaagtaattggcatcctgcaagatgggtttccaattcgcatcaaagcagttcacgtggtgaacgaacctcgaatttttaaaggaatttttgcaatcatcaaacccttcctgaaagagaaaatcgctaatcggtttttcctgcatgggtctgacctgaactctcttcacacaaacttgcccaggagcattttgccaaaggagtacggcggaaccgccggtgagctggatactgctacttggaacgccgtgctcctcgcgagcgaggatgacttcgtgaaggagttttgccagcccgttccggcttgtgacagcatcttagggcaaacattgctgcccgagggcctgacttccgacgcccaatgtgacgactctctgagggctgtgaagtcccaactctactcctgctattag

SEQ ID NO: 60329 - DNA, 840 bp, Artificial Sequence
  Description of Artificial Sequence: Synthetic coding sequence
atgtcggaagaaagtgactcactccggacatctcccagtgtcgcaagtctctcagaaaacgagctgcccccaccgcctgagcccccaggctacgtgtgctccctgaccgaggacttggttacaaaggcccgagaagagttgcaggaaaagcccgaatggagactccgggacgtccaggccttgcgggacatggttaggaaggagtacccgaacctgtccacgagcctggatgatgcctttctcctgaggtttttacgggcacgtaagtttgattatgaccgggcactccaacttcttgtgaattatcattcatgcagaaggagctggcctgaagttttcaataatcttaaaccgtctgcattaaaggacgtcctggcttccggctttctgaccgtgctgccccatacggaccctcgtggctgccatgttgtctgtataagacccgatcgatggatccctagtaactacccaatcactgaaaacatcagagccatctatttgacattggagaagttgattcaatctgaagagacccaggatggattcccaatacggatcaaagccgtccatgtggtcaatgagcctagaatcttcaagggaattttcgcaatcataaaacctttcctgaaggaaaaaatcgcgaatcgcttctttttgcacggctctgatctgaacagcttacatacaaatctgcctcgctccatcctgcctaaagagtatggtgggaccgctggagagctcgacactgctacatggaacgcggtcctcttagcctctgaagacgactttgtcaaagagttttgccagcctgtgcctgcttgtgactccattctgggatag

SEQ ID NO: 60330 - DNA, 309 bp, Artificial Sequence
  Description of Artificial Sequence: Synthetic coding sequence
atgcgcgcttccccgtgcatatctcagcccgcagccagttggcaccccaggccaagcgccctgaggcctacggcgggttccggccctgataccaggaccccgggtacggttgaagatggtagcgccccttgtccagcttttaggagtcctgcagtgagtccgtgtggggaggaaccctgttgctttcagatttcaccagcagaggagaccttggagctcggcagattggtgagccccggatgtcacaagtcgagtgccccacaggagcggagactggatcccagagctaggtgtgtggttcacatttag

SEQ ID NO: 60331 - DNA, 375 bp, Artificial Sequence
  Description of Artificial Sequence: Synthetic coding sequence
atgagggccagcccatgcatttcccaaccggctgcgagttggcaccctagaccttcagctctgcggccaactgcagggtccggacccgatacacgcacaccaggcactgtagaggatgggtcagccccatgcccagcatttcgcagtccggctgtttctccatgtggagaggaaccatgttgtttccagatttccccagccgaggagaccttggaactcgggagattggttagtcccggaaactgcgataccctttcgcccagggccgcaggtttctatgcctgccacgtcaggagcctgatcccttgcaggagcaccaagggccgttggccattgacggcttctgccgctgggctgtcttcttttagcggctag

SEQ ID NO: 60332 - DNA, 1131 bp, Artificial Sequence
  Description of Artificial Sequence: Synthetic coding sequence
atggacggggaagaacagcagccccctcatgaggctaacgtcgagccagtagtgccaagcgaggctagtgagcccgtgcctcgggtgctatcaggagatcctcaaaatttgagtgatgttgacgcattcaacctactgctggaaatgaagttgaagaggcggaggcagcggccaaacctgccgagaactgtgacccagctagttgccgaggatgggagccgagtgtacgtagttggaacagctcacttttctgatgacagcaaacgcgacgtggttaagaccattcgcgaggtacaacctgatgtagtagtggtggaactgtgtcagtacagagtttcaatgctaaaaatggacgagagtaccttacttagggaggcccaggaactgtctcttgagaaactgcagcaagccgtgcggcagaatggccttatgagcgggctcatgcagatgctcctactaaaagtgtccgctcatattactgagcaactcgggatggcccctggcggtgagtttcgcgaggcctttaaagaagcctccaaggtgcctttctgcaagttccacctcggggatcggcctattccagtcacatttaagcgggctatcgccgctttgagcttttggcagaaagtgcggcttgcgtggggactgtgtttcctaagcgaccccatctccaaggacgacgttgagagatgtaagcagaaagacctcctggaacagatgatggctgagatgatcggtgagtttccggacctgcatcggacaattgttagcgagagggatgtctacttgacgtatatgctcagacaggctgcgaggagactagaactgcccagagcgagtgatgcagaaccacgcaagtgcgtcccttcagtcgtggtcggcgtcgtagggatgggccacgtacccggaatcgaaaagaactggtctaccgacttaaatatccaggaaattatgaccgtccctcctcccagtgtgagtggcagagtgagtcggctggccgtcaaggcggcttttttcggactgcttgggtacagtctgtactggatgggacgccgaactgcttcactggtcctatctctgccagcggcacagtactgcctgcagagggtcaccgaggctcgacataagtag

SEQ ID NO: 60333 - DNA, 1131 bp, Artificial Sequence
  Description of Artificial Sequence: Synthetic coding sequence
atggacggcgaagaacagcagcctccccacgaagcaaacgtggaacctgtggtgccttctgaggcctccgaacctgtgcctagggtgctgtcgggggatccccagaacttgagtgacgtggacgcttttaacctgctgttagaaatgaagctgaagcgcagaaggcagcgccctaatttgcccagaactgtgacgcagttagtagcggaagacggctcgagagtttatgtcgtaggcacagcgcatttctcagacgacagtaagcgtgacgttgtcaaaacgatacgagaagtacaacctgacgtcgttgtcgtggagctgtgtcagtatcgtgtcagcatgctaaagatggacgagtctactctactgcgggaagcacaagagctctcactggagaagctacagcaggccgttcggcagaacggcctgatgagcggactaatgcagatgttattgctgaaggtgagcgcccacatcacggaacagctcgggatggccccagggggagagttccgggaggcatttaaggaggcttcaaaagtccccttttgtaagtttcacctgggcgatcggcctattccagtgactttcaagagggctatcgctgccttgtccttctggcagaaggtaaggttggcatgggggctgtgtttcctctccgatcccatttccaaagatgacgttgagcgctgcaagcagaaagacctgctggagcagatgatggcagagatgatcggcgagttccccgatcttcacaggactatcgtgtcggaacgggatgtctatctaacttacatgctgcgacaagctgcacgacgccttgagctgccgagggcctctgatgctgagcctagaaagtgtgtcccttccgtggtcgtgggcgtggtaggtatgggccatgtgccgggaatcgagaagaactggtccacagatttaaatatccaagagatcatgacagtccctcctccgtccgtttccggcagggtatcacggctggctgtcaaggccgcatttttcggtctgcttggatatagcctgtattggatgggcagacggacagccagcttggtactgagcctgcctgcggctcagtactgccttcagagagtgacagaggcacgccacaagtag

SEQ ID NO: 60334 - DNA, 1131 bp, Artificial Sequence
  Description of Artificial Sequence: Synthetic coding sequence
atggatggcgaagagcagcagcctccccacgaggccaacgtagaacccgtggtgccctctgaagcttcagaacctgtccccagagttctctccggcgatccacagaacttgtcggacgttgacgcatttaacctgttgttagaaatgaagttgaagaggcgacggcagcgtccaaacctgccgaggaccgttacacagctggtagcagaagacggttctcgcgtctatgtcgtgggaacagcccacttctctgacgatagcaaaagagacgtggtaaagacaatacgtgaagtgcagcccgacgtggtagtggtggagttgtgtcagtaccgagtgagcatgttgaaaatggatgagagcactctcctgagagaggctcaggaactgagcctagaaaagctgcaacaggcagtccgccagaacggtttgatgtcaggtctgatgcaaatgctcctgcttaaggtgagcgcccatatcacagagcagctgggcatggctccaggcggagaatttagggaggctttcaaagaggcttccaaagtgcctttttgcaagtttcatttaggcgaccgccctattccagtgacatttaagagggcgatcgctgctctgtccttttggcagaaagtaaggctggcctggggcctgtgctttctcagcgaccccatctctaaagacgatgttgagaggtgtaaacagaaggacttactggaacagatgatggctgagatgatcggagagtttcctgatctgcaccgaaccatcgtgagtgagagagacgtctacttaacctacatgctgcgacaggcagccagaagactcgagcttcctcgggcttctgacgccgaaccgagaaaatgtgtgcccagcgtggtcgtaggcgttgtaggaatgggtcacgttcccggtatcgaaaaaaactggtccacagatcttaacatccaggagattatgaccgtgcccccacccagcgtatcaggtcgcgtaagtcgtctagcggttaaggccgcatttttcggcctgttaggttacagtctgtactggatggggaggcgaaccgcgagcctggtcttgagccttcccgctgcccagtactgcttgcaacgtgtaaccgaggccaggcataaatag

SEQ ID NO: 60335 - DNA, 1554 bp, Artificial Sequence
  Description of Artificial Sequence: Synthetic coding sequence
atgcatgccgctctggcaggtcccctgttggcagcattgttggctaccgcacgagcgaggccccaacctcctgatgggggacagtgtcgaccccctggatcgcagagggaccttaactcatttctttggaccatccgaagggacccccctgcctatttgttcggcacaattcatgtgccttataccagagtttgggacttcatcccagacaattcgaaggcggcattccaggcatctaccagagtgtactttgaacttgatctgacagatccctacaccatctcggcccttgcctcctgccagctgttgcctcacggcgaaaatctgcaagacgtgctgcctcacgagctgtactggcgcctcaaacggcacctggactatgtcaagttaatgatgccaagttggatgacccctgcccagagggggaagggcctgtacgctgattacctgttcaacgcaatcgcaggcaactgggaacgcaagcgcccagtatgggtaatgttgatggtgaattctctcaccgagcgggacgtcaggttcaggggcgtgcccgtgctggacctttacctggctcaacaggcagaaaaaatgaaaaaaacgactggggctgttgaacaggtagaggaacagtgccatcctctgaataatggcctcaattttagccaagtgctgtttgcactcaaccagacactgctgcagcaggaatcggtgcgcgcaggttctctccaggcatcctacaccacagaagacctcatcaaacattacaactgcggggacctgtctgctgttatcttcaatcacgacacaagccaattgccaaacttcattaatacaaccctcccccctcacgaacaggtgaccgcccaggaaatagactcctatttccgccaggagctcatttataagcgtaacgagaggatgggcaagagggttatggctttgttaagagaaaacgaggataagatatgtttcttcgccttcggcgcaggccactttctaggcaacaacaccgttattgatatcctgcgccaggcgggattagaagtagaccacacacctgcgggtcaagcaatacactccccggctccccagtcccccgcaccaagtccggagggcacttcaaccagccccgcacccgtgacacctgcagcggcagtcccagaggccccaagtgtgactccaaccgctcccccagaagacgaggaccctgccctttccccacacctgctccttcccgacagcctgagccaattggaagaatttggccgacaacggaaatggcacaagcgccagtccacgcaccagagacccagacagtttaacgacttgtgggttcgcatcgaggatagcaccaccgcaagtcctccaccgctgcccttgcagcccacacattcttctggcacagccaagccccctttccagctgtccgaccaactgcagcagcaagaccccccaggccctgcatccagcagcgctcccacgttagggcttttacctgctatcgccaccacaatcgcggtctgtttcttactccattcccttggaccatcctag

SEQ ID NO: 60336 - DNA, 555 bp, Artificial Sequence
  Description of Artificial Sequence: Synthetic coding sequence
atgacatcatttgaagacgcagatacggaggaaacagtgacctgcctacaaatgaccgtgtaccacccgggacagcttcaatgcggcatctttcagagcatctctttcaaccgtgaaaaattaccttcttcagaagtcgttaagttcgggagaaacagtaacatttgccactatacattccaggataagcaggtctccagagtccagttcagcctgcaactgttcaagaagtttaactcctccgtgctgtccttcgaaattaaaaatatgtccaaaaaaaccaacctgattgtggatagtagggaactggggtatctgaacaagatggatctcccttaccggtgcatggtgcgtttcggcgagtatcagttcctgatggaaaaggaagacggggaaagtcttgagttttttgagacacagttcatactatccccacggtcactactgcaagaaaacaactggccaccccacaggccaataccggagtacgggacatactccctttgcagttcgcagtcaagcagccccacagagatggacgagaatgaatcttag

SEQ ID NO: 60337 - DNA, 255 bp, Artificial Sequence
  Description of Artificial Sequence: Synthetic coding sequence
atgacctcgttcgaggatgcagatacagaggagactgtgacctgtttgcaaatgactgtttaccatccagggcagctccagtgcggcatctttcagtctatcagtttcaatcgcgagaagttaccctcaagtgaagtggtgaagttcgggaggaactctaatatttgccattacactttccaggacaagcaggttagcagggtgcagttctctctccagttgttcaaaatacaacagctgagcagcctgttatag

SEQ ID NO: 60338 - DNA, 555 bp, Artificial Sequence
  Description of Artificial Sequence: Synthetic coding sequence
atgacttcattcgaagatgcagatacggaagagaccgttacttgcctacagatgactgtgtaccaccctggccagttgcagtgcgggatctttcagtcaataagctttaacagagagaagctgccatccagtgaagtagtaaagttcggacgcaatagcaatatctgtcactacaccttccaggataaacaggtttctagggtccagttctccttacagctgttcaaaaaatttaactcatcagtgctaagtttcgagatcaagaatatgagcaagaaaaccaatctgattgtggactccagagagctcggatatttaaacaagatggatctgccttataggtgcatggtacgattcggagagtaccagtttttaatggagaaagaggatggagaaagccttgaattctttgagacacagttcatcctcagccccaggtccctgctccaggagaataattggccccctcaccgaccaataccagagtacggtacctacagtctatgctcatcacagtcatcgagtccaacagaaatggatgagaatgaatcttag

SEQ ID NO: 60339 - DNA, 552 bp, Artificial Sequence
  Description of Artificial Sequence: Synthetic coding sequence
atggagaagccctataataaaaatgaaggcaacctagagaatgagggcaaaccggaggatgaggttgagcccgacgacgaggggaaatctgatgaggaagagaagcccgacgctgaggggaaaactgagtgtgagggcaagcgcaaagccgaaggggaacccggtgacgagggacaactagaagataagggctctcaggagaagcagggaaagtctgagggcgagggcaagcctcaaggcgaagggaagcctgcctctcaggcaaagccagagggacaacctcgggcagccgaaaagcggccagccggagactacgtgccaaggaaggccaagcgcaagaccgatagagggacggacgatagtcctaaggacagccaggaggatctgcaagagagacacttaagcagtgaagaaatgatgagggagtgcggagatgtcagtagagcacaggaagaactgcgcaaaaagcaaaaaatgggcggattccactggatgcaaagagacgtccaggacccattcgctcagggcgacaacggggtttcgggcgagtag

SEQ ID NO: 60340 - DNA, 1641 bp, Artificial Sequence
  Description of Artificial Sequence: Synthetic coding sequence
atggccgctgggagcacgaccttgcgggctgtggggaaactgcaggtaagactggccactaaaaccgaaccaaaaaaactggagaagtacttacaaaaactttccgcgctgccaatgaccgcagacatcctggcagagacaggcattagaaaaactgtgaaaagacttcgaaaacatcagcacgtcggcgactttgcccgtgacttagctgcgagatggaaaaagctggtgttggttgatcgaaataccggcccagatccccaggaccccgaggaaagcgcgagtcgacaaaggttcggggaggcccttcaggagagggaaaaggcttggggatttcctgagaatgctaccgccccaagaagtccaagtcatagtcccgaacaccgcagaacagcacgaaggacacccccaggccagcagcgacctcaccccagatcgccttctagggaaccgcgagccgagagaaaacgacctcggatggcaccagccgacagtgggcctcaccgagacccacctactcgaacagctccgttgcccatgcctgaaggccctgagcccgcagtgccaggagaacagccaggcagagggcatgcccacgcagcccagggagggccacttcttgggcaggggtgccagggccagccccaaggcgaagctgtgggatcacactccaagggccacaagtcctcgaggggagctagcgcacaaaaaagccccccagtgcaagaatcacagagcgagcgtttgcaagcggctgtggcagattctgcaggcccaaaaaccgtgccgtcacatgttttcagtgaactctgggacccttcagaggcctggatgcaggcaaattacgatcttctcagcgcttttgaggcgatgacctcacaggcaaaccctgaggcactgtccgcccctacactgcaggaggaggcagcgttcccaggaaggcgtgttaatgcaaagatgcctgtctacagcgggtcacggcctgcgtgccaactgcaggttcctacactcaggcaacaatgtttgagggtgcccaggaataacccagacgcactgggcgacgtcgagggcgttccttacagtgctctggagcctgtgctcgaaggatggacgcctgatcagccctacagaactgagaaggacaatgccgctcttgcaagggagaccgacgagctgtggcggattcactgcctccaggattttaaggaggaaaagccccaggagcacgagagttggagagagctctacctccggcttcgggacgccagagagcaaaggctgcgcgtcgtcactactaaaatccgcagcgcacgggagaacaaaccatctggccgacagaccaagatgatctgttttaatagcgtagcgaaaacaccctacgacgcctcgcggagacaagaaaaaagtgccggtgctgcggatcccggaaacggtgaaatggaaccagccccaaagcccgctggatcctcccaggccccttcaggcctgggagacggcgatgggggaagcgtttccggtggcggaagcagtaatcggcatgcggctcccgcagacaagacccgcaagcaggccgctaagaaagtggccccactgatggccaaagctataagggactacaaaggacggttttcacggaggtag

SEQ ID NO: 60341 - DNA, 1761 bp, Artificial Sequence
  Description of Artificial Sequence: Synthetic coding sequence
atgcaagcaggagccaggttccaaaggagaagaaggcagctgcagcaacagcagcctagacgaaggcagcctctgctgtggccaatggacgccgagccaccgccacccccaccctgggtgtggatggtgccaggctccgcaggtttgctaaggctgtctgccggtgtggtcgtacctccagtgttactggctagcgctcctccccctgccgcaccgctcctgccaggtctgcccggatggcctgcgccttctgaaccagtgctgcctctgctgcccctcccaagtgcacccgattctgctgctgccgctgccgcacacccttttcctgctctgcacgggcagtggctttttggaggacacagtccttctctgggcctcccacctagctcgacggtcgagttggttcctgtttttcctcatctatgcccgtctgctctcgccactcccattgggaaatcctggatagacaaacgcatcccaaattgtaagatcttcttcaataattcattcgcattagatagcacgtggatacacccggaagaaagccggttctttcacggccacgagaagcctaggttactcgctaaccaggtggctgtctccctgtcaaggcccgctcccgcatcaagacccctgccaactgtggtgctggctccacaaccaatccccggtggatgccacaactctctgaaagtgacctccagccccgctatcgcgatcgcaacagctgccgctgctgcaatggtgtctgtggacccagagaatttgaggggtccgagcccttcttcagttcagcctcggcatttcctgaccttagcccctataaaaatcccgctgcgcacttcacccgtaagcgacacacgcactgaaagaggacgggtggcgcgaccccctgccctcatgctccgggctcaaaagtcacgggatggcgacaaggaagacaaagagcctcccccaatgctcgggggtggagaagactccacggcccgtggcaaccgaccagtggccagcactccggtccccggtagtccttggtgcgtagtctggacgggtgatgaccgggtgttctttttcaatcctaccatgcatctgtcagtttgggaaaagccaatggatcttaaagatcgaggtgacctgaatagaatcattgaggacccccctcacaagaggaaactggaggctcccgctaccgacaactccgatggttccagcagtgaagataatcgcgaggaccaagacgtaaagactaagagaaacagaacagagggatgtgggtcacctaaacccgaggaagccaagcgggaggataagggtacccgtacgccccctccccagattctcctgccccttgaggagcgagtgacgcattttcgcgatatgctccttgaacggggtgtgtcggcatttagcacgtgggagaaagaactccataaaatcgtttttgatccacgttacctattgctgaactcggaggaaagaaagcaaatctttgagcaattcgtcaagacccgcattaaagaagagtataaggagaagaaatccaagctgctgctcgccaaagaagaatttaaaaaacttctggaggagtcaaaagtgtccccccgtactactttcaaagaatttgccgagaagtacggaagagaccaaagattcagactcgtccagaaacggaaagaccaggagcatttctttaaccaatttatcctgatcctgaaaaaacgcgataaggagaaccgcctccggctgcgaaaaatgcggtag

SEQ ID NO: 60342 - DNA, 504 bp, Artificial Sequence
  Description of Artificial Sequence: Synthetic coding sequence
atggacagaggcaggccagcaggctctcccctaagtgcttccgctgaaccagcgcctctggctgctgctatacgcgattccagacccggacggaccggcccaggccctgctggccctggcggtgggtcccgatctggcagtgggcgacctgcggcagcaaacgcagcacgtgaaagatccagggtacagactctgagacacgcctttctggaactgcaaagaacattgccatcagttccccctgatacaaaactttctaagctagatgttctgctgctcgctacaacttacattgctcatctgacacggtccctccaggatgatgccgaggctccagccgatgcgggtttgggcgctctacggggtgacggttacttacatcccgtcaaaaagtggcccatgaggtcccgtctgtatatcggagccacaggccagttcttgaagcactctgtctccggggagaagacaaatcatgataacacccccaccgactcccagccgtag

SEQ ID NO: 60343 - DNA, 11580 bp, Artificial Sequence
  Description of Artificial Sequence: Synthetic coding sequence
atggcatttgtagccacacagggcgctacagtcgttgaccagaccaccctgatgaaaaagtatctacagttcgtggccgcactcactgatgtcaatacgcccgatgaaaccaaattgaagatgatgcaggaagtgtccgaaaatttcgagaatgtgaccagttcacctcagtacagtacgttcctcgagcacatcatcccgcgttttctgacgttcctgcaggacggtgaggtccaattcctgcaggagaagcccgctcagcagctgcggaagctggttctggagattatccatcgcattccaaccaatgagcacctcaggccgcacacaaagaatgtgctgtcagtgatgtttcgctttctcgagacagaaaacgaagaaaacgttttgatatgcctgaggatcataatcgaattacataagcagttccgcccacccattactcaggagatccatcattttctggatttcgtaaaacagatttataaagagcttcccaaggtggtgaaccggtacttcgagaatcctcaagtcatccccgaaaatacagtgccccctccggagatggtcggcatgattactacgattgccgtgaaagtgaatccagaacgagaggactcagagactcgaacacactccataatcccacgtggctctttaagcctcaaggtcctggctgaactccctataatcgtggttcttatgtaccagttatataaactgaatattcacaacgtcgtagccgagttcgtgcccctgataatgaatactatcgcgattcaagtgagcgcccaagccaggcagcacaaactgtataacaaagaactgtatgccgactttattgcagcacagatcaagacattaagttttttagcctacattattagaatttatcaggagctcgtgaccaaatactcacagcagatggttaagggcatgctccagctgctaagcaactgccctgcggagactgctcaccttcgcaaagaactactgatcgccgcaaagcacatccttactacagaactgaggaatcagtttataccctgtatggacaaactttttgacgagagcatcctgattgggtcaggatacaccgcacgagagacgctcagacccctagcatattccaccctcgcagatttggtgcaccacgtacgacagcacctccctctgagcgacttgtcactggcggtgcagctgttcgccaagaacattgacgacgagtcactgccatcatctattcagacgatgtcatgtaaactgctactaaatcttgtcgattgcataaggagtaaatctgagcaggaaagtggcaatggcagggacgtcctcatgaggatgctcgaggtcttcgttcttaagttccatacaatcgctcgctatcagctctccgctatctttaagaagtgcaaacctcagagcgagcttggcgcagtagaggcagcactccctggagtgccaacagcccctgccgcacccggacccgcaccgagtcccgcaccagtccccgctcctcccccaccccctcctcctcccccacctgcaacacctgtcacgcctgcccctgtgcccccattcgaaaagcagggtgagaaggataaagaggacaagcaaactttccaggtgaccgattgccgaagtcttgtcaaaacattggtctgtggagttaagaccattacgtggggaatcaccagctgcaaggcccctggagaagcccagttcatccctaacaagcagttgcagcctaaggaaactcagatttacatcaagctcgtgaaatacgccatgcaagctctggatatctaccaggtgcagatcgccggaaatggccagacctacatcagagtagctaattgtcagacagtgcggatgaaagaggagaaagaagtgttggagcacttcgctggcgtatttactatgatgaatccactgaccttcaaggaaatctttcaaacgactgtgccctatatggtagagagaataagtaagaattatgctctccagatcgtggcaaacagtttcttggccaacccaactacatccgctctttttgccacaatcttagtggaatacctcctggataggctgcccgaaatgggttcaaacgtggagctttccaacctgtatcttaagctgtttaaacttgtttttggctcggtgtcactgtttgccgctgagaatgagcagatgctgaagccacatctgcacaagattgtgaattcctctatggaactggcccagacggccaaagaaccatacaattactttctcctcttacgagctcttttccgctctatcggaggtggttcccacgatctcttgtaccaggagttcttgccgttgctgcctaacctgttgcagggcctcaatatgttgcagagtgggctccataaacagcacatgaaagacctcttcgtagagctgtgcctgaccgttccagtcagactgtccagcttacttccatatctgccaatgctgatggaccccctcgtgtccgcactgaatggcagtcagaccctggtgtcgcaagggctgcgtactcttgagctgtgtgtagacaatctccagcctgattttctgtatgatcacattcaacctgtgcgggctgagctgatgcaggccctgtggcggacactaaggaaccccgcagacagcatctctcacgttgcgtatcgggtgttgggtaagtttggcggaagcaatcgcaaaatgctgaaggagtcccagaagctgcactacgttgtcaccgaggtgcaggggccttctattaccgtggaattctctgactgcaaggcaagtctgcagttacctatggagaaagccatagagactgcattggattgtctaaagagtgccaacactgagccatactataggcggcaggcatgggaggttattaaatgttttctggttgcgatgatgtccctggaagataataaacatgcactataccagctcctggctcaccccaattttacagaaaagaccattcccaacgtgattatctctcaccgctataaggcccaggatacccccgctagaaaaacttttgaacaggcactgacaggtgcttttatgagcgcagtaataaaggacctgcgacccagcgccctgccttttgtagcttcactgattcggcactacacaatggtggctgtcgcacagcagtgcggaccttttctcttaccctgttatcaagtcggatcgcagccaagcactgcgatgtttcactcagaggagaacggttctaaggggatggacccgctggtcctaatcgacgccattgctatttgcatggcctacgaagagaaggaactgtgcaagattggagaggttgcattggcagtgatattcgacgtggcgtctatcatcttgggaagtaaggagcgagcttgtcagttgcctctgtttagctacatcgtggagaggttgtgtgcctgctgttacgagcaggcatggtatgccaagctggggggtgtggtatccatcaagttcctgatggagcgcctgcccctgacttgggtgctccagaatcagcagactttcctgaaggccctgctctttgtcatgatggatctgacgggggaagtatccaatggagcagtagcaatggccaaaacgactctggagcaactgctgatgcgctgcgccacaccacttaaggatgaagagagggctgaggagatcgtcgccgcacaggaaaagtccttccatcatgtgacccatgacctggtcagagaggtcacttccccaaacagtaccgtcaggaagcaggccatgcatagcctgcaggtccttgcccaggttacgggtaaatccgtaacagtaatcatggagccacacaaagaagtactccaggacatggttccccctaagaagcacctgctccgccaccagccagccaacgcccagattgggctgatggaagggaacactttttgcaccaccctgcaacccagactgtttaccatggaccttaatgttgtcgagcataaagtcttttataccgagcttctgaacctgtgcgaagcggaagatagcgccctaactaaactcccttgctataagagcctgccttctcttgtgccgctaagaatcgccgctctgaacgccttggcagcctgtaactaccttcctcagtctcgggagaaaattatagccgcactattcaaagcactgaacagcacaaattcagaactccaagaggccggagaggcttgcatgaggaaattcctcgaaggcgctacaatcgaagtggaccagattcatacacatatgcgcccactgttgatgatgttgggagactatcgctccctgaccctgaatgtggtaaatcgactgacctctgtcacgagactctttccaaactctttcaacgataagttttgcgatcagatgatgcagcacctgcgtaaatggatggaagttgtggtcatcactcataagggtggccagagatccgacggaaatgagtctattagcgaatgcggacggtgtcccctgagcccgttctgccagttcgaggaaatgaagatctgcagtgcgatcattaacctattccatcttataccagccgctccccagacattggttaagcctttgctcgaagtggtaatgaagacggaaagggccatgctgattgaagccggtagtccattcagggagccactgattaaattcctgacaagacacccctcacagactgttgagttattcatgatggaagccaccttaaacgacccccagtggagccgaatgttcatgagtttcttaaaacacaaggacgcccgacctcttcgagatgtcctggctgcaaatcccaacaggttcataactctgctgctcccaggtggtgcccaaacagccgttcgtcccggatcccctagtacctctaccatgaggctcgacctgcagttccaggcaatcaagatcatttccataatagtcaagaacgacgattcctggcttgctagccagcattccctcgtgtctcagttgcgcagggtgtgggtgtccgaaaattttcaggagaggcaccggaaggagaatatggccgcaaccaattggaaggagcccaagttgctggcgtattgcctcctcaattattgcaagaggaactatggagatatcgagctgttgtttcaactcctcagggcttttactgggaggttcctgtgcaatatgacttttttaaaagagtacatggaggaagagatcccaaagaactatagtatcgcccagaagcgtgcactgttttttcgatttgtcgatttcaatgaccctaatttcggggatgagctaaaggcaaaggtgctgcagcacatactcaacccggctttcttgtactccttcgaaaaaggggaaggcgagcagctgcttgggccacctaacccagaaggtgataatccagagtccattaccagcgtgtttattaccaaggtgcttgaccctgaaaagcaggctgacatgcttgatagcctgagaatttatctccttcagtacgcaaccttgctagtggagcatgcgccacatcatattcacgataacaataaaaataggaactcaaaacttcgaaggctgatgacattcgcctggccttgtctcttgagcaaagcatgcgttgatcccgcatgcaagtattccggacacttgctgctcgctcacattatagccaaattcgctatccacaaaaagatcgtgttacaggtctttcattcgctcctcaaagctcacgcaatggaggctagggccattgttagacaggccatggcgattctcactcctgccgtgccagcacgcatggaagacgggcaccaaatgctgacacattggacaaggaagattattgttgaagaggggcacacggtcccacaactggtgcatatcctgcacctgatagtgcagcattttaaggtatattacccggttaggcatcacttggtacagcacatggtctccgcgatgcagagactggggttcacaccctcagtgaccatcgaacagcggagactggccgtcgacttgagcgaggttgttataaaatgggagctgcaacggataaaagatcaacaacctgacagcgacatggaccctaattcgtctggcgaaggagtaaattccgtgtcttcctcaatcaaacgcggactgtctgtcgactcagcacaggaagtgaagcggtttaggactgccactggagccatcagcgcagtgtttggtcggtctcagtcccttccaggagccgactccttattagctaagccgattgataaacagcacaccgacactgtggtaaatttccttataagagtggcgtgccaggtcaacgacaacaccaacaccgccggaagcccaggggaggtactttcaagacggtgtgtaaatctgctgaagactgcactccgccctgacatgtggcctaagtctgagctgaagctccagtggtttgacaaactgttgatgaccgtcgagcagcccaatcaggtgaattacggcaatatttgtacagggctagaggtgctgagcttcctcctgaccgtgctccaatcacccgctatcttatcaagttttaaacccctgcagagggggattgctgcctgtatgacgtgtggcaacaccaaagtgctgcgtgccgttcattctctgctaagtcggctgatgtccatcttccccactgagcctagtacaagcagcgtagcttcgaagtatgaagaattggaatgtctgtatgccgctgttggtaaagtcatatatgaaggcctgaccaactatgaaaaggccactaacgccaatccctcgcaactctttggcacacttatgatccttaagagcgcctgcagcaataaccctagttacattgaccgactcatctctgtgtttatgcgaagcctgcagaaaatggtccgggagcacctgaacccccaggccgcatccggctctactgaggccacctccgggacatctgagctcgtcatgctgtcactggaacttgttaagactagactggctgttatgtctatggaaatgcgcaagaactttatccaggccatcctgacgtccctcattgagaaaagccccgacgctaagatcttgagagccgtggtgaagatcgtggaggaatgggtaaaaaataactcacccatggccgcaaatcagacccccacgttgagggagaagagcatactgcttgtgaagatgatgacctacatcgagaagcggttccccgaggatttggagttaaatgcccagtttcttgatcttgttaattatgtgtaccgggacgaaactctctctgggagcgagctgacagccaagttagaacccgcattcctaagcgggctccgatgcgctcagccgctaatcagagcaaagtttttcgaagtgttcgacaatagcatgaagcgtcgagtgtatgagcggctcctgtacgttacctgcagccagaactgggaagctatgggcaaccacttctggattaagcaatgtatcgagctgttactcgcggtttgtgagaagagcacacccattggcacctcctgccagggcgctatgctgcctagcatcacaaatgttatcaatctggccgattcccacgacagagccgcatttgctatggtaacacatgtcaagcaggaacccagagagagagagaatagcgagtcgaaggaggaagacgtggaaatcgacatagagttggcacctggagaccagacctctactcctaagactaaggagctgtcagaaaaagacatcggaaatcagctccatatgctgacaaacaggcatgataaattcttagatactttgagggaagtgaagaccggcgcactgttgtcagcatttgtgcagctgtgccacattagcaccactctagccgaaaagacatgggtccagctgttcccgaggttatggaagattctgtctgaccgacagcagcatgcgcttgctggagagatcagtccattcctctgttctggcagccatcaggtacagcgggactgtcagcctagtgcgttgaattgcttcgtcgaagcaatgtcacaatgtgtgcctccaatccctatacgcccatgtgtgctgaaatatctgggcaaaacccataatctgtggtttaggtcaacactgatgctggagcaccaggccttcgaaaaaggtctgagcttacagatcaagcctaagcaaacgaccgaattctatgagcaggagagtatcacccccccacagcaagagatcctggattccctggctgaactgtactctttgctgcaagaggaggatatgtgggcaggcttatggcagaaacgctgcaaatattccgagaccgctaccgccatcgcttacgagcaacacggtttttttgaacaggctcaggagtcatacgagaaggctatggataaagccaaaaaagagcatgagaggagcaatgcttcccccgcaattttcccggagtatcagttgtgggaggaccactggatcaggtgcagcaaagaattaaatcaatgggaggccctgacggagtacggccaatcaaagggtcacattaacccctatctggtccttgagtgcgcgtggcgtgtgagtaactggaccgctatgaaagaggcgctggtgcaagtagaggtttcgtgccctaaggaaatggcgtggaaagtcaatatgtatcgaggctatctcgctatttgtcaccccgaggagcagcagttgagtttcatcgaacggctggtcgaaatggcctccagcctggccatcagggagtggcgccgtctcccccatgtggtgtcacacgttcacactccgctcttgcaggccgctcaacagataatagagctacaagaggcggctcagatcaatgctggcctgcagccaactaacttggggcgtaacaactctctgcacgatatgaagaccgttgtgaaaacctggaggaatagactacctatagtctccgatgatctgagccactggtcttctatctttatgtggcggcaacaccactaccagggcaagcctacatggtccggcatgcattcaagctcaatcgtgactgcttacgaaaacagctcacagcacgatccctcctcaaacaacgcgatgctgggtgtgcacgcgtcagccagtgctattattcagtatggcaaaattgccagaaagcagggactggtaaatgtcgctttggatattctgagccggattcacacgatccccacagtgcccatagtcgactgcttccagaagatccggcagcaagtcaaatgttacctgcaactggccggagtcatggggaagaacgaatgcatgcagggactcgaggtgatcgagtccaccaacctgaaatatttcaccaaagaaatgacagctgaattttacgctcttaagggaatgtttctggcccagattaataaatccgaggaagcaaataaagctttctcagccgctgtccagatgcacgatgtgttagtgaaggcctgggccatgtggggagattatctggaaaacatcttcgtaaaggaaagacagctccatctcggcgtgtctgccatcacctgctatctgcatgcctgtagacaccagaatgagtcaaagtctagaaagtacctagcaaaagtcctttggttgctctcattcgacgacgacaaaaatactttggccgacgccgtggacaagtactgcattggggttcccccaatccagtggcttgcctggataccccagcttctgacgtgcctggttggatctgagggaaagctgctcttaaatttgattagccaggtggggagggtttatccccaggctgtgtatttccccattcggactctgtacctcacactgaaaatagagcaacgggagcgttacaagtccgaccccggacccatacgggctactgcgcctatgtggcgctgttctcgcataatgcatatgcagagggaattacatcccacactgctgagctccctggaaggcattgtggaccaaatggtctggtttcgggagaactggcacgaagaagtcctgaggcagctgcagcaggggctggccaagtgttactccgtggccttcgagaaaagcggcgcagtatctgacgcaaagatcactcctcacactctcaacttcgtcaagaagctggtgtctaccttcggggtaggcctggaaaacgtgtctaacgtttcaaccatgttcagtagtgctgctagcgaatcactggccagacgggctcaggctacagcgcaggatcctgtattccagaagctcaaaggccagtttaccactgactttgacttctcagtgccaggatctatgaagctgcataacctgatcagtaagctgaagaagtggatcaaaatcctggaagcgaagactaagcagctcccaaagttctttttaattgaggaaaagtgtcggtttctttcaaactttagcgcccagacggcagaggtggaaattccaggcgaatttcttatgccaaaacccacccattactatatcaagattgctcggtttatgccaagggtcgagattgtgcaaaagcacaacacggcggctcgacgcctatacataagagggcacaatggcaagatttacccatatcttgtcatgaacgatgcctgtctcacagaatcgcggagggaagagcgtgtgctgcagctgttgcgtctccttaatccatgcctagagaaacggaaagagacaaccaagcggcacctgtttttcaccgtaccgcgagtcgtggccgtgtctccacagatgagactggtcgaggataacccttcgtcgctcagtctggtggaaatatataagcaaaggtgcgccaagaagggtatcgagcacgacaatccaatcagtagatactacgataggctcgccaccgtgcaggcacgtggcacacaagcaagccatcaagtccttagagatattctcaaggaggtgcagtcaaatatggtccctaggtcaatgttgaaggaatgggctctccacaccttcccaaacgccactgactattggacctttagaaagatgtttacgatccaactcgccttgatcgggttcgccgaattcgtcttgcatctaaaccgcctgaatcctgaaatgctccaaatcgcacaggacacaggaaaattgaacgtggcgtacttcagatttgatatcaacgatgccaccggggaccttgacgctaatcggccagtacctttccgactgacccccaatatttctgaattcctgaccactattggggtcagcggtccactaacagccagcatgatcgccgtggctaggtgttttgcacagccaaactttaaagtggacggaattctgaaaaccgtgttgcgagatgaaataatagcctggcacaagaagacccaagaggatacatcaagtcctctcagcgccgcaggacagccagaaaacatggacagtcagcagctcgtctccttagtgcagaaagccgtgacagcaattatgaccagattacacaacttggcccaattcgaagggggagagtctaaggtgaatactctcgtggctgccgcaaatagcctcgacaacctctgcagaatggatccagcttggcacccatggttgtac

SEQ ID NO: 60344 - DNA, 951 bp, Artificial Sequence
  Description of Artificial Sequence: Synthetic coding sequence
atgggcgagtctgccgctgccacagcaagtctgttccagcgcagaagacgaggcaggggtggcagagtgaccttccctggcggtcttaagggcagtgccagatttctctcattcggtccaccattccctgcccctccagccccacccttccctgccgctccagggccttggttgagacggccactcttttccctaaaactctctgacaccgaagacgtgttccccagacgcgcaggcccacttgaagtgccagccgattcacgcgtcttcgtgcaggcggctctggccagaccctcaccacggtggggcctagccttgcacagatgttccgtcaccccgagtagtaggcccgcacctggtccagccttagccttactgcgagaggggtgtcccgctgacacaagtgttgcttttccacccccaccaccaccaagcccaggcgctgcccgaccagctcggttctcctttcgtttgagacctgtttttaacgcatcggtgcagtttttgcattgtcagctgtcccgatgccgtcggctgaggggtgtacggagggctccagccccacttaccccccctccccctccgccaccgtcacgatgtttgccacaagacgaagcttgcgccgacacaggctccggttccgctgaagggctggccgctgacggcccacacttacacaccctgactcagccgattgtcgtgactgtaccgcgtcccccacctcgcccacctaagtccgtacccggaagagctgtgcggcctgagccaccagccccagctccagcagccctggagcccgcacccgtcgtcgccctggtgctggcggcattcgtgctcggggctgccctggccgcaggtctcggactcgtatgcgctcattcagcacctcatgcccctgggcctcccgctagagcgtcaccttctgggccacagccaagacggtctcaatag

SEQ ID NO: 60345 - DNA, 600 bp, Artificial Sequence
  Description of Artificial Sequence: Synthetic coding sequence
atggccaatagaggacctagttatggtctgagtagggaagtccaggaaaaaatagaacaaaaatatgatgctgacctagagaacaagcttgttgactggattatcctccagtgcgctgaggatattgaacacccccctcccggtagagcgcatttccagaagtggttgatggacgggactgtactctgtaaactgatcaattctctctatcccccaggtcaggaaccgatccccaagatttccgaaagtaaaatggctttcaaacagatggaacagatcagtcagttcttaaaggctgccgaaacatacggcgttagaactactgacatctttcagactgtggacctttgggagggaaaagacatggcggctgtccagaggaccctgatggccctcgggtcggttgccgtgactaaggatgacgggtgttatcggggagaacctagttggttccacaggaaggcccagcaaaacaggcggggattctccgaagaacaactgcgccagggccagaatgtgatcggactccaaatgggcagcaacaaaggcgcttctcaggctggcatgaccggctatgggatgccacgacagattatgtag

SEQ ID NO: 60346 - DNA, 600 bp, Artificial Sequence
  Description of Artificial Sequence: Synthetic coding sequence
atggcaaatcggggaccctcttatggtctgagcagagaagtgcaagagaagattgagcagaagtacgatgctgatctagagaataaactggtggattggattatacttcaatgtgctgaagacatcgagcacccgccacctgggagggcccattttcagaagtggctaatggatggcaccgtgttgtgtaaactcatcaactcactgtacccaccagggcaggagcccatcccaaagatctcagagagcaagatggcgtttaaacaaatggagcagatatcccagtttctcaaagccgctgagacatacggagtgcgaaccactgacattttccagacagtggacctttgggaggggaaagacatggcagcagtgcagcgcaccttgatggcgttagggtcggtggcagttaccaaagatgacggatgctaccgcggagaaccctcatggttccaccgcaaagcccagcaaaataggcgcggatttagcgaggagcagctgaggcagggccaaaacgtcattggcttgcagatgggaagcaacaagggagcgtcacaggcaggcatgaccggatacggcatgcccaggcagattatgtag

SEQ ID NO: 60347 - DNA, 600 bp, Artificial Sequence
  Description of Artificial Sequence: Synthetic coding sequence
atggctaacagggggccaagctacggcctgagccgagaagtacaggagaaaattgagcagaagtacgacgccgacctggaaaataaactggtggactggattattctgcagtgcgccgaggatatagagcaccctcccccaggcagggcccactttcagaaatggctgatggatggaacagtcctctgtaaattgataaacagtttatatccccctggtcaggaacccatcccaaagatcagtgaatcaaagatggccttcaaacagatggagcaaatcagtcagttcttgaaggcagccgaaacttatggtgtgagaaccacggacatctttcagacagtggacctctgggaaggcaaagatatggcagccgtacaaaggacgctgatggctctgggatctgtggctgtaacgaaggatgacggttgctaccgcggagagccgagttggtttcatcgcaaagctcagcaaaaccggcgagggttctcggaagaacagcttcgacagggccagaacgtgatcggtctccagatgggtagcaataaaggcgctagccaggcgggaatgacaggatacggcatgcctcgccagattatgtag

SEQ ID NO: 60348 - DNA, 600 bp, Artificial Sequence
  Description of Artificial Sequence: Synthetic coding sequence
atggccaaccgcggaccaagctacgggctctctagagaggttcaggaaaagatagaacagaagtacgacgccgatctcgaaaataaactcgtcgactggatcattctgcagtgcgcagaggatatcgaacaccccccacctggacgggcacacttccagaagtggcttatggatggaacagttctctgcaaattgattaacagcctgtacccaccaggccaggaacccatcccgaagatcagtgagtcaaagatggctttcaaacagatggaacaaattagccagttcctgaaggctgcagagacgtacggcgtgagaaccacagacatcttccagactgttgacctctgggagggcaaggacatggctgccgtccaacggacgctcatggcactaggcagcgtggcagtaacaaaggatgacggctgttaccgaggggagccaagctggttccaccggaaagcacaacagaaccgtcgcggattctctgaagagcagctgcggcagggacagaacgtcataggattacagatggggagcaacaagggagcctctcaggccggaatgaccggctacggaatgcctcgtcagatcatgtag

SEQ ID NO: 60349 - DNA, 666 bp, Artificial Sequence
  Description of Artificial Sequence: Synthetic coding sequence
atggcaaaccgcggaccttcttatggcctgtcaagagaagtccaggagaagatcgagcagaaatatgatgctgacctggagaataaactggtcgactggatcatcctacagtgtgccgaagacatagaacaccccccacctggaagagctcatttccagaagtggctgatggacgggaccgtgctgtgcaagctcatcaattctctgtacccacctggccaggaaccaattcccaaaatatcggagtctaagatggccttcaagcagatggagcaaatctcccaatttctaaaagctgcagaaacctatggggtaaggactaccgatattttccagactgtggacctgtgggagggaaaggatatggcagccgttcaaagaacactcatggcgctgggcagtgtggccgtcacgaaagatgacggctgctatagaggggaaccatcctggtttcatagaaaagctcaacagaacagaagaggattttccgaggaacaattgagacagggtcaaaatgtgatcggactgcaaatgggtagtaataagggcgctagtcaagccggaatgaccggctacgggatgccaggcaggagctgcagaacccgccacctgcctttggtggagcggacaaatgtgccccatcacgggctttatgagaagaagtag

SEQ ID NO: 60350 - DNA, 2520 bp, Artificial Sequence
  Description of Artificial Sequence: Synthetic coding sequence
atgaagaaatggtcttctacagacttgggggctgctgccgatccgttgcagaaggatacgtgcccggatcccctggacggcgatcctaactcgaggcccccaccggcaaaacctcagctgtctaccgctaagtcacgcaccaggctctttggcaaaggcgactctgaggaggctttcccagtcgactgtccacacgaggagggcgaactcgactcctgcccaaccattaccgtaagcccggtaataactatacaacgacccggagacggcccaacgggtgctagactcttatcacaggacagcgtagccgcttcaaccgagaagacgttacgtctctatgatcggcgttcgatctttgaggcagtggcgcaaaacaactgccaggatctggagtcccttctcctgttcctacagaagtctaaaaaacacctaactgacaatgagttcaaagaccctgagaccggaaagacctgtctgctgaaggcgatgctcaacctgcacgatggccaaaatacaacaattcctcttctgctggagatcgcgcgtcaaaccgatagtctgaaggaactggtcaacgcgagttacaccgactcgtactacaagggccagacggctttgcatatagccatagaaaggagaaacatggctttggtgactctgctggtggaaaacggggcagacgtccaagcagcagctcacggcgatttttttaaaaaaacaaaagggcgtccgggattctattttggtgagctgcctctgagcttggcagcttgtacaaatcagctcggtattgtcaagtttttgcttcaaaactcctggcaaactgcagacatatcggccagggactctgtcggcaacactgtgcttcacgcactcgtggaggtggctgacaacacggcagataatacaaagttcgtgaccagcatgtataatgagatccttatgctgggtgccaaactgcatcccaccctgaaactggaagaactcacaaacaaaaaggggatgacaccattggcgcttgctgcaggcactggaaagatcggcgtgctggcatatatccttcagagggagatacaggaaccagaatgccgtcatctgtcccgaaaatttactgaatgggcatacggcccagtgcatagttccctctacgatttgagctgtatcgacacctgcgaaaaaaattcagtgttggaagtgattgcctactcttccagcgaaacacctaatcgccacgatatgctgttggtcgaaccactgaaccgcctcttgcaggacaagtgggataggttcgtcaagcggatattctactttaattttcttgtgtactgcctgtacatgatcattttcacaatggccgcttattatcgacctgtggatggcctgccacctttcaagatggaaaaaaccggagactacttcagggtgacgggagaaatcttgagcgttcttggcggtgtatatttcttctttcggggtattcagtattttcttcagcgcagaccatcaatgaagactttatttgtggattcctatagtgaaatgttatttttcctgcaatccctatttatgctggccactgttgtgctgtacttcagtcacctcaaagagtacgtggcatctatggtctttagtctggctttggggtggacgaacatgctgtactacacacggggattccagcagatgggcatttacgctgtgatgatagagaagatgatcttgagagatttatgccgcttcatgtttgtgtacatcgtcttcctctttgggttttctaccgctgttgttacgttgatcgaggacggcaagaatgatagcctgccgtccgagtctacaagccaccgatggcggggacctgcgtgtcgaccccctgactccagttataattccctctactcaacctgtttggagctgtttaaattcaccatcggcatgggcgacctggagtttaccgaaaactacgattttaaagctgtttttatcatcctcctactggcctacgtcatcctcacctatatcttactgctaaacatgttgattgctctgatgggagaaactgtgaataagatagcccaggaatccaaaaatatctggaaactccaacgagcaattaccatccttgataccgaaaagtccttcctaaagtgtatgcggaaggcctttcgaagcggaaagctgctgcaggtaggctacactcccgacgggaaggatgattaccgctggtgctttcgggtggacgaggtcaactggactacctggaatacaaatgtcgggatcataaacgaagaccccggaaattgtgagggcgttaaaagaacactcagtttctcattgagaagtagcagggtgtcgggccgacactggaagaatttcgccctagtgcccctattgagagaagccagtgctcgggacaggcagagcgcacaaccagaggaggtgtacctgcggcagttttctgggtccctaaaaccagaggacgccgaagtctttaagtcacctgctgcgtccggcgagaaatag

SEQ ID NO: 60351 - DNA, 1791 bp, Artificial Sequence
  Description of Artificial Sequence: Synthetic coding sequence
atggcagacgcggaggcaagggctgagttccccgaggaagcgaggcccgatcggggaacactacaggtcctgcaggatatggcttccaggctgcggatacattcgatcagggcaacctgcagcacttctagcgggcaccctacttcatgcagcagctcttctgagattatgtccgtgctgttcttttacatcatgcgatacaaacagagtgaccccgagaatcccgacaatgacaggtttgtgcttgcaaaaaggctctcgttcgtagatgtggcaactggatggttgggacagggcctaggagtggcttgcggcatggcgtataccggtaagtacttcgatagagccagctaccgtgtcttttgcctgatgtctgatggggagtcaagtgaggggagtgtttgggaagccatggcgtttgcttcttattatagtctggacaatctggtagctatcttcgatgtgaacagacttggacatagtggggcattgcccgctgagcattgcatcaatatctaccagcggaggtgtgaagctttcgggtggaacacttacgtcgtggacggaagagatgtcgaggcactgtgtcaggtgttttggcaggcaagccaggtgaaacataagcccacggctgtcgttgccaagacattcaagggccgtggcacacctagcatcgaagatgccgagagttggcacgctaaacctatgcctagagaacgagccgacgccatcattaaattgatcgaatctcagattcaaacttctcggaatttggatcctcagccccctatcgaagacagccccgaggttaatattaccgacgtcagaatgactagtcctccagactacagagtgggggataaaattgctacacgtaaagcgtgcggcctcgcactcgccaagctggggtacgctaataaccgagtggtcgtgctggatggcgacacccgatacagtactttctcggagatcttcaataaagagtatcctgagaggttcattgagtgtttcatggcggaacagaatatggtgtcggttgccctggggtgtgcatcgagagggaggactattgctttcgcctccacgtttgcggcatttctaaccagagccttcgatcatattagaattggagggctggctgagagtaatattaacattatcggctcccactgcggcgtctcagttggggacgatggcgcttctcagatggcactggaggatatagcaatgttcagaactataccaaagtgcacgatcttctatcccactgacgccgtatccaccgagcacgctgtggcactggccgctaacgccaaggggatgtgcttcatacgaactactcggccagagactatggtcatttatacaccacaggagaggttcgagataggccaggctaaagtgttgagacattgcgttagcgataaagtaacagtgatcggcgctgggattaccgtttacgaagcgctcgcggctgctgacgaactgagcaagcaggacatttttattcgcgtgatcgacctgtttactattaaaccactcgacgtcgccactatcgtttcgagtgccaaggcaacagaggggagaattataacagttgaggatcattatccacaggggggtatcggggaagcagtttgtgcagctgtatccatggatccggatatccaagtgcacagtttggccgtgtcaggcgtgccccagtcaggcaaatctgaggagctgctcgatatgtatggaatttccgcccgacacattatcgtcgctgtaaagtgtatgctactgaattag

SEQ ID NO: 60352 - DNA, 1500 bp, Artificial Sequence
  Description of Artificial Sequence: Synthetic coding sequence
atgtggagtcgccgacagggacgtctgaggcccaccgtgtgtggagttgaggaactgcgacgccgaaggcgagagcgtgaggctgccttaaggaaggccagacgcgaacagcaactggtctccaaacgcctgctccgcaatgatgccccagaagaagccggagagggttgcgtagccgctatcctgggtgaaactgaagtccagcagtttctcaggcaggcccagagaggaaccgaagaaaaagaacgagagggggctctcgtgtcgctgcgcagaggcctccagcacccggagacacaacagacattcatcagactggaagggtccatgcgtacgctggtcggattgcttactagtaaccaggcgctgttgcagctcgaggccgcaaggtgtctccacgagttgtcacattccgagcaaagcactgttgcggaggcctgtctccctgcaacatcttacctcctgacctacctcagtagccactcttcagacttcattgaactctgcctgtacacgctaggcaacctgatcgtagagtcagaggcggttagaagacaactgctgccccaggggattgtgcctgcgctggccgcatgtatccagtcaccccatgttgctgtgctggaagccctgggttacgcactgtctcagttactgcaggccgaggaagcccctgagaagataatccccccagcctcagcttcctcaagcattttggctagcacgttgcctcaacatatgctgcaaatgttgcagcccggaccaaagctgaatcctggggtcgccgtggaatttgcctggtgtctgcattacataatttgcagccaggttagtaatccgctgcttattggccatggggctctgtcaacactgggactgcttctcctcgatcttgccggagccgttcaaaaaaccgaggatgcaggcttggaattactcgcatgtcctgtgctgcggtgtctgagtaacctactcacagaagccgctgtggagaccgtggggggacagatgcagctgcgggacgaaagagttgtcgccgcactgttcatccttcttcagttcttctttcagaagcagccttcgcttcttccagaaggactgtggttgctgaataacctgacagctaactccccttcattttgcaccagcctgctctcactcgatctgattgaacccctgttacagctgctgcctgtttcaaacgtcgtctcagtcatggtgttgacagtcctgtgcaacgtagctgaaaagggtccggcttactgccagcgtttgtggcccggaccactcctgcctgccctcctgcacaccttagcctttagcgataccgaggtggtggggcagtctctcgagttactgcaccttctatttctctaccaacccgaggccgtccaggtctttctgcagcagtcaggtcttcaagctctggagcgccaccaggaggaagctcagttgcaggatcgagtgtacgccctacagcaaaccgcccttcagggatag

SEQ ID NO: 60353 - DNA, 1482 bp, Artificial Sequence
  Description of Artificial Sequence: Synthetic coding sequence
atgtggagcagacggcagggcagactccggcctacggtgtgtggagttgaagaattgcgacgacgccgaagagagcgcgaagccgctctcaggaaagccagacgggaacaacagttagtgtctaagagattgcttagaaatgacgcacccgaggaagccggtgaagggtgtgttgcagctatactgggtgaaacagaggtgcagcagtttctccgacaggcccagcggggaaccgaagaaaaggagcgagaaggcgctcttgtaagtctgcgaagagggctgcagcaccccgagacccaacagacattcatccgactggagggctctatgcggactttagtgggcctgctcacctctaaccaggctctcctgcagttggaagcagcccgatgcctgcacgaactgagccattctgagcaatccactgtcgctgaagcttgcctgcctgccaccagctatcttctcacctatctgtcttctcatagtagcgactttatcgaattatgcctgtatactctgggaaacctgatcgtcgagagcgaagccgtgcgtaggcagctcctacctcagggtattgtccccgcactggccgcatgcatccaaagccctcacgtggctgtcttggaggccctcggctatgccctgtctcagttactccaggctgaggaagcaccagaaaaaatcattccatccatcttagccagcacgctgcctcaacatatgttacagatgctccagccaggtccaaaattaaatccgggagtggcggtcgaatttgcctggtgcctccactatattatctgtagtcaggtgtcaaatcccctgctgattggtcacggcgctctgtcaacactgggacttctcctcctggatctagctggagcagtccaaaagactgaagatgcgggtctcgaactgctagcgtgtcccgtgctgcggtgtctaagcaatctgctcactgaggcagcagtggaaactgtgggaggtcaaatgcaattgcgtgatgagcgcgtggtggcggctctgttcatcttactgcaattctttttccaaaaacagccctccctgcttcctgaggggctgtggctcttgaacaatctcactgccaatagcccgtctttctgtacgtcactcctctcactggatctcattgaaccacttcttcaattattacctgtgtctaatgtggtctccgtgatggttctgactgtcttgtgcaacgtggcagaaaaggggcctgcttactgtcagcgcttgtggcctgggcctctgctcccagctctcctccacaccctggccttcagtgatactgaagtggttggtcagtctttagaactgctccatcttctgtttctgtaccagcctgaagcggtccaggtgtttctgcagcagagcggtcttcaagctttggagcgacaccaagaagaagcacagttacaagaccgcgtttatgcactgcaacagacagctctccaggggtag

SEQ ID NO: 60354 - DNA, 357 bp, Artificial Sequence
  Description of Artificial Sequence: Synthetic coding sequence
atgtggtcgaggcgccaaggacggctgagaccaaccgtatgcggcgtggaagaactgaggagacgccgtagagagagggaggctgcgctgagaaaggcgcgtcgggagcagcagctggtctctaaacgcctgcttagaaatgatgcacccgaggaggccggtgaggggtgtgtggccgctatcctaggagaaaccgaggtccagcaatttctccgtcaggcgcagcggggaactgaagaaaaagaaagagagggcgctctggtttcattgcgaagaggcctccagcatccagagacacagcagacctttattcgctctgtgtggatggtatggtggagagaagaattaggattgtag

SEQ ID NO: 60355 - DNA, 762 bp, Artificial Sequence
  Description of Artificial Sequence: Synthetic coding sequence
atgctacaaatgctacaacccggacccaagctgaacccaggcgtcgccgtggaattcgcatggtgtctccactacatcatctgcagccaggtaagtaatccactgttaattggacacggagctctgagcacccttggcctactgttgctcgatttggccggagctgtccagaagacggaggatgccggtctcgaactgttagcgtgcccagtgctgcgctgcctgtccaatctcctcactgaggccgcagtcgaaacggtcggaggacagatgcagctgagggacgaacgagttgtcgctgctctgttcattctgctgcagtttttcttccaaaaacaaccctcactgcttccagagggcctgtggctcctcaacaatttgaccgctaacagcccaagcttctgcacaagcttactctccctggacctaatagagccactgttgcaattacttcccgtctcgaacgtcgtgagcgtcatggttctcacagtgctatgcaatgtggcggagaagggaccagcatattgccagcgcctgtggcctgggccattgcttccagctctgctgcacacactggcattcagcgatacagaagtcgtggggcagtcgttggagttgctgcatctgctgtttctttaccaaccggaagctgttcaggtgttcttgcagcaatccgggcttcaggctttggagcgtcatcaagaggaagcccagctccaagaccgcgtgtacgctttacagcaaactgcattgcagggctag

SEQ ID NO: 60356 - DNA, 903 bp, Artificial Sequence
  Description of Artificial Sequence: Synthetic coding sequence
atgctgcctttacttgccgcactcctggcagccgcatgccctttaccgcctgtgcggggaggcgcagctgatgcaccgggtctccttggagtccctagtaatgcaagtgtgaacgcctcttctgccgatgaacctatcgcacctcgactgctcgcttcagctgcacctggacccccagagaggccaggccctgaggaagcggctgccgcagcggctccttgcaatatatcagttcagcggcagatgctgagctctctgctggtacgctgggggaggccacgcggtttccaatgtgatctcctgctattttctacaaatgcccacggtagagcgttcttcgctgccgcattccaccgggtgggaccgccactgctcatcgaacatctgggcctggctgctggcggagcccagcaggatctcagactgtgcgtcgggtgtgggtgggtgagaggacgtcggacagggagactgagaccggcagccgctccttctgccgcagcagcaacggcaggcgctccaaccgctttgcccgcttatccggcagccgaaccacctgggcctctctggttacaaggggagcccttgcatttctgctgcttagattttagcctggaagagcttcaaggcgagcccggatggcgattaaaccggaagcctatagagtctaccctggttgcgtgttttatgacactggtcatagtagtctggtcggttgctgctctgatttggcccgtcccaatcatcgctggctttctgcctaacggaatggagcagcgcagaacaaccgctagcacaactgcggctacaccagctgctgtaccagcaggaactaccgctgcagctgccgcagctgcagccgctgctgctgctgcggcagtgacaagtggcgtggcaaccaagtag

SEQ ID NO: 60357 - DNA, 2526 bp, Artificial Sequence
  Description of Artificial Sequence: Synthetic coding sequence
atgcctctcgctgcttattgctatctacgtgtggtcgggaaaggaagctatggggaggtaacactggtgaagcatcgtagagatgggaagcaatacgttattaaaaagctcaaccttcgtaacgcttctagccgggagaggagagcagcggaacaggaggcacagttgctcagccagttaaaacatccgaatatcgtcacatataaagagtcttgggaaggcggagacggcttgctgtacattgtcatggggttttgcgaagggggtgatttatacagaaagctcaaggaacagaagggacagctgctgcccgaaaaccaggtcgtggagtggtttgtgcagattgctatggcactgcagtacctgcatgagaagcatattctgcatagggatctgaagactcaaaacgtttttttaacccggaccaacattattaaagttggggatctcggcattgctcgcgtgctagaaaaccactgcgatatggcctccaccttaattggtactccgtattacatgagtcccgaactgtttagcaacaaaccctacaattataaatccgacgtgtgggcgcttggttgttgcgtctacgaaatggctactctgaaacacgctttcaatgccaaggatatgaacagcttggtatacaggataatcgaggggaagctgcctcccatgcccagagactatagtcccgagctggccgaactgatacgaaccatgctttcaaaacggcctgaggagaggccttccgtgagatcgattctgcgtcagccatatataaagcgccagatcagctttttcctggaggccaccaagatcaaaacttcgaaaaacaacatcaagaacggcgactcccagagcaaaccatttgctacagttgtgtcaggcgaagcagagagcaatcacgaggtgattcaccctcagcctctgagtagcgaggggagtcagacttacattatgggggaaggcaagtgtctgtctcaggagaagccccgagccagcggactactgaagtctcccgctagccttaaagctcatacttgtaagcaggacctgtcgaacaccaccgaactggctacaatcagctctgtcaacattgacatcttgcctgccaaaggccgagatagcgtgtccgatggcttcgtccaggagaatcagcctcgatatctggatgcaagcaatgagctgggtgggatctgcagcatcagtcaagttgaggaggaaatgctacaggacaatactaagagttctgcacagcctgagaacctaatccccatgtggagcagtgacatcgtgacgggcgaaaaaaatgaacctgtgaagccgttgcaaccattgatcaaggagcagaaacctaaagaccaatccctggcactgagccctaagctggaatgttctggaactattctggcccatagcaacttacgcctactgggctctagtgactccccagcatctgcttctcgcgtcgcgggtattactggtgtgtgccaccatgcccaggaccaggtcgccggtgaatgcataatcgaaaagcagggtagaatccaccccgacctccagccccacaattccggcagtgagcccagtctgagccgccaaaggaggcagaagcgcagggaacagaccgagcaccggggagagaagaggcaggtgcgacgagatctgtttgccttccaggagtcaccaccccgattcctcccttctcaccccatcgtgggcaaggtcgacgtgacatccacccagaaagaggccgagaaccaacgtcgcgtggtgaccggatccgtcagtagtagccgctcttctgaaatgagtagtagtaaagaccgcccactaagcgccagggaacgaagaagactcaagcagagtcaggaggagatgagctcttctggaccgagcgtgcggaaggcttcattgagcgtcgcaggtcctggcaagccacaggaggaagaccagcccttgccagccagaagactttctagtgattgctccgttacccaggaacgaaaacagatacactgcctctccgaggacgagctgtcttcgtcaacctcctccacagacaagtctgatggcgattacggagagggtaagggccagaccaatgaaattaatgcgctagtgcagcttatgactcaaacgctcaaactcgactctaaagagtcttgtgaggatgttccagtcgccaatccggtctccgagttcaagcttcaccggaagtatcgcgataccctgatcttgcatgggaaagtggcggaggaggcggaagagatccacttcaaagaacttccgagtgccataatgcctggaagcgaaaagatcagacggctggtcgaggtcttgcgcactgacgtgattcggggactcggcgtgcaactgcttgagcaggtctatgatctcctggaagaggaggatgagttcgaccgggaagtacgtctaagagaacatatgggtgagaaatatactacatattcagtgaaggctcgccagctgaagtttttcgaggaaaatatgaacttctag

SEQ ID NO: 60358 - DNA, 486 bp, Artificial Sequence
  Description of Artificial Sequence: Synthetic coding sequence
atggctaaagaggaaccgcaaagcatcagccgcgacctgcaggaactgcagaaaaaactgagtctcctgatcgatagctttcaaaacaactccaaagtggtggccttcatgaagtctcccgttggccaatacctggattctcatccttttctagccttcaccttgctggtttttatcgttatgtctgccgtccccgtagggttctttctgctcattgtggttctgactacactggccgcactgctgggcgtcatcatcctagaggggctggtgatcagtgttggtgggttttctctgttatgcatcctgtgcggtctcggcttcgtatctctcgccatgagtggcatgatgattgccagttacgtcgtggtcagttcgcttatctcctgttggttttccccccgacctctgacacagcaaaatacaagctgcgattttctaccagctatgaaatctgctgaatttgaaggactgtatcaagagtag

SEQ ID NO: 60359 - DNA, 558 bp, Artificial Sequence
  Description of Artificial Sequence: Synthetic coding sequence
atggccaaggaggagccccagagcatcagccgcgatctgcaggagctccagaagaaattatccttgctgattgatagcttccagaacaattcgaagctcccccagcactcaaggattagtctcgactcagatgacggcgtgtcccgattgggatcggccggatcaaaggtggtagcctttatgaagtcacctgtaggccagtacctggactcccatccattcctggcattcacactgctcgttttcattgtgatgtccgcagttccggtgggcttctttctgctgatagtggtcttgacaacactcgctgctcttctgggcgttataatcctggagggactggttatttccgttggtggttttagtctcttatgcatattatgcggcttgggtttcgtttctctggctatgagtggtatgatgattgctagctatgtcgtagtgtcttcgctgatcagctgttggtttagcccaaggcctttaacccagcagaacacctcttgtgatttcctgccggcaatgaaatctgccgagtttgagggcttgtaccaggaatag

SEQ ID NO: 60360 - DNA, 885 bp, Artificial Sequence
  Description of Artificial Sequence: Synthetic coding sequence
atggcagccggtcgactactactctacaccggactgtcgttagccctctgcgctctcggaatgctcgctgttgccatttgctctgatcattggtacgagaccgatgccaggaagcatcgcgacaggtgtaaggccttcaacaccagacgcgtagaccccggtttcatctacaataacaataataatctccccctcagggctagccgctcccgacttgatagatgggaagggaaattgctcagggctaggaaccgaagacaactgttcgccatgtcgcccgcagacgagtgctcaaggcagtacaattctacaaacatgggtctgtggcgtaagtgccacaggcagggatttgacccggaaatcgcagcattgatccggaagggagaaattgagcgctgcacctacatcaagtatcactactcctctgccacaatcccgagaaatctgacattcaacattaccaagacaatccgccaggatgaatggcacgcactgcatttacgccgtatgacagccggatttatgggcatggctgtggctataatcctcttcggttggattataggggtgctgggatgctgctgggacagaggattgatgcagtatgtggccggactcctattcctcatgggtggaactttctgcattatctccctctgtacatgtgtggcgggtatcaacttcgagctgagtcgttatccccgatatctctacgggctacctgatgatatctcccatggatatgggtggagcatgttttgtgcgtgggggggactcggcctgacactgatcagcgggtttttctgcacccttgctccctcagtccagcccgtgcctcgaactaactacccgaagagtaggccagagaacgggaccgtctgttag

SEQ ID NO: 60361 - DNA, 1053 bp, Artificial Sequence
  Description of Artificial Sequence: Synthetic coding sequence
atgaaccttcgcggtctctttcaggacttcaatcctagtaagttcctgatctacgcttgtctacttctctttagcgtgctcctcgccctgcgactggacggcataatccagtggtcatattgggctgtgttcgctcctatctggctctggaagcttatggtcatcgtcggggcttccgtcggcacaggcgtgtgggcccgtaatccccagtatcgcgctgagggggaaacctgcgtcgagttcaaagcaatgctgatcgctgtaggcattcacctgcttctgcttatgttcgaggtgctggtgtgtgacaggatcgaaaggggttcccacttttggctgctagtcttcatgcctctcttctttgtttctccggtgagtgtagcggcttgtgtgtggggcttcagacacgatcgctccctggaactcgaaatcctgtgtagtgtgaacattctgcaatttatcttcatcgccctgcgcctcgacaaaattatccactggccctggctcgtggtgtgcgtaccgctgtggatcctgatgtcctttttatgcctcgtagttctctactatatagtgtggtccgtcttattcctgcgttcgatggacgttattgccgaacagaggcggactcatatcactatggctcttagttggatgacgattgtggtgcccctcctgacatttgagatcctgctggttcacaagctggatggacataacgccttcagctctattcccatcttcgttccactgtggttgtcacttatcaccctgatggctactactttcggccaaaagggtgggaatcattggtggttcggcattcgaaaggacttctgccagtttctcctcgaaattttccccttcctccgtgagtacggaaacataagctatgacctccatcacgaggacaacgaggaaacagaagagactcctgtgccagaaccccctaagatagccccaatgttcaggaaaaaagcccgagtcgtaataactcaaagccctgggaagtatgtgcttccaccacccaagctgaacatagaaatgcctgattag

SEQ ID NO: 60362 - DNA, 876 bp, Artificial Sequence
  Description of Artificial Sequence: Synthetic coding sequence
atgaaccttaggggattgttccaggacttcaatcctcgggctgagggcgaaacttgtgtggaatttaaggcaatgctcatcgccgtgggcattcacctgcttttgttaatgttcgaggtcctggtgtgcgatagaatcgagcgaggatcccatttctggctgctggtgtttatgcctctgttcttcgtaagcccagtaagcgttgcggcttgcgtgtggggcttccggcacgaccggtcgctggagcttgaaattctatgttctgtgaacattctgcagtttatctttatcgccctgagactggacaagatcattcactggccgtggttggtggtttgcgtgcccctgtggatcctcatgtctttcctttgtctcgtagtgctgtactatatcgtgtggagtgtgctattcctccggagtatggatgtcatagctgagcagcgacgcacccacattacgatggcgctcagttggatgacaatcgtggtgcctctgctcactttcgaaatacttctcgtccacaagctggacgggcataacgccttcagtagcattcccatctttgtgcctctctggctgtccctgatcactctgatggccactaccttcggccagaaggggggaaatcactggtggttcggcatccgcaaagatttctgccagttcctccttgagatattcccttttctccgtgaatatggtaatatatcctacgacctgcatcacgaggacaacgaggagacagaggaaacgcccgttccggagccacctaaaatcgctcccatgttcaggaagaaagcccgagtggtgataacccaatctccagggaaatatgtactcccacccccaaagttgaatattgaaatgccggactag

SEQ ID NO: 60363 - DNA, 519 bp, Artificial Sequence
  Description of Artificial Sequence: Synthetic coding sequence
atgtccttcctatgtctggtggtattgtattatatcgtgtggtccgtcttgtttctgcgcagtatggacgtcatcgcggagcagcggagaacacacatcacaatggccctgtcatggatgacaatcgtggtcccgctgctcacgttcgaaatcctgttggttcacaaactggacggacataatgccttctcctccatcccaatctttgtcccattatggctctctctcattacactgatggccaccacctttggccagaagggcggaaatcattggtggttcggcattcggaaagacttttgccagttccttctcgagatcttcccgttcctgcgagaatacgggaatatctcttatgatctacaccacgaggacaacgaagagacagaggagacgccagttcccgagccgccaaaaattgctcccatgtttcgcaaaaaagcaagggtagtcattacacagagtcccggtaaatacgtattacctccgccaaagttaaatatagaaatgccagattag

SEQ ID NO: 60364 - DNA, 1254 bp, Artificial Sequence
  Description of Artificial Sequence: Synthetic coding sequence
atgggtcctaggcaaggacgatggtggctcctgctgtggctgccccctctggccactctccccgtgaggggagaggccgctgctgctgccttgagtgtgcgccgttgcaaagcgctgaaagagaaagacctgatcaggacctccgagagcgactgctattgctataaccagaattctcaggtggagtggaagtacatatggtccacgatgcaagtgaagattacctccccaggattgttccgtatcgtctacatcgcagagcgccacaactgtcagtaccccgaaaatatcctgtccttcattaagtgcgtaatccacaatttttggattccaaaggagtccaacgaaataaccataattatcaacccgtacagagaaactgtttgcttttccgtggagccagtgaagaaaatatttaactatatgatacatgtgaacagaaatatcatggatttcaaactgtttctggtatttgtcgctggcgtttttctgtttttttacgccagaaccctcagccagtcccccaccttttactatagttccggaactgtcctgggcgtacttatgactctcgttttcgttcttctcctggtaaagcgctttattcctaagtactccacattttgggccctgatggtgggctgctggttcgccagcgtgtacattgtctgccagctgatggaagatttgaaatggttgtggtatgagaatagaatatacgtgctgggctacgtcttgatcgtgggcttcttctcttttgttgtgtgctacaagcacggacccctggccgacgacagatcccgttcactcctgatgtggatgctgcgactgttgtccctggtgcttgtgtacgctggcgtggccgtaccgcagttcgcctatgcagctatcatccttttgatgagtagctggtctcttcattaccccctccgggcatgtagctacatgagatggaagatggaacagtggtttacgtccaaggagctcgtggttaagtacctcacagaggacgagtaccgagagcaagctgatgctgaaaccaacagcgccttggaggaacttcggagggcctgtcgcaagcctgatttcccatcttggcttgtggtgagtcgcctgcacactccctctaaattcgcagattttgtgctcggaggctcccacctcagtcctgaagaaatctccttgcacgaggaacagtacggattaggaggagcattccttgaagaacagctcttcaacccatcgacagcttag

SEQ ID NO: 60365 - DNA, 822 bp, Artificial Sequence
  Description of Artificial Sequence: Synthetic coding sequence
atggaaagacgtgaacatctgaccctgactttccactcccctgaggtgcctaaaatcaagggcaataggaagtatcagagaccgaccgtgcccgcaaagaaacatccatcagcctcaatgagctgccagcgacagcagcagctcatggatcaggctcacatatacattcgcaccctgtgcggatcactatgcagttttagcctgctgatgcttattgccatgtcgcctttgaattgggtacagttcctcgtaatcaaaaatggcctcgagttgtacgccggtttgtggaccctctgcaaccacgaattatgctggagccatacgccaaagccaccctattaccttcagtattcacgcgctttcttcctcatttccgtgttcaccattctgaccggcctaggctggctcttttcttcttggattttgaaccgaggctcgatgaccacaaacctggacctgaaggtgtccatgctgtcctttattagtgccacctgtctgctgctctgccttaacctgttcgtggcccaagtgcactggcacaccagggacgcgatggaatcagatttgctttggacatactatctgaactggtgcagcgatatcttctatatgttcgcaggtatcatatctctactcaactacttaacctcaagatcgccagcttgcgacgaaaacgttacagtgattcccaccgaacggtctcgactcggtgttggcccagtgacaacagttagccctgccaaagatgagggcccacgctccgaaatggagtcattgtcggtcagagaaaaaaacctgccgaagtcaggactttggtggtag

SEQ ID NO: 60366 - DNA, 585 bp, Artificial Sequence
  Description of Artificial Sequence: Synthetic coding sequence
atgaaagggctgtaccaggctgctggcagaattttggttacccttggtatcctcagtgtctgttccggtgtcattgcattcttcccagtgtttagctacaaaccatggtttactggttggagcgtaagaatcgcgtgccctatatggaacggcgctttggcgatcacaacgggagtcctcctgctcctggcctacagagagtggacccagcgctacttgggcgaagccacatttacattcgtgatactctccatcatggggtgtcctctccacttcgccatcgcactagaatctgcgttgctgggaccatattgcttttacagttttagtggcattgccggaaccaattatttggggtacgccgttacatttccctacccctatgccaagttccctctggcctgcgtggatccaccccactacgaagagtaccatttgacactgcaagcgctcgatctctgtttatcctttacactgctctgcacatccctgactgttttcatcaaattgtccgctagattgattcagaacggccacataaatatgcaactacccgctggtaacccaaacccattctctccttag

SEQ ID NO: 60367 - DNA, 453 bp, Artificial Sequence
  Description of Artificial Sequence: Synthetic coding sequence
gcatgccctatttggaacggagctttggctattaccaccggcgtgctactgctgttggcgtacagggagtggacgcagcgctatttgggggaggctaccttcaccttcgttatcctctcaatcatggggtgcccgctgcacttcgctattgccctggaatctgctctccttggcccttactgtttctactcgttctctggaatagctgggacaaattacttgggatacgctgtcacttttccatacccttacgctaaattccccttggcctgtgtggacccccctcattacgaagaatatcacctaacacttcaggcactagacctctgcctttctttcaccctactgtgtactagcctgactgttttcattaagctttcggctcgacttatacagaatggacatatcaatatgcagctccccgcaggcaatcccaacccattttctccttag

SEQ ID NO: 60368 - DNA, 876 bp, Artificial Sequence
  Description of Artificial Sequence: Synthetic coding sequence
atggcgaggtcttacggcggacgggtcctcgccgcaatgacgctgctgggcatcgcggcagctgtgctggcagctctgggcgcacagttgctgttccagcttcaggctggccgtgccgagttgagaggactcagagctgagggcctaggacaagaactgggagcaggcccagggctccctgaggatgctgctgggaccctgctccctctcgcagcggcattggcagcactggtcctggtgctcggtttcacatgcctgctgctcgcggctttatgtgggcacctcggggcagagctagctagaggtcctggccctcgcaggtctgactggttcctttacgattgtagattgctgcgccatgtggctcttggcctcttctgctgtgggatttcagtgtacctagcagcccttagcatttatgcactgctgctgttcgaaattgagactggagcagctgccgcttcaatcctggggtcaggcacgctggtcctggttgctgttctcacgcacaccttactgcgtgccgctcgtgccgcaaggaggggactccacgagctgagccctcccagcttcgaagatgatctggctcggcctgcagaggtgtccaaggcatcacctagagcccagcctcagcaaggaatacacagaagaaccccgtactccacctgccctgaacccggtgatccattcggtagcatggcaacagcaacagctcccgcagcacttgaagggggatgggaatcttccctcccagcgtcccgaatgcaccgaaccttgagtgctggccttggacattgggatggcgtaacacatgagatgcgcaggatgctaggccataggccagggagcatgggaaaagattccactttggtctag

SEQ ID NO: 60369 - DNA, 1056 bp, Artificial Sequence
  Description of Artificial Sequence: Synthetic coding sequence
atggctagtgggcgtctaattaagttcgtggtcttcgagctcttggagtttgcagctttcagcattccaacattggttatcactgagcagttcgccactgcatatcaaggaaccagggcgcgttctgataatacacattactggcttatcattagctgctccattgcctacgtcgcattggtcaccctgcttatttgggtgccagtgaaggtcattttacacaagaagaggtacatctatagaaagatcaaagggtggagaccagtcctgatgatgtgcgtcgttcttaccacactgccttgtctgacgtttagcattgctgtgaccgaggtccaaaagtctatcaacggtagcgctgacgtgctgcctgacatgttaccggacctcccagtcagtcttgtgctgctgtctctgattatggtcgatatcatagaaaagcttagaatttaccccctccggggtagccagaaaagttccgagaatgggcatattcactcaacctctctgcagcatatcaagaccgtcactgagcaagtgcgacagtctccagaaaacgcagcatctccccaagctacgaatagtacacaggtgtcccagccaagcggtgccatgacccgtagccaagaaagtgtgtttatgggacctcaagagccatcttgtgattccggcatcctgcgcatgatgtctcggagggatgtgagagccgagctttttctttggagctttttactgtggtctgatactatcgaaatggttcgggtggcaggtcatccgaatgtgtataagtcatcatggctctatccagtgtatattttcagtttcatatctctgctgagaatcacgttcactcctcagaatcccttgctcaatagcttatcggttctgctgcaggacctgcctttcgtttttgtgagactcggattgataatcgcactcggtacaattacacctgtcttgggcctctgcaaaaacatcctcgtgaccttaagttacatctactttaattatttgacccgcattagaatctttagtgcctttgaaatgagccctttctag

SEQ ID NO: 60370 - DNA, 531 bp, Artificial Sequence
  Description of Artificial Sequence: Synthetic coding sequence
atggcagctgctcccgcagtgtgcgccagccaggggtcaccacccggtgctcccagcgctccagctgccgctccagcccctgccgcagggctcggcagatgcaggatggccttattacttgccgtggcgcttgacgtggccggtatggcggctctgctgactggcgtgtttgcccagttgcaggtgcggggacgggactttggcgacctgctaatatacagcggcgcactactggtttttctgtccctcctcggctggattttatggtatacaggcaacatcgagatcagtagacaagaactggaaagggactacgggttgcggccatctgctttagctaggctggccagaaagctgagtaggcgctggagcgctcccgctgctgctggacagcgcccagcccctggttccagacgtgccaggcgagcggcacgggcaccacctccccctgctgcaggctccagaagggtgagactgcaattggccacattagaggccggtcccggagctgccggagctgggtcagaatag

SEQ ID NO: 60371 - DNA, 588 bp, Artificial Sequence
  Description of Artificial Sequence: Synthetic coding sequence
atgcgagttggaacctggatttgcctgcctggccgacccggacggtgcagaaagcagcacgatctgggcaattgcccagaggtccctggaatatttaagacactagctctctcaccaggagccccagatatgatgcagcagcccagagtggagacagacacaatcggcgctggcgaggggcctcaacaggctgttccatggtcagcatgggtgacccgtcacggatgggtccgctggtgggtgagccacatgcccccatcctggattcaatggtggagtaccagtaattggagacagccactgcagcgtctcctgtggggtctcgaaggaattctctacttacttctggcactaatgttgtgccatgctctcttcaccacaggcagtcacctgctgagtagcctctggccagttgtggcggctgtgtggcggcatctccttcccgcattgttactgctggtcttgtctgcactccctgccctcctgtttaccgcctcattcctgctccttttctccacgttgctttccctggtgggcctgttgaccagtatgacgcatcccggagacacgcaggatttggaccagtag

SEQ ID NO: 60372 - DNA, 765 bp, Artificial Sequence
  Description of Artificial Sequence: Synthetic coding sequence
atgactcggctctgcctgcccaggcctgaagctagggaggacccaatcccagttcctcccagaggactgggcgcaggcgaagggagtggatcaccagttagaccccctgtgtcaacttggggcccatcttgggcccagcttctggattccgtactgtggttgggcgctcttggcttgacaattcaggcagtgttctccaccactgggcctgctctgttgctcctgctggtgagctttcttaccttcgacctgctgcaccggtgtacacggcatgacgccgctgcggcatctggagatagatatcatcgcggttggcgcggtgcgactgccggttctgccttggtgtctctgggccacgaagcttggctgggagccctcgtgggggagcctcacgcaccagaactggatccagtggtggagcatctcgagctggctgctacggctgctgcacccgcagtaggcagtgggggagacacattacccgcagcaggcaccgacgtggttccctgcacacttcaccattggctgccccctgccgagttgctggtggcctgtcggggtcgaggcgtcgctccacctgcaaccggaagtccagccgctggtgctcaatgttcggcctgccccccactgcatgggttattgccggcagctcttctgcacaccgccgaaccttgcggtcctccccacctgcatgactctcctcggagacatagcggtttcggctcaatcgagggacagccacacccaacggcatgcgtatgttag

SEQ ID NO: 60373 - DNA, 459 bp, Artificial Sequence
  Description of Artificial Sequence: Synthetic coding sequence
atgatgcagcagccaagggtggagacggatactatcggcgcaggagaagggcctcaacaggccgtgccctggtccgcgtgggtgactcgacacggctgggttcggtggtgggtttctcatatgcccccatcttggatccagtggtggtcgacgagtaactggcgccagcccctccaacggcttttgtgggggcttgagggcatcctatatctgttgcttgccttaatgttgtgtcacgctcttttcaccaccggcagccacctcctctcctcactctggcctgtggtcgctgccgtttggaggcacctgctgcctgcactcctcctcctagttctcagtgcactgcccgctctgcttttcacagccagcttcctgcttctcttcagcaccctgttgagtctggtcggactgttgacttccatgacccatcccggagacacccaggatcttgaccaatag

SEQ ID NO: 60374 - DNA, 969 bp, Artificial Sequence
  Description of Artificial Sequence: Synthetic coding sequence
atggcactacccccaggacccgctgcattgagacataccctgctgctgctgccagcattgctttcttctggttggggcgaactggagccccagattgatggacaaacatgggcggagcgggctctgagggaaaacgaacgacatgcgtttacctgcagggtagccggtgggccaggaacccccagactggcctggtatctagacggccagttgcaagaagcttccacgtcccgccttttgagtgtcggcggagaggcgttctccgggggaacctccacctttacagtgacagcacaccgagcccagcacgaattaaactgctctctgcaggatcccagatcgggccgatctgctaacgcctctgttattctcaatgtgcaatttaaacctgaaattgcacaggtcggggctaaataccaggaggcccaaggaccgggtctgctggtggtattgttcgcactcgtgcgggcaaaccccccagctaatgtgacttggattgaccaggacgggcctgtaaccgtgaatacaagcgattttctggtgctggacgctcagaactacccctggctaacgaaccatacagtgcaattacagcttcgttcccttgcccataatctgtcagtggtcgcaacaaacgacgtcggcgttacctccgcatccctcccagcccctggaccaagtaggcatccaagcctgatttcatctgattcaaacaacttgaaactcaacaatgtgcgattgcctagagagaatatgtcactgcctagtaacctacaactgaatgatctgaccccggattctagggccgttaaaccggctgaccgccaaatggcccagaataacagtcgcccagaactgctggacccagagcctgggggattactgacgagccaaggattcatcaggttaccagtcctgggttacatataccgggtcagcagcgtctcaagcgacgaaatctggctgtag

SEQ ID NO: 60375 - DNA, 969 bp, Artificial Sequence
  Description of Artificial Sequence: Synthetic coding sequence
atggcattgcctcccggtcccgctgcccttaggcacacgttactcctgttgccagccctgctgtctagtggttggggtgagctcgagccacagatagatggtcaaacctgggctgagcgcgcactcagggaaaatgaaaggcacgcatttacctgccgagtcgctggaggacctggaacccccagacttgcatggtacctggacggacagctccaggaggccagtacgtccagattgttgtccgttgggggtgaggcgttttctggtggaacttcaacctttactgttactgcccacagggcacagcacgagcttaactgttctctgcaggatccacggagcgggcgaagtgccaatgcctcagtgattcttaacgtgcagttcaaacccgaaatcgctcaggtgggggctaaataccaggaggcacaggggccaggcttgctggtggtgctgtttgctctagtgcgtgcaaatcctccggctaacgtcacctggatagatcaggacggccctgttacggtgaacacatccgattttctcgtcctggatgcccagaactacccatggttgaccaatcacaccgtgcagctgcaattacgatctcttgcacacaatctgtccgtggtcgctaccaacgacgtcggtgtgaccagcgcaagtctgcccgcacctggacccagccgacatccttccctgattagctcggatagcaataatctgaaactcaacaacgtcagactgccacgcgagaacatgtcactgccaagcaacctgcaactgaacgacctcaccccggacagcagagccgtcaagcccgcagatcgccaaatggcccagaacaattcgcgtccggagctgctggaccccgaaccaggcggactgctcacatcccaaggattcatacgcctaccagtgttggggtacatttacagagtttcgtccgtgagcagcgacgagatttggctctag

SEQ ID NO: 60376 - DNA, 660 bp, Artificial Sequence
  Description of Artificial Sequence: Synthetic coding sequence
atggccgctgaagaccgtgaaatgatggaggctagaggagcaggggagtcatgtcccacgttccccaaaatggtccctggcgacagtaagtctgaaggcaagccaagagcatatctggaggccgagtctcagaagcccgatagctcctacgattaccttgaggaaatggaagcttgtgaagacgggggatgtcagggccctctgaaaagcctctcccccaaaagctgcagggccactaagggccaggctggggatggtcccaagcctgccgagctgcctccaacaccgggtacagaacgtaatccagagatggaactggagaaagtgcggatggagttcgagttaaccagactgaaatacttgcatgagaagaaccagaggcagcgccagcacgaagtggtgatggaacagctgcagagggaacgccagcatgaagttgtaatggaacagcttcagcaggaggcagccccaagactgttctctggaggtctgcaaaactttctgctgccccagaaccagttcgcaatgtttctgtactgctttattttcatccatatcatatacgtgaccaaagagatggtcttttttctattcgcaaaacattacctgttttgtatcgctgcaatcttactttgcttgattaaaaccttctggtcttag

SEQ ID NO: 60377 - DNA, 1320 bp, Artificial Sequence
  Description of Artificial Sequence: Synthetic coding sequence
atgggggaagctcctagccctgcccctgcgctgtgggactgggactacttggaccgctgcttcgccagacaccgggtgtgcattagtttcggactgtggatctgtgcaagttcctgctggatcgccgctcacgcgctgctcctgtacctgcgctgcgcacagaaaccaagacaggaccaatccgcactgtgtgctgcgtgttgtttactcacttctttgtgcgacactgtgggggctcttctcgctcggcagctgaccattcaggtgtttaccggcgcttacctggcagccattgacctagttaatttcatgttcatcctctttcccgtctgcggctcaaagttcaagagcaactctgacagagaggctagggagcgaaaacgaaggcgtcaactgcgcgcaagtgtcttcgccttagccctgccactcagcctggggccttgttgggctctctgggtcgccgtgcctaaggccagtgcaacaatcagggggcctcagaggcggttgctggcctccttactgcaagagaacacagagatcctgggttacctgctcggttccgtggccgcattcgggtcttgggcgtccagaattccgccactgagccgtatttgtaggggtaagacattccccagtatacacctgtggacacggctcttgagtgcactggcgggtctgctgtatgcatcagcgattgtcgcccatgatcagcatcccgagtacttacttcgggctacgccatggtttctcacctccctgggccgtgcagcactcgacctggcgataatcttcttgtcctgcgtgatgaaatccaagatgcggcaagccctgggattcgccaaggaggcaagagaaagcccagatactcaagcgctcttgacatgtgctgaaaaagaggaggaaaaccaggagaatctcgactgggtacctctcacgaccttaagccattgcaaatctctacgaaccatgacagccattagccggtatatggaactgactattgagccggtgcagcaggcaggctgcagcgccactcgtctccctggggacggacaaactagcgccggtgatgcatccttacaggatccaccttcctacccgccagtgcaggtcattagggctcgagtatcctcaggtagctcctctgaggttagttctatcaactctgacctagaacaaaagtattgggaggccttaaactccgagcagtgggacccagaagacgtgaaccttgaaggctccaaggaaaatgtggaacttttgggcagtcaggttcaccaagattccgtgagaacagcccatctctccgacgatgactag

SEQ ID NO: 60378 - DNA, 342 bp, Artificial Sequence
  Description of Artificial Sequence: Synthetic coding sequence
atgttcattctctttcccgtttgtgggtccaagttcaaatctaactctgatagggaggctcgcgagcggaagcgcagaagacagctcagggcctcggtgttcgccttggcgctcccgctgtctctcggcccttgttgggctctgtgggtcgctgtgcctaaggcttctgccacaataaggggacctcagaggaggctcttagccagtctgctgcaggagaatactgagattcttggctaccttttggggagcgttgccgcttttggctcttgggcgagcaggatcccgcctctttcaaggattgtccgacctggcgtaggcatgggactttgggtgacatag

SEQ ID NO: 60379 - DNA, 1287 bp, Artificial Sequence
  Description of Artificial Sequence: Synthetic coding sequence
atgggagaggctccctccccagctcctgctttgtgggattgggattatctggacaggtgtttcgcacgacatcgcgtctgcattagcttcggactttggatctgtgcaagttcctgctggatcgcagctcacgctctgctgctctatctcagatgcgcccagaaaccacgccaagaccagtcagctttatgcgccgcttgttgtttgctgacttctctttgtgatacagtgggggcattgctagctcggcagttgaccatacaggtgttcactggcgcatatcttgcagcaattgacctcgtgaattttatgttcatattgtttcccgtatgtggttctaagttcaagtccaatagcgacagagaagctagggagaggaagcgcagacgacagttaagagctagcgtgttcgcactagccctccccctgtccctggggccttgctgggccctgtgggtggccgtacctaaagctagcgcaacgataaggggcccacaacgtcgactgctcgcctctctcctccaggagaataccgagatcctgggctacttgctgggaagcgtggcagcattcggaagttgggccagtagaatcccacctcttagtaggatctgtagaggcaaaaccttccctagtattcatctttggacacgtctcctgagtgctttagctggattgttatatgcatccgcaattgtggctcatgaccagcatcccgagtacctgctgcgggcaaccccttggttcctgacttccctgggcagagcagccctggacctggcgatcattttcctgtcgtgtgtcatgaaatcaaagatgcggcaggctctggggtttgctaaggaagctagggagtctcctgatacacaggccctgctcacatgcgctgagaaggaggaagagaaccaagaaaatttagattgggtacccctgactaccctcagtcattgtaagtcactgagaacaatgacagctattagcaggtacatggagttgaccatcgagcctgtgcagcaggccggttgtagcgccacacgcctgcccggagacgggcagacttccgctggggacgccagcctgcaggaccctccctcttaccctccggtgcaagttatcagagctcgcgtctccagcggaagctctagtgaagtaagttccataaactcggacttagagtgggacccggaggacgtgaatcttgaggggagcaaggagaacgtcgagctgctcggctcccaggtgcatcaggattcagtcagaaccgctcatctctcggacgatgactag

SEQ ID NO: 60380 - DNA, 1191 bp, Artificial Sequence
  Description of Artificial Sequence: Synthetic coding sequence
atgggcgaagcgccatcacctgcccctgcattgtgggactgggactacttggatcgctgctttgcccgacacagagtatgcatttcctttggcctatggatatgtgctagtagctgctggatcgccgcacatgccctcctattgtatctgagatgtgcacaaaaaccccgacaggaccaaagcgccctctgcgcggcatgctgcctactgacctctctatgtgacacggtgggtgctctgctggcaagacaattaactatacaagtgtttactggcgcttatctagcagctatagatctggtaaacttcatgtttatcctgttcccagtctgcggctctaaattcaagtcgaattcagatcgggaggccagagagcgaaaacgacgaagacaactacgtgcctccgtatttgcccttgcattgccattaagtcttggaccctgttgggccctttgggtggctgttcccaaagcctctgcaacaatccggggacctcagcgtcgattgctggcaagtctgctgcaggagaataccgagatccttggctatttactggggtccgtagccgctttcggctcctgggcctctagaattcccccacttagccggatctgccggggaaagaccttcccaagcattcacctctggactcggttgctcagtgctctggccggtctcctgtatgctagcgcaattgtggcccatgatcaacatcccgaatacctcctcagggctacaccttggtttttgacatctttgggccgagcagcgctggaccttgcaattatatttctgagctgtgtgatgaaaagcaagatgagacaggcgctgggatttgccaaagaagcacgcgagagccctgatacccaggccttgctgacgtgcgccgaaaaggaggaggaaaaccaggaaaatctggactgggtgcccctgactactctcagccactgtaaaagtctacgtacaatgactgccatcagtcgttacatggagttgacaatagaacccgttcagcaggccgctgttcctcctggctgtcaggtcacaggaaggagagcgcctgaaatgcgtccctgtcgcacaccacgcagaacgctgccattccgttcctctggacctggttgcttgccagccgcaccattgcgctcgccgccatcgacccctacttggtctggtacgttgaaaatgtag

SEQ ID NO: 60381 - DNA, 1428 bp, Artificial Sequence
  Description of Artificial Sequence: Synthetic coding sequence
atgggggaagcgccatccccagcccctgccttgtgggattgggattacttggatagatgtttcgcaagacaccgtgtgtgcatctctttcgggctctggatttgtgcttctagctgttggattgccgctcacgcactgctgctatacctcaggtgcgcccagaagcctagacaggatcagagcgcgctgtgtgcggcttgttgtctgctcaccagtctttgcgatactgtcggagccctgctggcaaggcagttaacaatccaggtttttaccggggcatatctggccgcaatagatctggtcaacttcatgttcattctgtttcctgtgtgtggctcaaagttcaagtctaatagcgaccgagaggctagagagagaaaacggcgtcgccagctgagagcctcagtgttcgctctagccttgccgctctccctgggaccgtgttgggcattatgggtggccgttcccaaggcctctgctaccatccggggtccccagcggaggttattggcgagcctgctccaagagaacacagaaatcttgggctacctgttaggttcagttgctgctttcggaagctgggccagtcgaatcccaccgctgagtcgcatagcacccccacctactctcggtattactacgcagcacgagatttggagaggacaaatgtcaaaacctagtcaatccccctcaaggagtccttccggacattggcgggctgccgcacaaagacaggtcttggggacagaaatgtgtagaggaaagactttcccttccattcacctctggaccagactgttatcagctctagcgggattgctatatgcaagcgcaatcgttgcccacgatcagcatccagaatatctgttgcgcgcaacaccttggtttcttacctcgttgggcagggcagcccttgatttagctatcatttttcttagttgcgttatgaaaagcaagatgcggcaagccctgggattcgcgaaggaagccagagaaagccctgacactcaggccctgctgacttgcgctgaaaaggaggaagagaaccaggaaaacctcgattgggtgcctcttacgaccttatcgcattgcaaatcccttcggacgatgacagccatctcacggtacatggaattaacaatcgagccagtgcagcaagcaggttgttccgccacacgccttccaggcgatggccaaacttccgcaggtgatgcctctctgcaggacccgcctagttatccacccgtgcaggtgatccgagcacgcgtttccagcggatcctcctctgaagtgtctagtattaacagtgacctggagtgggatcctgaggacgtaaatctcgaaggttctaaagaaaacgtggaattgttagggtctcaggtgcaccaagacagtgtccgaacggcgcacttgtccgatgatgattag

SEQ ID NO: 60382 - DNA, 1317 bp, Artificial Sequence
  Description of Artificial Sequence: Synthetic coding sequence
atgggtgaggcacctagcccagccccagcactctgggattgggattatcttgaccggtgttttgccagacacagggtgtgtatctcatttggactgtggatctgcgcaagctcatgttggattgctgctcacgctttgttgctctatctgaggtgtgcccagaaaccaaggcaggatcaatccgccctatgcgccgcatgctgcctactgactagtctgtgtgacaccgtgggggctctgctcgctcgccaactcactattcaggtatttaccggtgcctacctggctgctatcgatctggtgaacttcatgtttattctctttcccgtgtgcggttctaagtttaaaagcaatagcgaccgggaggcacgggagcgaaaacgcagacgacaactgagagcatccgttttcgcccttgccttgccattaagcctcggcccatgctgggccctatgggtggcagtgccgaaggcatctgctaccattcgaggccctcagcgtagactcctggctagtctgttgcaagagaacactgagatactgggatacttactgggcagcgtcgcagccttcggcagctgggcatcacgcatccctccactgtctaggatttgtaggggcaagactttcccatcgatccacctttggacgaggttactgtcagcccttgcagggctcctctatgcaagtgctattgtcgctcacgatcaacaccccgagtaccttctccgtgctactccatggtttctcacaagccttgggcgagccgcacttgacctggcaataattttcctgtcatgcgtgatgaagtcgaagatgaggcaggcgctgggatttgccaaagaggccagggaatcacctgacacccaagccctgctcacgtgtgctgaaaaggaggaggaaaatcaggagaatctagattgggtccccctcactactctgagccactgcaaatcgttgcggaccatgacagccatctcgcggtacatggaactgactatagagcctgtccaacaggccggatgcagtgccacgaggttacctggcgacgggcagacatcggccggagacgcttccctgcaggatcccccttcatacccccctgttcaggtgatacgagcaagagtatctagcggatcatcttctgaagtctcctctatcaattctgaccttgaaaagtattgggaggcgctgaactctgaacagtgggatcccgaggatgtcaatttggagggcagtaaagagaacgtggagctgcttggatctcaggtccaccaggattccgtgagaacagcacatctgagcgatgacgactag

SEQ ID NO: 60383 - DNA, 477 bp, Artificial Sequence
  Description of Artificial Sequence: Synthetic coding sequence
atggcaggatttttggataactttcggtggcccgagtgcgaatgcatcgactggagtgagcgtcgcaacgcggtagcctcggtggtggccggaatactattctttacaggttggtggatcatgatcgatgctgcagtagtgtacccaaaacccgagcagctcaaccatgcgttccatacttgcggtgtgttctctacccttgccttcttcatgataaatgccgtcagcaacgctcaggtgagaggtgattcatacgagtccggttgtctgggaagaaccggggctagagtttggctgttcattggcttcatgctgatgttcggatccctcattgcaagcatgtggatcctattcggggcttacgtgacacagaacactgacgtgtaccctgggcttgccgttttctttcagaatgcactgatatttttctctactctgatttataaatttgggagaacagaagaactctggacctag

SEQ ID NO: 60384 - DNA, 831 bp, Artificial Sequence
  Description of Artificial Sequence: Synthetic coding sequence
atgtaccgcatatcccagcttatgagcacccctgtggcttcttcttcacgccttgagcgcgaatatgccggtgagctgtcacccacatgcattttcccatcattcacttgtgattcactggacggctaccactctttcgaatgcgggagcattgatcctctgaccggctcccactacacgtgtaggcgaagccctcgcctgctgacgaatggatattatatctggacggaggattcatttctgtgcgacaaagacggaaatattactctcaacccatcacagaccagtgtgatgtacaaagagaacttagtgagtaccagcaaatcctggctacatggctcgatctttggcgacataaacagtagtccatccgaagacaattggctgaaggggacccgacgcttggacacagatcattgcaacggaaacgctgatgacttggactgttcaagtctgacggatgactgggagagcggaaaaatgaacgccgagtcagtcatcacctccagttcctcacacatcatctctcagccccctggcggaaatagccatagcctgtccctgcagtcccagctgactgcatctgagcgattccaggagaactcatcggaccacagtgaaaccagactgctgcaggaggtcttcttccaggctattctgctcgccgtctgcctgatcatcagtgcttgcgctcgctggtttatgggcgagattctggcttctgttttcacgtgtagcctcatgatcacagtggcctatgtgaagtcgctattcctgtcattggcctcctactttaaaaccacagcatgtgccagatttgtcaagatttag

SEQ ID NO: 60385 - DNA, 699 bp, Artificial Sequence
  Description of Artificial Sequence: Synthetic coding sequence
atgtataggattagccagttaatgtctacaccagtggcctcgagttctaggctggaacgagagtatgcaggagagctgagccctacttgcatctttccttcttttacctgcgatagcctggacggataccattcatttgagtgcgggagcattgaccctctgactggatcccactacacgtgtagacgatcacctcgcctgttgactaacgggtactacatttggaccgaagattccttcctgtgcgataaggacggaaatataactctaaaccctagtcagacaagcgtgatgtataaggagaatcttgttcggatttttagaaaaaaaaagcgcatatgccactcattttccagcctattcaatctatccacaagtaagtcctggttacacggcagcatcttcggagatattaattcatcccctagcgaagacaactggcttaaagggacaagaaggctagataccgaccattgtaatggtaatgaaacccgcttattacaggaggtctttttccaggcgattctccttgcagtttgtcttattatttcagcttgtgcacggtggttcatgggagagatacttgctagcgtgttcacctgcagccttatgatcacagtggcctacgtgaaatctctttttcttagcttggcaagctactttaagaccacagcatgcgccaggttcgtgaagatttag

SEQ ID NO: 60386 - DNA, 300 bp, Artificial Sequence
  Description of Artificial Sequence: Synthetic coding sequence
atgtacaggatatcccagcttatgtcgactcctgtagcctcgtcctcaaggctggagcgggaatacgccggtgaactttcccctacgtgcatcttcccatctttcacctgcgacagcctcgacggttaccactcatttgagtgcgggtcaatcgatcctctcactggaagccactatacctgtcgtaggtccccacggctgctgacgaacggttattacatctggaccgaggatagcttcctttgcgacaaagacggaaatataacattgaatcccagccagacatccgtaatgtactag

SEQ ID NO: 60387 - DNA, 279 bp, Artificial Sequence
  Description of Artificial Sequence: Synthetic coding sequence
atgtaccgcatttcccaactgatgtctacccctgttgcttcatccagccgcctggaacgcgagtatgccggagagttaagccctacttgtattttccccagctttacatgtgactctctagacgggtaccattccttcgagtgtggaagtattgatcctctgacaggcagccactatacctgtaggagaagccccaggctgctgacaaacgggtattatatttggacagaggactcattcctttgcgacaaggacggcaacatcacccttaacccttag

SEQ ID NO: 60388 - DNA, 666 bp, Artificial Sequence
  Description of Artificial Sequence: Synthetic coding sequence
atgggtaccctggtggctaagttgctcctaccaacgctaagctccttagctttcttgcccactgtgagcatcgctgctaagcggcgatttcatatggaagccatggtttacctgtttaccctcttcttcgtggctttgcatcatgcttgtaacggtccaggcttgtcagtgctgtgctttatgagacatgacatcttggaatatttctccgtgtacgggaccgcactctccatgtgggtttcccttatggccctggcagactttgatgagcccaagcgcagtacttttgtgatgtttggagtcctaactattgccgtccggatttatcatgaccgttgggggtatggggtatactcaggtcctatcggaacagccatactgatcattgcagccaaatggctccaaaagatgaaggagaagaaaggtctgtacccggataaatcggtctatacccagcagattggaccagggttatgttttggcgcactggcgctaatgctacgcttcttttttgaagactgggactacacgtatgtgcactccttctaccattgtgctctcgccatgagtttcgtcctcctcttgccaaaagtgaacaagaaagccggatcacccggtacacccgctaagctggattgtagtacactgtgctgtgcgtgcgtgtag

SEQ ID NO: 60389 - DNA, 555 bp, Artificial Sequence
  Description of Artificial Sequence: Synthetic coding sequence
atgtggagactggcacttgggggagtattcctcgccgcagcacaggcctgcgttttttgcagacttcctgcacatgatctgtccggcagactcgcccgtctgtgttcacagatggaggcgagacagaaggagtgtggcgctagcccggattttagcgcttttgccctggacgaggtgtcgatgaacaaggttaccgaaaagacccaccgagtgctgcgtgtgatggaaataaaagaggccgtgtcctccctgccctcttattggtcttggctccgaaagaccaagctgcctgagtatacacgggaagcattatgccctcctgcctgccctcttccgctgctctctcctgccggaggatccacaactctttacaactgctctacgtgcaaaggtacggaggtgtcatgctggccccgaaagcgatgtttcccaggcagccaagatctttgggaagccaagatcctgctgctgagcatctttggcgcttttctgctgctcggtgttctgagcctcctagtcgaatcacaccatctgcaggcaaaatcggggctgtag

SEQ ID NO: 60390 - DNA, 612 bp, Artificial Sequence
  Description of Artificial Sequence: Synthetic coding sequence
atgtggcggcttgcgctgggaggtgtattccttgccgcagctcaggcgtgcgtgttctgtcgccttcctgctcacgatctttcaggcaggctggctaggctctgctcccaaatggaagccagacaaaaggagtgtggagcctcacccgatttttccgcctttgcactggatgaggtgagcatgaataaagtaacagaaaaaacacatcgagtactgagggtcatggagatcaaagaagccgtgagttctttgccgagttactggtcatggctgaggaaaacaaagctcccagaatacactcgggaggctctctgtccaccggcatgtagagggtctacaactctatataattgcagcacatgcaaggggactgaggtgagttgttggccacggaagagatgcttcccaggctccctggggtctcaagatagcgctcccctccacttaaggtcatttcccgcttcagggtgtagtgaaccaccaggaggcgtgccacccccaccttccaagaagtggctcgtcaagacactgaagacttcccagccgcctgctctgcgagggatgcattctcaattgccacacccccttgaaggcaatcagagcgccccatag

SEQ ID NO: 60391 - DNA, 1755 bp, Artificial Sequence
  Description of Artificial Sequence: Synthetic coding sequence
atgccaggcagaacatgggaactatgcctgcttctgctgctgggactgggactcggcagtcaggaagccctgcccccaccatgcgagtcagagatctattgtcacggagagctgttgaaccaggtacagatggccaagctgtaccaagacgacaaacaattcgtggatatgccattgagcattgcaccagagcaggtgcttcagaccttcacagagctcagccgggatcacaaccactctattcctcgggaacagttacaagccttcgtgcacgagcatttccaggcaaagggacaagagctgcagccatggacgccagccgactggaaggatagccctcagtttttacagaagatcagcgatgctaaacttcgtgcatgggcaggtcagctccaccagctttggaaaaaactcggaaagaagatgaaacccgaggtgcttagccatccagagcgtttttctctgatttattcagagcacccctttatcgtgccaggagggcgatttgtagaattttattactgggactcttactgggtgatggagggcttgttgcttagcgagatggctgagaccgtcaagggcatgcttcagaatttcctggacttagtcaaaacgtatggacacgtgcccaatgggggacgagtctattacctccagaggtcacagccccctcttctcactctaatgatggattgctatctgacccatacaaatgataccgcctttctccaagagaacatcgagacattggcactagagctggacttctggactaaaaatcggaccgtatctgtaagtcttgagggaaagaactacctgctgaatagatattatgtgccctacggaggtcccagacctgagtcatattcaaaagatgttgagctggctgacacccttcccgagggagaccgcgaggccctctgggcagagctcaaagcaggcgcagagagcggttgggatttctccagccgttggctgatcggcggaccaaaccccaattccctctctgggattagaacatccaagctcgttcctgtggacttgaatgccttcctgtgccaagccgaggaattaatgtctaatttctactctcgactcgccggtaacgactctcaggctaccaaataccggattctcagatcacagagactagcggcactgaacacagtcctgtgggacgagcagaccggggcttggtttgactacgatctcgaaaagaaaaagaagaatcgagaattctacccctcaaacctgacacctttatgggcgggatgtttttctgacccgggtgtggctgataaagccctgaaatatctcgaggataaccgcatcctcacgtatcaatacgggatccctacatcccttcagaaaaccggccaacagtgggatttccctaatgcatgggcgcctttgcaggacctcgttattagaggcttggcgaaggcacctctccgaagagctcaggaggtggcgtttcagctcgcccagaactggatacggactaacttcgatgtctactcccagaaatcagccatgtacgagaagtatgacgtgtccaacggcggtcagcccggagggggtggcgagtacgaggtgcaggagggatttggttggaccaacggcgtggtgctcatgctgctcgatagatacggtgatcgccttaccagcggagctaagctcgcatttctcgagcctcattgcctcgcagctacactgttaccctcactcctcctctctctattgccatggtag

SEQ ID NO: 60392 - DNA, 2715 bp, Artificial Sequence
  Description of Artificial Sequence: Synthetic coding sequence
atgcctcaactgctcagaaacgtgctgtgtgtgatagagacttttcataagtacgctagtgaagactccaatggagctacactgacaggtcgcgagctgaagcagctcatccagggagagttcggtgatttctttcagccgtgcgtgttgcacgccgtggaaaaaaattcaaatctgttgaatattgactccaatggaatcatcagttttgacgaattcgtgctggccattttcaatttactgaacctgtgctacctggatattaagtctctgctttcatcagaactcaggcaggtcaccaaacccgagaaagaaaagctggacgacgtcgacgtgcaggcgacaacaggggacggccagtggacagtcggtaccagtcctacgcaagaaaagcggatgctgcctagtgggatggccagctcctcccaacttatacccgaggaaagtggtgccgttggcaacaatagagtggacccttggcgagaggcgaaaacccacaactttcctggggaagccagcgagcataacgacccgaaaaataaacatctggagggcgatgagcagtctcaagaggtggcccaagatattcagacaaccgaggacaatgaggggcagcttaagacaaataagcccatggccggatctaagaaaacatcctcgccaacggagcggaagggacaggataaggaaatctcccaggaaggcgatgagccagccagggagcagagtgtgtctaagattcgcgaccagtttggagagcaggagggcaatctggctacccagtcttctcctccaaaagaggccacacaacgtccctgcgaggatcaagaggtgcggaccgagaaggaaaagcacagtaacatacaggagcctcccctccaacgcgaggatgaaccatcatcccagcacgccgatttgcccgaacaagccgctgctagaagccccagtcagactcagaaatccacggattctaaagatgtttgccgcatgtttgatactcaggaacctggaaaggatgccgatcagactccagctaagacaaagaaccttggagaacccgaggactacggaaggactagtgaaactcaggaaaaagagtgtgagacaaaggacctcccagtgcagtacggttcacgcaacggctcagagacatctgatatgagggacgagaggaaagaacgcaggggacccgaggctcacggaactgccggtcagaaagagcgcgacagaaagacacgccctcttgtccttgaaacacagacccaggacggcaaataccaggagctgcagggcctttcgaagtcaaaagatgccgaaaagggtagcgagacgcagtacctcagtagtgagggcggagatcaaacccacccggagttagagggcacggcggtatctggagaggaggcagagcatactaaggaaggtaccgcagaagcattcgttaactccaagaatgcccctgccgctgagcgaaccctcggcgcacgcgaacggacccaggacctggcacccttagagaaacaatctgtcggggaaaacacccgggtgaccaagacgcacgatcagcccgttgaggaggaggacgggtatcagggggaggatcccgaatcgccctttacccagtccgatgagggcagttcagagacaccaaatagtcttgctagtgaagaggggaatagtagctctgagaccggcgaactccctgttcaaggcgactctcagtcacagggcgatcagcatggagaatctgtccaaggtggacacaataacaatcccgacacacagcggcaggggacccctggcgaaaaaaatagggccctggaagctgtcgtgcctgccgtgcgaggtgaggatgtgcagcttaccgaggatcaggagcaacctgctaggggtgagcataagaaccagggcccaggtacaaaggggccaggcgctgcagtcgagcccaacggacacccagaggcccaggaatccactgcaggagacgaaaataggaaatcgctcgaaattgagatcactggcgcactggatgaggactttaccgaccagctgtcactcatgcagctacccggaaagggggacagcaggaatgaactgaaagttcaaggtccctcttctaaggaggagaaagggcgagcaactgaagcccagaacacgcttttggaatccctcgatgaggacaatagcgcttcactgaaaatccaactggagaccaaagagcccgtcaccagtgaagaagaagacgagtcccctcaggagttagcgggagagggaggggaccagaaatcaccagccaaaaaggaacataacagttccgtgccatggagctcactggaaaaacagatgcaaagggatcaagaaccttgcagtgtggagaggggtgccgtctactcatcacccctttatcagtatcttcaggagaagattctgcagcagactaatgtgacacaggaggagcaccagaagcaggtccaaattgcccaggcttcgggtcccgagctgtgttctgtgagtctaacaagtgagattagtgactgttctgtcttcttcaactactctcaggctagtcaaccctataccaggggacttcccctggatgagagcccagctggcgctcaagaaactccggctcctcaagcgctggaagacaaacaggggcacccacagagagagaggctggtccttcagcgggaggcaagcaccaccaagcaatag

SEQ ID NO: 60393 - DNA, 1248 bp, Artificial Sequence
  Description of Artificial Sequence: Synthetic coding sequence
gagatcgccaagcagctccaagcggtaaaacggaaaatacgcgacgaatctctatgtcctcagcaccatgaagccctctcgcttttctgctacgaggatcaggaggcagtgtgcctcatttgcgccatttcccacacgcatagagcccatacggtggtaccactggatgatgcaactcaggagtacaaggagaagttacagaaatgccttgagcccctggaacagaagctccaggagatcactcgatgcaaatcctcagaggagaaaaagccgggtgagcttaagcgcctggtagagagtaggaggcagcagatcctccgcgagttcgaagaactgcaccgtaggctcgacgaggaacaacaggttctgctgagccggctagaagaagaagagcaagacattctgcagcgtcttcgggagaacgccgctcaccttggtgataaaaggagggatctggcgcacctggccgctgaagtcgaaggtaaatgcctgcaatccggctttgagatgctgaaggacgtcaagtctaccttggagaaatgcgaaaaggtgaagaccatggaggtgacctcagtgagcatcgaattagaaaagaacttcagcaactttccgagacagtactttgcactgcggaaaatactgaagcagctgattgcggacgtgacactggaccccgagaccgcccaccccaacctcgttctgtccgaggacaggaagtcagtgaaattcgttgaaacaaggctcagggatttacctgatacaccgcgacgctttacattctatccgtgcgtcctagccactgaaggttttacatctggtcgacactactgggaggtggaggcagcccactgcgttctcgcccaggaccccgaaaaccaagcactggccaggttctattgttacacggaaaggaccatcgccaagcggttggttctccgacgggatcctagcgtgaaaagaacgctgtgtcgaggatgttctagtttgctcgtacctgggttgacatgtacccagcgacagcgacggtgtcggggtcagcgttggaccgtgcagacctgtctgacatgtcagcggtcccagcgtttcttaaatgaccccggtcatttactgtggggtgaccggccagaagcacagctgggttcacaagcggattctaagcccctccagcccttgcccaatacagcgcactcaatctctgatcgcttgcccgaggaaaagatgcagacacagggtagcagtaaccagtag

SEQ ID NO: 60394 - DNA, 1602 bp, Artificial Sequence
  Description of Artificial Sequence: Synthetic coding sequence
atggaggagaagggctcaaaaagaggactggaggctgcaggcaaagcgggtttagcgacagctggccctgggttactgcccaggaagccacccggactggctgccggtcctgctggtacctatggcaaggcagtctcaccccctccctccccaagggcaagtcctgtagcagccttgaaagcaaaggtcatacaaaagttagaggatgtgagcaagcctccagcttacgcttatcccgcaacaccttctagtcatccaaccagcccacctcccgcaagtccacccccaacacctggaatcaccagaaaggaagaggctcctgagaacgtggtagaaaaaaaggatcttgagttagagaaggaagctcccagcccctttcaagccctcttctcagatatccctcccagataccccttccaggctctccccccacactatgggaggccctatccgtttctgcttcagccaacagctgcagcagatgccgatggcctggcgccagacgtgccactccccgctgacggtcctgagcgacttgcattaagcccagaggacaaaccaattcgactgtccccatccaagatcacagaacctctgcgcgaggggcctgaggaagaacctttggctgagagagaggttaaggccgaggtggaggacatggacgagggtcccaccgagctgcccccactggagtcacctctgcctcttccagccgcagaagcaatggcgaccccttctcccgcaggcggttgtggtggcggactcctggaggcacaagccctatccgcaaccggtcagagttgtgcggaacccagcgagtgcccagactttgtggaaggacctgagcctagggtcgatagccctgggcgtaccgaaccatgtaccgcagctctagacttgggtgtacaactgactcctgagaccctcgttgaggcgaaggaagagccagtggaggttcctgtggctgttcctgtggttgaggccgtgcccgaagaaggtctagcccaggtggccccatcagagagccagccgacactggagatgtcagattgcgacgtgcctgcaggagaggggcagtgccccagtcttgaaccgcaagaggccgttcctgtgctcgggagtacatgttttttggaggaagcgagttctgatcaatttcttccatcactcgaagaccctctcgcaggcatgaacgccctagccgcagccgcagagctgccacaggcaagaccacttccctcacccggtgctgccggtgcccaggcccttgagaagctcgaggctgccgagtccctcgtacttgagcaatcttttcttcacggcatcactctactgagcgaaatcgccgagctggagctggagcggcgttctcctccacagggcctacccccttgtatggggcaaggtagccctatgccagccggtctacctgattgcgcgagaggacccgcacccacattatcaggttggcctagactcggggaacagtccagggtaggcttgcagcccggtgtgtcggtcaagggaacccgatggcgtggacctggcaccggcccaccgtggtctaagccctcccattatagaaaaccccagtggtgttag

SEQ ID NO: 60395 - DNA, 8906 bp, Artificial Sequence
  Description of Artificial Sequence: Synthetic coding sequence
atggatgggagggacttcggccctcagcgcagtgttcacggccctccccctcccttgctaagcggcctcgccatggactcccatcgcgttggcgctgccaccgcaggaagattgcctgcatccggtcttcccggtccactccctccagggaaatacatggccggattgaaccttcacccccaccctggggaggcattcctcggaagctttgtggctagtggaatgggcccaagcgcgtccagccacggatcacccgtgccgctgccttctgacttgtcattcagatctccaacccctagtaacctccctatggttcagctgtgggcggcacacgcccacgaaggcttcagtcacctccccagtggcctgtacccttcatatctccatctgaaccatctcgaaccccctagctctggatcacctttgctgagccagctcggccagcctagcatctttgatacccaaaaggggcagggccctggaggagatgggttttatctgcccacggctggtgcccctggatctcttcactcccatgccccaagtgcccgtacgcctgggggtgggcactctagcggagcaccagcgaaagggagcagtagcagagatgggcctgccaaggagcgggctggccgaggcggagagcccccacccctgtttggtaaaaaggatcccagagccaggggtgaggaggcctcaggcccacgcggtgttgtggatcttactcaggaggctcgagccgaaggcaggcaggatcgaggccctccgcgtctggctgagcgcctctctccgttcctggccgagtctaaaaccaagaatgcggcactgcagccttctgtacttaccatgtgtaacggtggcgcaggtgacgtgggcctccctgccctcgttgccgaagccggacgcggtggcgcaaaggaggccgctcgacaggacgagggagcccgactgctaagaagaacggaaaccttgttgcccggaccccgaccttgtccctcacctcttccgcctcccccagctcctcctaaaggtccccctgcccctcctgccgcaaccccagctggcgtgtacactgtgttcagagagcagggaagggaacatagagtggtggctccaacgttcgtgcccagcgtggaagcttttgatgagaggcctggccctattcagatagcaagccaggccagggacgctcgtgcccgagagagagaggcgggacgcccaggtgtgttgcaggcgccaccaggcagccccaggccattggaccggccagagggtcttagggaaaaaaactcagtgatcaggagtttgaaacgtcccccaccagccgatgcccctacagtgagagcaaccagggcctctccagacccaagggcctacgttcctgcaaaggagctgctaaaacccgaggccgacccaagaccttgtgagcgggctccacgcggaccagccggtccggcagcacagcaggcagcgaagttatttgggctcgaacccggaaggcccccacctactgggccagagcataagtggaaaccattcgaactcggcaacttcgccgctacacagatggccgtcctggcagcgcagcatcaccattcgagagctgaggaggaagcagcagtggtggccgcttcaagcagcaaaaaggcctacctcgatcctggagccgtgctgcctcggagtgccgctacctgtggtcgcccagttgcggatatgcatagtgcagcccacggctcaggcgaggcctctgccatgcagtcccttattaaatacagtggttctttcgccagagacgccgtggccgtcagacctgggggttgcggaaaaaaaagtcccttcggtggcttgggaacaatgaaacccgagccagccccaaccagcgccggagcttctagggcacaagcacgcctcccccatagcggaggaccggctgcaggtggcggtaggcagctgaagagagatccagagcgccctgaaagcgccaaagcgttcggaagagagggttccggagcccagggcgaggctgaggtgcgacacccacccgtgggcatagccgtggcagtggctcgccaaaaagacagcgggggaagtggcagactgggacccggtctggtcgatcaggagcgatcattgagtctgtctaatgttaagggccacgggagagccgatgaagattgtgtcgatgatagggccaggcatcgcgaggagcgacttcttggggcaaggctcgatagagaccaggagaagctcctccgagagtcaaaagagctcgctgacttagctcgtctccatccaacaagctgtgcccctaacgggcttaatccaaaccttatggtcacaggcggaccagcactcgccggtagcgggagatggtccgcagaccctgccgctcacctggccacgcacccgtggctcccccgaagcggtaacgcttccatgtggctcgccggacatccttatggcctgggtcctcctagtctacatcagggaatggccccagcgttccccccaggcctgggagggtctctccctagtgcctaccagttcgtgagagatcctcaaagcggacagctggtggtgatcccaagtgatcacttgcctcactttgctgagctcatggaacgcgcaacagtccctcctctgtggccagccctgtatccccctgggaggtcacccctgcaccacgcccaacagctgcagctgttttcacagcagcatttcctgagacaacaggaatttctttacctgcaacagcaggccgcacaagctttagagctacagcgatctgctcagctggttcaggaaaggctcaaagcccaggagcatcgcgctgaaatggaagagaagggctcaaaacggggactcgaggccgcaggcaaagcgggtttagccaccgccggaccgggtctgctgcctcgaaagcccccaggcctagcggcagggcctgctggcacatatggcaaagcagtgtcaccacccccttctccccgtgcgtcaccggtcgcggctctaaaggctaaggtgatacaaaagctggaggatgtctcgaaacctcccgcatacgcctatcctgcaaccccatcctctcacccaactagccctccgccagcctcacctcccccaacccctggtatcactaggaaagaggaagccccagagaacgtggtggagaaaaaggacttggaattagagaaggaggctccgtccccatttcaagctctcttcagcgatatccctccgagatacccctttcaggccctgccccctcactatggtcgaccttacccattcttgctgcaaccaaccgctgcggctgatgctgatggactcgcacccgacgtgcccttgcctgccgacgggcctgagcgcttggccctgtcaccagaagacaaacccattcgcctgagccccagcaagattacagagcctttgcgcgaaggtcctgaggaggaacccctcgctgaaagggaggtcaaggccgaggtggaagatatggacgagggccctacggaacttcctccgctcgaaagccccttgccactgcctgctgctgaggctatggccacccctagcccagctgggggttgtggtgggggactgctggaggcgcaggcgttatccgccaccgggcagtcttgcgccgagccttcagaatgccccgatttcgtggaagggcctgagccccgagtcgactcacctggcagaacagagccctgcacagccgctctggacctaggtgtccagctgacaccagaaactctcgtcgaggccaaagaagagccagtcgaggtgcccgttgccgtcccggtggtcgaagcggttccagaggaaggtctggcacaagtagctccatctgagtcacagccaactctcgagatgagtgactgcgacgtcccagccggagaggggcaatgccccagtctcgagccccaggaggccgtccctgttcttgggtctacctgcttcttggaagaagctagttcagaccagttcttgccaagtttggaggacccgctggccggaatgaacgcgctcgccgctgcggcagaactgccacaggcgagacccctgccctcacccggagcagcgggagcccaggccctggagaagctcgaggcagctgagtccctggtgcttgaacagtcattcctgcacgggatcaccctgctctcagagattgcggaactggaactcgaaaggagatcacaggaaatgggcggagcggagagggcattagtcgctcgcccatcactagagagtctgttggctgcagggtcccatatgctgagagaggtgcttgacgggccagtggtcgacccactcaagaacctgcgccttcctagagagctgaagcctaataaaaagtacagctggatgcgtaagaaggaggagaggatgtacgctatgaagagcagtctcgaggacatggatgcgctggaactcgactttcgcatgcgtcttgcggaggtgcagcggcagtataaggagaagcagagagaactggtgaagctccagagaagacgggacagtgaagataggagagaagaaccccaccggtcactggcgaggagggggcctggcagaccacgaaagaggactcatgccccaagtgctcttagtccccctcggaaaagaggcaagagtggacacagctcaggcaagctgagctcaaagtctttgctcaccagtgatgactacgaactcggcgctggcattcgtaaaaggcataagggttctgaagaagagcacgatgccctcataggaatggggaaagctagaggaagaaatcaaacatgggatgaacatgaagccagctcggacttcataagtcaacttaaaatcaaaaagaagaaaatggcctctgaccaggaacaactggccagcaaactcgataaagccctctcactgaccaagcaggacaaactcaagtctccttttaagttttccgattcagccggaggcaaatctaaaacatcaggcggatgcgggcgttacttaactccttatgatagcctgctgggtaaaaacagaaaagctctggccaagggcctgggcctttcactgaaatcctctagggagggaaaacataaacgagccgctaagacacgtaagatggaagtgggcttcaaggcgagaggccagccaaagtccgcccattcacctttcgcctccgaggtgtcctcatatagttacaatacggactctgaggaggacgaagagtttttgaaagatgagtggcccgctcagggtccatcttctagtaagctcactccaagcctgctctgttccatggtggcaaaaaattccaaagctgctggtggtcccaaactaaccaagcggggactggccgctcccaggactctgaagcctaagccagctacctctcgcaaacagcccttttgtctgctcctgcgggaggcagaagccaggagttcgttcagcgactctagcgaggagagctttgatcaggatgaaagttcggaagaagaggatgaggaggaggagcttgaagaggaagatgaggcatccggtgggggttaccggttaggggcaagagaaagggcattgagtccgggactggaggagagcgggctggggctgctcgctcgcttcgccgctagcgccctgccttctcctacagtggggcctagtctcagcgtcgtgcagctggaagcaaagcagaaagctcggaagaaagaggagcgccagagcctgctcgggactgagttcgagtatactgacagcgagtcagaggtcaaggtgcgcaagcgttcacccgctggtttgctgcgccctaagaaggggctcggcgaacctggtcctagcctagctgcaccaacaccaggggcaaggggtcctgatccctcgagccctgacaaggctaagcttgccgtggaaaagggacgcaaagccaggaaactgcgcggtcccaaagagcctggcttcgaagccggacctgaggcatctgacgacgatttatggactcgaaggcggtccgagcggattttcctgcatgatgcaagtgccgcagctcccgctccagtgtccactgcgcctgccactaagactagcagatgcgccaaaggtgggcctctgtctcctcggaaggacgctggacgagccaaggatcgcaaggatcccagaaagaagaaaaaagggaaggaggcgggacccggtgccggactgcccccaccccgagcccctgctctgccctcggaagctcgtgcaccacacgcgagttcattgactgccgctaaaaggtctaaggcgaaagccaagggcaaagaggtcaagaaagaaaaccgcggtaaaggtggagccgttagtaagctgatggagtccatggccgctgaagaggactttgagccaaaccaggactctagttttagtgaggacgagcatctaccacgcggaggtgccgttgaaagacctcttactccagcacctcggtcgtgcatcatcgataaagatgaactaaaagacggactgagagtcctgatcccgatggacgacaagttactttacgccggtcacgttcaaacagtccattctccagacatttacagagttgtggtcgagggggagcgtggcaatcgccctcacatctattgcttggagcagctgctgcaggaagccatcattgatgtgcgtcctgctagcaccaggtttttaccccagggaacccgaattgctgcctactggtcccagcagtatcgttgcctgtatccaggaacagtggtgcgcggtttgcttgatttggaggacgatggggacttgattaccgtcgagtttgatgacggtgacactggtcggattcctctatctcacatccgccttttgcctcctgattataagattcaatgtgctgaaccgtcacccgctctccttgtgccctcagccaaacgaagaagccggaaaacatccaaagacactggcgaaggaaaagatgggggaactgccggtagcgaggagcccggagcgaaagctaggggaaggggaaggaagccatctgccaaggcaaaggggggacgcgctgccacactggaagaagggaaccccactgatgaagttccttcaacgcccttggcactcgaaccctcaagcacccctggctccaaaaagagtccccctgaacctgttgacaagcgtgctaaagcccctaaagccaggccggctcctccgcagcctagcccagcacctcccgcttttacaagctgtcccgcacccgaaccatttgccgagttgcctgcccctgctacttctttagcccctgctcccctgatcaccatgcccgcaactaggcccaaaccaaaaaaagcacgggcagcagaggagtctggagctaaggggcctagaagacctggggaagaagctgaattgttggtgaagttggaccacgagggcgtgacttcacccaaaagcaagaaagccaaggaagccttacttctgagagaagacccaggcgctggcggttggcaggaaccaaagtcactgctctctctggggtcctaccccccagcagccggtagctccgagccgaaggcaccctggcctaaggccaccgatggcgacttggcacaggaaccaggtcctgggctcacatttgaagatagcggcaaccccaaaagccccgataaggcccaggcggaacaggatggcgcagaagaaagtgagtcctcttcctcctcgtccagcggcagttcgagctcaagttcaagttcatcaagtagtggatccgagactgagggggaggaggagggggataaaaacggcgatggaggctgtggcactgggggacgaaactgttcagccgctagcagtcgggctgccagtcccgcatcatcttctagctccagcagtagttcatcatcctctagctccagtagcagtagctcttcctcttcctctagttcaagttcttcttcaagctccagctccagctcctccagcagctccagctcgtcatcgagttcttcaagctccagcagctctagcagttcatcaagctcctctacaacggacgaagactctagctgctcttctgatgatgaggccgcacctgcccctaccgcaggcccttctgcccaagccgcactgcccacgaaggcaacaaaacaggcagggaaagctcgtccgtccgcccactctccgggtaaaaagactccagcgccacagccgcaggctccccctccccaacctactcaacccctccagcctaaagcccaggctggggctaaaagccgcccaaaaaaacgcgagggagttcacttgccgaccactaaagaattagcaaagaggcagagactccctagcgtggagaaccgcccaaagattgctgccttcctccccgcacggcagctgtggaaatggttcgggaagcccacccagcgcaggggaatgaaaggcaaggctaggaagttattttacaaagcgatcgtccggggtaaagaaatgatacggattggtgactgcgcagtttttctctccgcaggaagaccaaatctaccgtacattgggagaatccagtcaatgtgggagagctggggcaataacatggtggtccgcgttaagtggttttatcacccagaggagacctcccctggaaagcagtttcaccaggggcagcactgggatcagaaatcatcccggtccttgcctgctgcgttgcgcgtcagcagccagagaaaggacttcatggaacgggcactttatcagtctagtcacgtggatgagaatgatgtgcagacagtgagccataagtgtttagtcgtgggactcgagcaatacgaacagatgttaaagacaaagaaatatcaggatagcgaaggtctgtactatttggccggaacctatgaaccaacaaccggaatgatcttcagcactgatggtgtccccgtactgtgtta

SEQ ID NO: 60396 - DNA, 3939 bp, Artificial Sequence
  Description of Artificial Sequence: Synthetic coding sequence
atggaagaaaagggaagtaagcgcggattagaggctgcgggaaaagctgggctcgccacggcaggtccagggctcctgcctagaaaacctcctgggctcgcggctggcccagcagggacttatggcaaagcagtgagcccgcctccgtctccccgtgcgtctcctgttgccgcactgaaggctaaggtgatccagaaactcgaggatgtgagtaagcctcctgcgtatgcctacccagcaactccctccagtcatccaacgagtcccccacccgcttcgcccccacctacccccggaatcacccgcaaagaggaagcacccgaaaacgttgttgaaaagaaggatctggagctggagaaggaagccccatctccttttcaggcactcttcagtgacatccctcccaggtacccctttcaagccctgcccccacactacggcagaccctatcccttcctgctgcagcctacagcagccgctgacgccgacgggctcgcccctgacgtgccgttacctgccgacgggccagagaggctcgctttgagccctgaagacaaacccatccgcctttccccatctaaaattacggagccactaagagagggccctgaagaggaaccacttgccgagcgcgaggtgaaggcagaggtggaggatatggacgaaggccctacagaactgccgccactggaatcacccctgcccctcccagctgctgaggccatggccaccccgtcccctgcagggggttgtggtgggggtctgttggaggcgcaggcacttagtgcgactggacagtcctgtgcggagccctccgagtgtccagactttgtggagggcccagaaccgagagtcgatagccctggtcgaactgagccgtgcacagctgcactggatcttggagttcagctgactccagaaactctggtggaggccaaagaggaacccgttgaggtgccagttgctgtacccgttgtcgaggcggtgcctgaagaggggttggcacaggtggctcccagcgagtcccagcctacgctggagatgtcagactgtgatgtgcccgcaggagagggtcagtgtccttccctggagccccaagaggcggtccccgtgttaggcagtacatgcttcctggaggaggcctcgagcgaccaattcctgccaagccttgaggaccctctggccggaatgaacgcgctggcggctgccgctgaactaccgcaggccaggccactcccgagtcctggagccgctggcgcacaggcgctcgagaagttggaggctgcggagtcccttgtgctggagcaaagtttcctccacggaattactcttttatctgaaattgccgagctggagctggagcgcagaagtcaggaaatgggcggagccgagcgggctctagtcgcaagaccaagtctagagtcactattagccgctggctcccacatgctcagagaagtccttgacgggcctgtggttgacccgctgaagaacctgaggctgcccagggagcttaaacctaataagaagtactcgtggatgcgtaagaaggaggagagaatgtatgcgatgaagagttctctcgaggatatggacgccttagagcttgacttcaggatgagactggccgaggttcagaggcagtataaggaaaaacagcgcgaactggtgaagctccagagaagacgcgactctgaagacaggcgagaggaaccgcacaggtccctggcacgcagaggcccaggacggcctcggaagaggacacatgccccaagtgcactctcgccaccaaggaaaaggggcaagtctggccatagttccggcaaactatcctccaaatcccttctcactagcgatgactacgagcttggggcaggcattcggaaacgtcacaaaggttcagaggaagagcacgatgcactgatcggcatgggaaaggccagaggacgcaatcagacatgggacgaacacgaggcttcatccgacttcatatcacagctgaaaatcaaaaaaaagaaaatggcgtctgatcaggaacagctcgcttctaagctggataaggcactgtcactgacaaagcaagacaaattgaagtccccttttaaatttagcgattccgcaggtggcaagtccaaaaccagtggcggatgcggcagatacctgacaccttatgacagtctgcttggtaagaaccgaaaagccctggctaagggactcggactttctctgaaaagctctcgtgaaggcaagcataaacgggctgcgaaaacgagaaaaatggaggtgggctttaaagctcgcggacagcccaaaagcgcccacagtcccttcgcatccgaggtgtcttcctactcctataacaccgattcagaggaggatgaggaattcctgaaagatgaatggccagctcaaggcccttcaagtagcaaactgacgccgtccctcctctgctcgatggttgcaaagaacagtaaggccgctgggggtcccaaattgactaagcgcggtttggccgctcccaggacattgaaacctaaacctgctacctccagaaagcagcccttttgcctgctgctcagggaagccgaggccaggagttctttctctgatagttccgaggagagttttgatcaggacgagagctcggaagaggaagacgaggaggaggagctggaggaggaggatgaggctagcggcggtgggtatcggcttggtgccagagagcgagcgctgtctcccggtttggaagaaagcggtctgggcttgcttgctcggttcgctgcaagtgcactcccctcacctacagtggggccaagcctgtcagtcgtgcagctggaggccaagcagaaggcgagaaagaaagaagaacgacagtcactgctgggcactgagtttgagtacaccgattcagaatcagaggtgaaagtgaggaaacggtcgccagctggtttgttaaggccaaaaaaaggacttggtgagccaggacccagtctggcagcccctacacctggcgcacgtggccctgacccatctagtccagacaaagccaaactggccgtcgagaaagggagaaaggctaggaagctccgcggaccaaaagagcctggatttgaggcgggtcctgaggcctccgacgacgacctatggacgaggcgacgcagtgagagaatctttctgcacgatgcttccgccgcagctcccgctcccgtatccactgcccctgccacgaagacctctagatgcgccaaaggtgggcctttgtcgcccaggaaagatgcaggccgagcaaaggaccgaaaagatcccagaaagaaaaaaaaaggaaaggaagcaggccctggggctggattgcccccaccacgggctccggcactgccctctgaggctagagcccctcccccaccccctcccccacccccaccacatccacctcttccgcctcccccattgccccctccaccacttcccctcagactgcccccattgcctcctccacccctgccacggccacacccacccccacctccccctcttcccccattgctccctcctcctcagacaaggacactgccagcagccaggacaatgaggcagccacctccccctaggctggcactcccacgcagacgaagaagcccacctaggccacccagcaggcccgcaagaagaggacctaggccaacgccacaggctagacggaggccaaggccttccccacgacgcctgctgcgttctccacattctctgtgttctcccagactcaggccgggtccccgagcagaccctaggagggagcgggcatccacatctcctcctccccgatcatggccatcaggcagtgcttgcaggccctggagaaccggacctcgcagtcctccctcctgccagcctgggtctagcggtagcggctccgcctctcccccatctggcgtcgcatag

SEQ ID NO: 60397 - DNA, 912 bp, Artificial Sequence
  Description of Artificial Sequence: Synthetic coding sequence
atggatggtagagactttggccctcaaagatcagtgcatgggccacctcctcctctgctttctggactggctatggactctcaccgagtcggagcggctacagcaggtaggctgccagccagtggcctgccagggcctctcccaccagggaagtacatggccggactcaatctgcaccctcatcctggtaaatgcccagctccttgcccttccccgcctgtattcccaggccgaagtaccaggcccggtccaccggtgcactccaggcctgggctcggggatagccctagcgttggacacgggggagctggcaggctgggaagccagggatgggagactccgggtcctggtgcgaaggcggttgaaagcgtggcccgtcttggctatctgttcagatcagttcttggacctcgtgaacccaaggccggagtggtcgcaagagccaccggagccattccaattcctggagcacccgcagcacgagcttgggctggcgtctttaaaatttgggccaggaaagagcaaacaggccctgcaccgcgtgaaaccccactgccagaattggaaagcttcagctggcaaactctgctcctggccctcgtagggccaccgggtttctgcagtcaactgcatcattccagacgcgcaggctccttggcggtcactgaacgcaggggaatgagagagtatgcgggtggctgcggcagcaccgtgactccggcactcgggccttggcctagagggggtcgggatgcaccattttttcccggaaggacagcagcattgggaacatgtacacctgttggcggacgacgacccaggccttccggcacaccttgtttccccgctcgcaagagagtccgcaggtgcggtcgtgataccgagacggggccatcaaggtctcgcacatag

SEQ ID NO: 60398 - DNA, 8906 bp, Artificial Sequence
  Description of Artificial Sequence: Synthetic coding sequence
atggacgggagggatttcgggccacaaaggtctgtgcatggccctcctccgcctttgctgagcggacttgccatggacagtcatcgcgtcggtgcagctactgcaggcaggttgcctgcctctggcctcccaggtccgctaccgccaggcaagtacatggccggactgaatctgcacccacatcccggagaggccttccttggatcctttgtggcatctggcatggggcctagcgctagttcccatgggagccccgttcccttgccatctgacctgtctttccgatcccccaccccgagcaacctcccgatggtgcagctgtgggcagcccacgcacacgagggattcagccacttgccatctggcctgtatccatcttacctccatcttaaccatcttgaaccaccctcttccgggagccctctactaagccagctagggcaaccaagcatatttgacacgcagaagggacaggggcctggaggggatggcttctatttgcctactgccggagctccaggttccctgcactcacacgctccatccgccaggacgccgggagggggacattcctctggggctcccgctaagggctcgtcttcacgggatggacctgccaaagaaagggcaggccgtgggggtgagcccccaccgctatttggcaagaaggacccacgcgctagaggcgaagaggcctctggtcctcggggagtcgtcgatttgacacaggaagcgagggctgagggtaggcaagatagaggcccacctcgactggcagagcgcctgtccccatttctggctgagtcgaagaccaaaaatgctgctctacagccctccgttcttacaatgtgtaacgggggtgcaggggatgtcggtctgccagccctagtcgccgaagcaggcagggggggtgccaaagaggccgcacgtcaggatgagggtgcccgtctgttgcggagaaccgagacacttctccccggacctcgtccttgtccctctccgctgcctccacctcccgctcctcctaaaggacccccagcacccccagccgcaactcctgccggagtgtataccgtttttagagagcagggcagagagcatagagttgtggcccctacgtttgtccctagcgtggaggcctttgacgaaagacctggacccatccaaatcgcctcacaggccagagatgctagagcgcgtgaacgggaggccggacgtcctggggtgctccaagcccctcccggatcacctaggccccttgatcgtccggagggactgcgcgagaagaactctgtaattcgttcattgaaaagacccccacctgcagacgccccaaccgttcgcgcaacacgtgcctcccctgacccgagggcttacgtccccgctaaagaactgctgaagcctgaagccgatcctcggccttgtgaacgagcccctcgcggtcctgcaggtccagcagctcagcaggccgctaagttatttgggctggaacccggaagaccgcctccaaccggcccagagcacaagtggaaaccatttgaattgggcaacttcgcagccacacaaatggctgtcctggctgcacagcaccaccactcccgcgctgaagaagaggcagctgttgtggcagcctcctcctccaagaaggcatacttggatcccggagccgtgttgcccaggtcggcagcgacctgtggcaggcccgtggctgacatgcattccgccgcacacggctccggcgaggccagtgctatgcagtctctcatcaagtactccggctccttcgctagagatgcggttgccgtgaggccagggggttgcggtaagaagagcccatttggcggacttggtaccatgaaaccagaaccagcccctacttccgctggcgcttctcgggctcaggcgagattgccgcactctgggggacccgctgcgggaggagggagacagctcaaacgggatccagagagacccgagtcagccaaagcgtttggacgggaggggtccggcgctcaaggggaagcggaagttaggcatccgccagtcggcattgcggtggctgtggcgaggcagaaagattctgggggaagtggcaggttgggccctggccttgtggatcaggagcggtcactgtctctgtctaacgtaaagggccacggacgcgcagacgaggactgtgtggacgatagggctcggcacagggaggagagactgttgggagccagattagatcgagatcaggaaaagctgctccgcgaatctaaggagctagctgacctggcccgattacaccccacttcctgtgccccaaacggcctcaatccaaatctcatggttacaggtggccctgctctggccggtagtggcaggtggagtgctgatccggctgcccatctggctacccacccgtggttgccgaggagtggtaacgcaagtatgtggctggccggtcacccttatgggctgggacctcctagcctgcaccagggcatggctcctgctttccctcctggcctcggcggaagtctgcccagcgcctaccaattcgtgagggaccctcagtctggccagctggttgtgataccctctgaccacctccctcactttgccgaactcatggagagggcaacagtcccaccgctctggcctgccttgtaccctcccggacgtagtcccctccatcacgcgcagcagctgcagctgtttagccagcaacacttcctgaggcagcaagaatttctgtacctgcaacagcaagctgcccaggcgctcgagttgcagcgttcggcacagctcgtgcaggagcgattgaaggcccaggagcaccgtgcagagatggaagaaaagggttccaagagagggctggaggcagccggtaaagccggactggctaccgccggaccgggactcctgcccagaaagcctccaggcctcgccgctggaccggctggaacatacggcaaagcagtttctccccctccctcccctagggctagtcccgtggctgctttaaaggccaaggttattcagaaattggaggacgtttcgaagcctccagcttatgcctaccccgctacacctagttctcatcctactagtcctccacccgcaagccctcctcctacccctggcattacccgtaaggaggaagctcccgagaacgtggtggaaaagaaggatcttgaactggagaaggaggcaccaagccccttccaggcactcttttccgacatcccccctcggtacccctttcaggccctgccccctcattacggccgtccatatccgtttctccttcagcccaccgcagcggctgacgccgacgggctggctcctgatgtgccactccctgctgatggccctgagagactggccctgtctcccgaggacaaacctatcagactgtcaccgtcgaaaataactgagcctcttcgtgagggtccggaggaagaacctctggccgagagggaagtgaaagcagaagtggaggacatggacgaggggccaacagagctcccccctttggagtctccccttcccctgcctgccgcagaagcaatggccacaccttcacccgcaggtggctgtggagggggattattagaggcgcaggcactctccgccacaggacagagctgtgctgagccctcggagtgcccagattttgtagaagggcctgaacctcgagttgactctccagggagaactgaaccttgcacagcagctctcgatttgggcgtacaacttactccggaaacacttgtggaggccaaagaagaacctgtggaagtgccggtcgctgtccctgtggtggaggcggtgcctgaagagggactggctcaggtggccccttcagagagtcagccaaccctggagatgtccgactgtgacgttccagcgggagaaggacagtgtccttctcttgagcctcaggaagcggttcccgtccttggcagcacctgctttctggaagaggctagctcagaccagttccttccaagtctcgaggacccccttgccggtatgaacgcactggcggcagccgctgagctgccacaggctaggccacttccatctccaggggctgcgggtgcccaagccttggaaaaactagaggccgctgaatctctggtacttgaacaaagtttccttcacggcattaccctgctctcagaaatcgccgaactggaactagaaaggcgctctcaagagatggggggagcagaacgggcactagtcgcccgacctagcctggaatctctgctcgccgctggtagccacatgctgcgcgaagtcctggatgggcctgtggtggaccctctgaagaacctgagactgcctagagaactcaagcctaacaagaagtacagctggatgcggaagaaagaagaaagaatgtacgccatgaagtcctccctcgaggatatggacgctctcgagctcgatttcaggatgcgcctggccgaggtccagaggcagtacaaggaaaagcagagggagctggtgaagctgcagaggcggagggattcagaagacaggcgggaggagccccatcgcagcctcgctagacgtggaccgggtcggcctcggaaaaggacccatgccccttcagccctctctcctcccagaaaaagaggcaagagtggtcacagctcaggaaaactgtccagcaagagtctgctgacaagtgatgattacgagttgggggctgggattcggaagagacacaaaggcagcgaagaagaacatgatgccctaatcggcatggggaaagccagggggagaaatcaaacctgggacgaacacgaagcctcttctgactttatttctcagctcaagatcaaaaaaaagaaaatggcctcagatcaggaacagcttgcatcgaaacttgataaagcattaagcctcaccaaacaggacaaattaaaaagtcccttcaaattttctgatagcgccggtggcaaaagtaaaacttccggtggatgcggccgataccttactccctacgactccctgttgggcaagaaccgtaaggctctggcaaaaggactcggactttcactgaaaagtagtcgcgaagggaagcacaaaagagctgccaaaacacgcaaaatggaagtcggcttcaaggctaggggtcagcccaagagcgcccactccccctttgcctcagaagtttccagttatagctacaacacagactcggaagaggatgaagagttcctgaaggatgaatggcccgctcagggaccaagcagctccaaactgaccccttctttgctttgcagcatggttgctaagaactcaaaagcagccggaggaccaaagcttacaaagagaggactggcagcaccaaggacactaaagccgaaaccagccacgtctcggaagcagcccttctgtctgctgctccgggaggcagaagcacgctcaagcttttccgatagtagtgaggaatcatttgatcaggacgagagcagtgaggaagaggacgaagaggaggaactggaggaggaagatgaggccagcggtgggggttatcgactgggcgcaagggagagagctctctcacctggacttgaggagagcggcctaggcctgctggctcgattcgcggcttcagcccttccgagccccaccgttgggccttccctttctgtcgtgcagcttgaggctaaacaaaaagcacgcaagaaagaagagcgccaatccttactgggtactgagtttgagtatacagacagcgagtctgaggtcaaggtgcgaaagcgctctcctgcgggtctgctgagacctaaaaaaggcctcggagagccagggccatccctggcagctccaacacccggagccagggggccagatccttctagccccgataaggccaagctggccgtcgagaagggccgtaaggctaggaagctgcgcggtccaaaggagcccggtttcgaggcaggccctgaggcttcagatgatgatctctggactagaaggagaagcgaacgcattttcctacatgacgcatccgcggctgccccagcgcctgtctcaacagcaccagccacaaagacttcgagatgtgccaagggcggacctctgagcccccgtaaggatgccggtcgcgctaaggacagaaaggaccctcgcaaaaagaagaagggcaaggaggccggtcccggagccggactcccgccaccgagggctcccgctctgccctctgaagcccgtgcgccacatgcctctagcttgaccgctgccaaaaggagcaaagccaaagcaaaaggcaaggaagtcaaaaaggaaaacagaggaaaaggaggagccgtgagtaagctcatggaaagtatggcagctgaggaggacttcgaaccgaaccaggattcctctttctcagaagacgagcatctgccccgagggggagccgtcgaacgacctttaacacccgctcctcgctcctgtataatagataaagacgaactaaaggacggacttagggtgttgatcccaatggatgataaactactgtacgccggacacgtacagacagtacatagtccagacatttatagagtggtggtcgaaggggaaaggggcaaccgaccacatatctattgccttgaacagctgctgcaggaagccatcatcgacgttcgaccagcgagcacgcgctttctgccacagggaacccggatcgctgcatattggagccaacagtatcgatgtctgtatcctggcacagtagtgcggggactgctggacctggaagatgatggtgatttgatcactgtcgagttcgatgacggtgatactggccgtatccctctgagccacatacgactgctgccacccgactacaaaattcagtgtgctgagccctcacctgctttacttgtcccatccgctaaacggcgatctagaaagacgtcaaaggatacaggagaaggtaaggacgggggtacagccggttcagaggaaccaggagcaaaggcgaggggcaggggcagaaagccatcagcaaaagcaaagggagatagggcagctaccctggaagagggcaaccccaccgacgaagtcccaagtactccgttagctctggagccttcgtctacccccggttcgaagaagtctccaccagaacctgtggacaaaagggccaaggccccaaaggcccgacctgcaccaccccaaccatcacccgctcctcctgcattcacctcctgccctgcaccagagcccttcgcagagctacctgcccctgccacaagcctcgcgccagccccactaattacaatgccggcaacgaggccaaaaccaaaaaaagcacgggcagccgaagaatcaggcgctaaagggccaagacgcccaggcgaggaagcggaactactggtgaaacttgatcacgagggagtgacgagcccaaagagtaagaaagccaaggaggcactgctgttgagggaagatccaggggcaggcggatggcaggagcctaagtctctgctgagcctgggatcctatcctcccgctgctggaagctccgaaccaaaagctccatggccaaaagccaccgatggcgacctggctcaagaacctggtccaggcctgacgtttgaagactccgggaatcccaagagcccagacaaggcacaggccgagcaggatggagccgaggaaagcgagtcctcctcgagctccagctccggcagcagctcctcctcttcttcaagctccagctccggatccgaaacagaaggcgaggaggagggagataagaacggcgatggcggatgcggcaccggaggccgaaactgctctgcagcaagctcgagggcggcatctccggcatcaagcagtagctctagctcttcaagctctagctcttcatcgtcgtcctcatcttcatcttcatcctcttccagctcttcctcctcctcctccagctcgagcagcagttcaagctcatcttcctcgtcttcttcgtcgagcagttcatcctcgagcagttcatcctccagtagtaccacagatgaagattcctcgtgctcatccgacgatgaagcggcacctgcccctacagctggtccctctgcacaagctgctctgcctaccaaagctaccaagcaagcgggtaaggctagaccctccgcccactccccaggaaagaagacccccgctcctcagccacaggccccacccccacaaccaacccagcctttacagccaaaggctcaggctggcgctaaatcgaggcccaagaaaagggagggcgtgcatttgccaacaaccaaggagcttgctaagcgtcagcggctccccagtgttgagaaccggcctaaaatcgccgcttttttgcccgctcggcaattatggaagtggtttggcaagccaactcagcggagaggaatgaaagggaaggcccgaaaactgttctataaagcaatcgtccggggtaaggagatgattagaatcggagattgtgccgtctttttaagcgccggacgccctaacctgccttatatcgggcgtatacaaagtatgtgggaaagttggggaaacaacatggtggtaagagttaagtggttctatcaccccgaggagacatctccgggaaaacagttccaccagggtcagcactgggaccaaaagtcctctcggagtcttccagcggcactccgagtaagttcgcaacgaaaggatttcatggagcgagcactataccagtcaagccacgtcgacgagaacgatgtgcaaacagtatcccacaaatgccttgtggttggcctcgaacagtatgagcagatgttaaaaaccaaaaagtaccaggattccgaaggcctgtactaccttgcaggaacttatgaaccaacgaccggaatgatcttcagtaccgacggtgtgcctgtgctctgtta

SEQ ID NO: 60399 - DNA, 504 bp, Artificial Sequence
  Description of Artificial Sequence: Synthetic coding sequence
atgatcaaagattgcggcgctacctgggtcgtactggggcacagcgagaggcggcacgtgttcggcgagtcagacgaactcattgggcagaaagtggctcacgccttagccgagggactcggagtgatcgcatgtatcggggaaaagctggacgagagagaagccggtatcactgaaaaggtggtcttcgagcagaccaaggtcatagcagataatgtgaaggactggtcgaaggtggtcttagcatacgaacctgtatgggctattggtaccggcaaaactgctacccctcagcaggcacaagaggtacatgaaaagttaagggggtggctgaagtccaatgtgagcgatgccgttgcccagagcactcggatcatttacggcggatctgtgaccggcgctacctgtaaggaactggcttcccagccagacgtcgacggttttcttgtgggaggggctagtctgaagcccgagttcgtcgacatcataaatgctaaacagtag

SEQ ID NO: 60400 - DNA, 1398 bp, Artificial Sequence
  Description of Artificial Sequence: Synthetic coding sequence
atgcctgccactccatctctcaaggtggttcacgagctgccagcctgcacactgtgcgccggacctctcgaagatgccgtcaccatcccctgcggtcatacattctgtcggctatgtttgcccgctttgtctcagatgggcgctcagtcttccgggaagatccttctgtgtcctttatgtcaggaggaggaacaagcggagacacccatggcacctgttcctcttggcccacttggcgagacgtattgcgaagaacacggcgagaagatctacttcttttgtgaaaatgacgccgagttcctttgcgttttctgcagagaggggccaactcatcaagctcataccgttggattcttggatgaggccatccagccgtatagggataggctgcggagccgcctcgaagcgctaagtaccgagcgcgatgaaatcgaagatgtcaagtgccaggaagatcagaaactgcaggtgctgttgacccaaatagagtccaagaagcaccaggtggaaacggctttcgagagactacagcaggagttagaacagcagcgttgcctactgttggctcggctcagggagttagagcagcaaatttggaaggagcgagacgagtatattactaaagtgtcagaggaggtcacgagacttggggcacaggtgaaagagttggaagagaagtgccaacagccagcgtctgaactgcttcaggacgttagagtgaatcagtcaaggtgtgaaatgaagaccttcgtttcccctgaagcaatcagccccgatctggtgaagaagatacgggattttcaccgtaaaattttgacattgcctgaaatgatgaggatgttttccgagaatctcgcacaccatctcgaaatcgacagtggcgtcattaccttagatccgcagacagctagccggtctcttgtgctgtctgaagatcgcaagtctgtacgctacactaggcagaagaagtctttgccggatagccccctgcgttttgatgggctaccagccgttttgggtttcccaggattctcctcaggcaggcataggtggcaggtggatctgcagttgggcgacggcggaggctgcactgttggcgtggctggggaaggtgtgcgcaggaaaggtgaaatgggacttagtgcggaggatggtgtctgggccgtgattatcagtcaccagcagtgctgggcatcaacatccccagggaccgatttgcccctgtcagagatccctcggggagtgagggttgcccttgactacgaagcgggtcaggtgacattacataatgcccaaacacaggagcccatttttacatttacagcctccttcagcgggaaggtgttccctttctttgctgtgtggaaaaaagggtcctgcctcactctgaagggatag

SEQ ID NO: 60401 - DNA, 348 bp, Artificial Sequence
  Description of Artificial Sequence: Synthetic coding sequence
atgcctgcaactccgtctttaaaggtcgtgcacgagctgcctgcctgtactctgtgtgcgggaccattggaagacgctgtgacgattccctgtggtcacactttttgcaggctctgcctgccggctctgagccagatgggcgctcagtccagcggcaagattctcctctgtcccttgtgccaggaggaggagcaggccgaaactcccatggcccctgtgcctctgggtccacttggcgagacatattgtgaggaacatggcgaaaagatctactttttctgtgagaacgacgcagagtttctatgcgtgtcagaatgtaggaccacggacgggtttggctgtgcttag

SEQ ID NO: 60402 - DNA, 1398 bp, Artificial Sequence
  Description of Artificial Sequence: Synthetic coding sequence
atgcctgcaaccccatcccttaaggttgtgcatgaactgcccgcatgtacactttgcgcaggcccactagaggacgcagttacaataccttgcgggcacactttctgccggctgtgcctgcctgctcttagccagatgggggctcaaagttcgggtaagatcctgctgtgcccactgtgtcaggaagaggaacaggccgagacaccaatggcccctgtcccattggggcctctgggagagacgtattgtgaagagcatggagaaaagatttactttttttgcgagaacgacgcggagtttctctgcgttttctgtagggaagggccaactcatcaggcccacaccgtcggattcttggacgaagccatccaaccgtatcgtgacaggctgcgcagtcggttggaggcgctctctactgaaagggacgaaatagaggacgttaagtgccaagaagaccagaaactgcaggtgctcctgactcagatcgagtctaagaaacatcaggtggagactgctttcgagagactgcagcaggagctcgagcagcagcggtgcctactgttagcccgacttagagaattggaacaacaaatctggaaggaacgggacgaatacattactaaggtgtccgaagaagtcacacgactcggggctcaggtaaaagaattggaggaaaagtgtcagcagccagctagcgagttgctgcaggacgtgagagtcaaccaatcacgttgcgagatgaagaccttcgttagtccagaggctatctctcctgatttggtgaaaaagatccgggattttcatcgaaaaatcctgacgttacctgaaatgatgcgaatgttctccgaaaatctggcacaccacttagaaatagattcgggcgtgattactctagatcctcagactgcaagccggtcgctcgtgctgtctgaggaccggaagagtgttaggtataccaggcagaagaaaagcctgcccgactcaccgctccggttcgatggcctcccagcggttctggggttcccgggtttctcgtccggccgtcataggtggcaggtagatctccagctgggggatggcggtggatgtactgtgggggtagccggtgagggagtccggagaaagggagagatggggcttagcgcagaggacggtgtgtgggctgtgatcatttctcatcagcagtgttgggccagtacttccccaggcaccgaccttccgctgtcagaaatacctagaggagtgagagtggcccttgattatgaagctggacaggttaccctccacaatgctcagactcaagaacccatttttacctttaccgctagcttcagcggcaaggtcttccccttttttgccgtgtggaagaaggggtcctgtctgacgctcaaaggatag

SEQ ID NO: 60403 - DNA, 1191 bp, Artificial Sequence
  Description of Artificial Sequence: Synthetic coding sequence
atggctcccgtacctctaggccctctgggggagacttactgcgaagagcacggggagaaaatttattttttttgtgagaacgacgctgagttcctgtgcgtcttctgcagagagggacccactcatcaggcacacacagtcggttttttggatgaagccatccagccctaccgggacaggttacggtcccggctggaggccttaagcactgagcgcgacgagatcgaggacgtcaagtgtcaggaagatcaaaaactccaggtgctgttaacacagattgagtcaaagaagcaccaagtggagaccgctttcgagcggctccagcaagaactggagcagcagcgctgcctgctgcttgctaggctgcgggaactagagcagcagatttggaaagagcgtgacgaatacattacaaaggtcagcgaggaagtgactagactgggagcacaggtgaaagagttggaggagaagtgccagcagcccgctagtgaactgctccaggtcattcgtgagggccttcacggttgtgaaatgaaaacgtttgtgagtccggaggccattagcccggacctggtgaaaaaaatccgcgattttcatagaaaaattctaactctgcctgagatgatgcggatgttttccgagaatttagctcaccacctcgagattgactctggtgtgataactctagaccctcagacggcaagtcgctccctcgtgctgagtgaggaccgcaagtcggtccgctatacacggcagaagaagagcctccctgattcacccctgagattcgacggcttgcccgctgttctgggattccctggcttctcaagcggcaggcacaggtggcaggtcgatctgcagctgggagacgggggtggatgtactgtaggcgtggccggtgagggggttagaaggaagggcgagatgggcctgtccgcggaagacggagtttgggcggtgataatcagccaccagcaatgttgggcatctacgagtcctggtaccgatctcccgttgtctgaaatccctcggggagtcagggtggccctagattacgaggctggccaggtgaccctgcacaatgcccagacgcaggagcctatctttacgttcaccgccagcttcagtggcaaggtattcccattcttcgccgtctggaagaaggggtcatgtctgacactgaaaggctag

SEQ ID NO: 60404 - DNA, 1398 bp, Artificial Sequence
  Description of Artificial Sequence: Synthetic coding sequence
atgccggctactccaagtctaaaggttgtgcacgagttgccagcatgcacactgtgcgccggacccctagaggacgcagtcacaattccctgcggacacacattttgccgcctttgcctgcctgctttgagccagatgggggctcagtctagcggaaagatcctcttgtgtccactgtgccaggaggaagaacaggccgagacaccgatggcacccgtgcctcttggccctctgggcgaaacctattgcgaggaacacggggagaaaatatattttttctgcgagaacgacgctgaattcctgtgcgtgttttgtagggaggggcctacccaccaagctcatacagttggattcctcgacgaagcaatccagccctatcgagaccgcctgcgctccaggctcgaagctttatccacagagcgagacgaaatcgaggatgtcaaatgccaagaggatcagaaactgcaggtgctcctgactcaaattgagagtaagaagcatcaggtcgagacagccttcgaacggctccagcaagaacttgaacaacagagatgcctgctgctcgcacgcctgcgggagttggaacagcagatctggaaggagcgggatgaatatatcaccaaggtatccgaagaagtgacaaggctgggtgctcaggtgaaagagctggaggagaagtgccagcagcccgctagcgagcttctccaggatgtgagggtgaaccagagccggtgtgaaatgaaaacattcgttagccctgaggccatctctccagacttagtgaaaaaaatccgcgactttcatcgtaaaatcctgaccctgcctgaaatgatgagaatgttctcggaaaacctggcccaccacttggagattgactccggtgtgatcactttggacccacagaccgcgtctcgaagtcttgtgctgtccgaggataggaaatccgtgagatacactcgccagaaaaaatcattacctgacagccctctgcgattcgatggcctgccggctgttctcgggttccccggattctccagcggaagacaccggtggcaggtggatcttcaactcggggatggcggaggctgcaccgtgggcgtggcaggcgagggcgtgcgaaggaaaggggaaatgggactttccgccgaggacggagtgtgggctgtgattatctctcaccagcagtgttgggccagcacatctccgggaactgatctgccactttcagaaatccccaggggtgttagggtcgccctggattatgaagctggacaggtgaccctgcacaatgcccagacacaggaacccatctttaccttcaccgcctcattctccggcaaggtcttcccttttttcgccgtgtggaagaagggaagttgtctaaccttaaaaggctag

SEQ ID NO: 60405 - DNA, 1398 bp, Artificial Sequence
  Description of Artificial Sequence: Synthetic coding sequence
atgcctgccacacctagcctcaaagtggtgcacgaactccctgcatgcactctttgtgccggaccactggaggacgcggtgaccatcccgtgtggccacaccttctgtcgactctgccttccagcactttcccagatgggagctcagtcatccggcaagatcttactgtgtcccctatgccaagaagaggagcaggctgaaacccccatggcaccagtgcctctgggtcccctcggcgagacctactgcgaggaacatggagaaaagatctacttcttttgtgagaatgacgcggagttcctgtgcgtgttttgtagggagggtccgacacaccaggctcataccgtggggtttttagatgaggcaattcagccataccgtgaccggcttcggtctaggctcgaggccttatccacagagagagatgagattgaagacgtgaagtgccaagaagaccaaaaacttcaggtgctgcttactcagattgaatccaaaaaacatcaggtagagaccgctttcgaacgcttacagcaggaactcgagcagcagcggtgcctgctgctagctcgcctgagagaacttgaacagcaaatctggaaggagcgggacgagtacatcacaaaagtctccgaggaggtcaccagactcggagcccaggttaaggaattagaggagaaatgccaacaaccagccagtgagctgctccaggatgtcagggtgaaccaatctcgttgcgagatgaaaacctttgtatccccggaggctatcagccctgacctggtgaagaaaatccgggattttcaccgcaagattcttacactgccagagatgatgcgcatgttttccgagaatttggctcatcacctggagatcgatagtggcgtgatcactctggatccccagaccgctagtaggagccttgtgctctccgaagacaggaaaagcgtaagatacacgaggcagaagaagagcttacctgacagccccctgcgctttgatgggctgccggcagtactgggcttcccaggattttcaagcggtaggcaccgctggcaagtcgacctgcagctgggtgacgggggtgggtgtaccgtcggggtcgcaggcgagggagtgcgaaggaagggggagatgggcctgagcgccgaggacggcgtttgggctgtgatcatcagtcaccagcagtgctgggcgagtacttcgcccggtaccgatctgccactgtccgagattccaagaggtgttcgcgtggcattggattacgaggcaggccaggttacattacataatgcccaaacacaggagccaatcttcacttttactgcctctttctctggtaaagtgttcccgttctttgcagtctggaagaagggaagctgtttaactctgaagggatag

SEQ ID NO: 60406 - DNA, 495 bp, Artificial Sequence
  Description of Artificial Sequence: Synthetic coding sequence
tagaagaaacatcaggtggagacagccttcgaacgtctccagcaggaactagagcagcagagatgtctgctgttagcacgcctcagagagcttgaacagcaaatttggaaggagcgagacgagtacattactaaggtgagcgaagaggtcacccgccttggagcccaagtgaaggagcttgaagaaaagtgccagcagcctgcttcggaactgcttcaagacgtgcgtgtgaaccagtcaagatgcgagatgaaaacctttgtgtccccggaggccatttctccggatctggtgaagaagatcagggacttccacaggaaaatcctgacactgcccgagatgatgcgcatgtttagtgagaatctggcacaccatctggagattgattcagaccggcagccagagcccggtagtcttggacgccaggaggtttccgaggttcatcctgcagaggaggaacccgctaggcagccacctgcattacggcgaccctag

SEQ ID NO: 60407 - DNA, 495 bp, Artificial Sequence
  Description of Artificial Sequence: Synthetic coding sequence
taaaaaaagcaccaggtcgaaactgcattcgaaagactgcaacaagagctggagcagcagaggtgcctcctactcgcccgtcttcgtgaactcgaacagcagatctggaaggagcgtgacgagtacatcactaaggtgtccgaggaagtcacacgactgggagcacaggtgaaggaactcgaggaaaaatgtcagcaaccagctagtgagttgcttcaagacgtgagagtcaaccagtctcgctgcgaaatgaaaactttcgtgtctccagaagcaattagtcctgacctagtgaaaaaaattcgggacttccataggaagattctgacattacccgagatgatgcgcatgttctccgaaaatctggcccaccacctagagatcgactctgatagacagcctgagcccggaagcctcggaaggcaggaagtctccgaagtccaccctgccgaggaggaacctgcacgacagcctccggctttgaggcgtccttag

SEQ ID NO: 60408 - DNA, 495 bp, Artificial Sequence
  Description of Artificial Sequence: Synthetic coding sequence
taaaagaagcaccaggttgagacagccttcgagcggctgcagcaggagttagagcagcagcggtgcctcctgctagcccgtcttcgggaactcgagcaacaaatctggaaagaaagggatgaatacatcacaaaggtgtctgaggaagtgaccagactgggggcacaggtgaaggaactggaggagaaatgtcaacagcccgcaagcgagctcctgcaggatgtgcgtgtgaaccaatcccggtgtgagatgaaaaccttcgtgtccccagaagccatcagcccagacctggtaaaaaaaatacgggacttccaccgaaaaatcttgacacttcctgaaatgatgcggatgtttagcgagaatttagcacaccacctagaaattgatagtgaccggcagccagagccagggtctttaggtagacaagaggtgtctgaagtgcaccccgcagaagaggaacctgccagacaacccccagctctgcggaggccatag

SEQ ID NO: 60409 - DNA, 495 bp, Artificial Sequence
  Description of Artificial Sequence: Synthetic coding sequence
taaaagaagcatcaggttgagactgcgttcgagcgtcttcaacaggagttggaacagcagaggtgcttgctgctcgcaaggttacgggaactggaacaacagatatggaaggagcgagacgagtacattacaaaggtgagcgaagaggtcacccggctgggagctcaagtgaaggagctggaagagaaatgccagcagccagcctcagaacttttacaggacgtgcgcgttaaccagtctcgatgcgaaatgaagactttcgttagtccagaagctattagtcccgacttggtcaaaaagattagggattttcatcggaaaattcttacactgccggaaatgatgcggatgtttagtgaaaacctagcccaccacctagaaatagactcggaccgccaaccagagccaggcagcctaggacgccaggaggtgtctgaagtgcacccagccgaggaagaaccagctcgccagccgccagccctcagaagaccatag

SEQ ID NO: 60410 - DNA, 1398 bp, Artificial Sequence
  Description of Artificial Sequence: Synthetic coding sequence
atgcccgctaccccttcgctgaaagtagtgcatgaactccctgcttgtaccctttgtgctggcccactggaagacgctgtgaccatcccatgtggccacacattctgtagactctgtttgcccgctctcagccagatgggggcacagagtagtggaaaaatcctgctgtgccctctgtgtcaagaagaagaacaagccgaaaccccgatggccccagtgccacttggcccactgggagagacttattgcgaggagcacggggagaagatctatttcttctgcgaaaacgacgcagaattcctttgtgtattttgcagggagggccctacacaccaggcacatacagtggggttcctcgacgaggctatccagccatacagagatcggttgagaagccgcctggaagccctgtcaacagagcgggacgaaatagaagatgtgaaatgccaggaggaccaaaagctgcaggtgcttctcacacagattgaatccaagaaacaccaggtcgagacagctttcgagaggctacagcaggagctcgagcagcagaggtgcctcttgttggctcgactgcgagagctcgagcagcagatctggaaagaaagagacgagtatattacaaaggtgagcgaggaggtgacaaggttgggagcccaggtgaaagaactggaagagaagtgccagcagcccgctagtgagctgctgcaagatgtgcgcgttaaccagtctagatgcgaaatgaaaaccttcgtgtcgcccgaggcaatatcccccgacctggtgaaaaagatccgggactttcatagaaaaatcctgacgctgcctgaaatgatgagaatgttttcagagaacctggcacatcaccttgagatcgattctggcgtcatcacgctggaccctcagacagcatctcggtcacttgtgttatcagaggataggaagtccgtgcgttacacccggcaaaaaaaaagcttacccgactctcctctaaggttcgacggattaccagcagtgctgggctttcctggctttagctctggacgacacagatggcaagtcgatttacagttgggcgacggaggtgggtgcaccgtaggggtagctggcgagggtgttcggcgaaagggcgaaatgggactcagtgccgaggatggcgtgtgggcagttatcattagccaccaacagtgttgggcctcaacttccccgggtactgatctccccctgagtgagattcctcggggtgttagagtcgccctggactatgaagcgggacaggttactctccataatgctcaaacacaggagcctatttttacattcactgcaagcttctctgggaaggtgttcccgtttttcgccgtctggaaaaagggaagctgtctgaccctgaagggctag

SEQ ID NO: 60411 - DNA, 495 bp, Artificial Sequence
  Description of Artificial Sequence: Synthetic coding sequence
tgaaaaaagcaccaggtcgagacagctttcgaacgcctgcagcaagagctggaacagcaaagatgcctcctcctcgcacgtctccgtgaactcgagcagcagatctggaaagagagggatgaatacataaccaaggtctcggaagaagttactcgtttgggcgcacaagtcaaagagttagaagaaaaatgccaacaacctgcttctgaactgctgcaggatgtgagggtgaatcaatcaaggtgcgaaatgaaaacatttgtttcacctgaggctatttcacctgatttagtaaagaagatcagggacttccaccggaaaatcctgacgctgccagagatgatgcggatgttcagcgaaaacttggcacatcacctggagatagacagtgataggcaacccgagccagggtctctaggcagacaagaagtaagcgaggtccatcctgccgaggaggaacccgctcgacagccacctgccttacggcgaccttag

SEQ ID NO: 60412 - DNA, 1398 bp, Artificial Sequence
  Description of Artificial Sequence: Synthetic coding sequence
atgccggctactcccagtctgaaggtggtccacgagttacccgcttgcacactgtgcgccggaccactggaagatgctgtgactataccctgtggacatacgttttgtagattgtgcctgcccgcacttagccagatgggagcccagagctccgggaagatcctgctgtgtcccttgtgccaggaagaggagcaggctgaaacacccatggctccagtgccccttgggccactgggtgagacgtattgcgaggagcatggggaaaagatctactttttttgcgagaacgatgcagagtttctctgtgttttttgcagagaaggacccacacaccaggctcatacagtgggtttcctggacgaggctattcaaccgtaccgagaccgtttgcgttcacggctggaggcactaagcacagagagggacgaaatcgaggatgtgaaatgccaggaggatcagaagctccaggtgttgctgactcagattgaatccaaaaaacatcaggtggaaacagcctttgagcgtctgcagcaagagctggaacagcagcgttgcctcttactcgctaggctgagggagcttgagcaacagatctggaaggagcgggatgaatatataacaaaagtgagcgaggaggtgacccgcctgggcgctcaggtaaaggagcttgaagagaagtgtcaacagccggcatcagaactactgcaggatgtccgtgtcaaccagtcaaggtgcgagatgaaaacctttgtctcgcctgaggccatatcgcccgatttagttaagaaaatcagggattttcatcgcaaaatcctgacgttgcctgaaatgatgagaatgttctccgaaaacctggcccaccacctcgaaatcgattccggcgtcataactctggacccgcagaccgcttcacgtagtctcgttctttcagaggaccgcaaatcggtccggtatacacggcagaagaagaatctgcctgatagcccattacgcttcgatggtcttcccgctgtgctaggctttcctggattctcatcaggccgtcatcgctggcaagtggatctgcagctgggcgatggcggaggatgtactgttggggtggctggcgaaggagtccgacgcaagggcgagatgggcctctcagccgaagacggtgtgtgggctgtaataatatcccatcagcagtgttgggctagtacctctcctggcacagatcttccattaagtgagatcccacgcggtgtgagagtcgcgctggactatgaggcgggacaagttacattacacaacgcacagacccaagaacccatcttcacctttactgcttcattttcagggaaggtgtttcccttcttcgcagtgtggaaaaaggggagctgcctgacactgaaagggtag

SEQ ID NO: 60413 - DNA, 1398 bp, Artificial Sequence
  Description of Artificial Sequence: Synthetic coding sequence
atgccagccactccgagcctcaaggtagtgcatgaactgcccgcttgtacactgtgtgcaggacccctcgaggatgccgtgacaattccttgcggacacaccttctgtcgcctttgcttgccggctttgtctcaaatgggagcccagtctagtggaaagattttgctgtgtccactgtgccaggaggaagaacaggcggagacgccgatggcgcctgtgcctctgggccctcttggcgagacctattgcgaagaacacggggaaaaaatctactttttttgtgagaacgacgcagagtttctttgcgtgttctgcagggagggaccaacacaccaggcacacacagttggctttctagacgaggccatccaaccttatagggacaggttgcgatcacggttagaggcgctgtccaccgaaagggacgaaattgaagacgtgaagtgccaggaagatcagaagctacaggtcttactgacccagatagaatccaaaaagcaccaagtcgagacagcattcgagaggctccagcaggagctggaacagcagcgatgccttctgctcgctaggctaagagagctggagcaacagatttggaaagaacgcgacgagtacattaccaaagtgtccgaggaagttacccgactcggggcacaggtcaaggaactcgaagaaaagtgccagcagcccgcaagcgagctgctgcaagacgtaagagtgaatcaaagtcggtgcgagatgaaaacttttgtaagcccagaagccatctctcccgacttagtgaaaaaaatccgcgactttcacaggaaaatactaactctgccggagatgatgagaatgttttctgagaatctggctcaccatttagaaatcgatagtggggttattactcttgatccgcagacagcgtcacgaagtctggtgctcagcgaagatagaaaatcagtgaggtacaccaggcagaaaaaaaatctccctgattcccccctgcggttcgatgggctcccggctgtcctgggcttccccggattttcctcaggacggcatcgttggcaagtggacctgcagcttggcgatggagggggttgtactgtgggagtcgccggtgagggcgtgagacggaagggagagatgggcttgtctgccgaagacggagtgtgggcagtgataatatcacatcaacagtgctgggcctcaacatcccctgggactgacctgccactatccgagataccacgaggcgtcagggttgctctggattatgaggccggtcaggtgaccctccacaacgcccagacccaggagcctatttttacctttacggccagcttttctgggaaagtttttcccttttttgccgtctggaagaaagggagttgcctcaccctcaaaggctag

SEQ ID NO: 60414 - DNA, 1398 bp, Artificial Sequence
  Description of Artificial Sequence: Synthetic coding sequence
atgcccgcaactccaagtctgaaggtagtgcacgaattaccggcatgtactctgtgtgctggtccattggaggatgcagttacaatcccgtgcggacacactttctgtagactttgcttacctgcactctcccagatgggagcacagagttctggtaagatcctcctgtgcccattgtgtcaggaagaggagcaagctgagaccccaatggccccagttcccctcggaccactcggagagacctattgcgaagagcacggagagaagatatacttcttctgcgagaacgacgccgaatttctgtgtgtattctgtcgggaaggcccaacgcatcaggcgcacactgtggggttcttggatgaggccattcagccgtacagggataggctgagatcaagactggaggcactgagtaccgaacgggatgagatagaagatgttaaatgccaggaagaccagaagttgcaggtcttactcactcagatcgagagtaagaagcaccaagtggaaacagccttcgagaggctccagcaggaactcgagcaacagcggtgcttactcttggctaggctgagggagctggagcagcagatttggaaagagagagatgaatatattactaaggtgtccgaagaggtgacacggcttggggcacaggtgaaggaattggaagagaagtgtcagcaacccgcatccgagctgctgcaagacgtccgggtaaatcaatctcgctgcgagatgaagacctttgtgagtcctgaggctatcagccctgatttagtgaaaaaaatccgagactttcaccggaaaatactcacattgcccgagatgatgcgcatgttctctgaaaaccttgcccatcatctggaaattgattctggggttattacgctagacccacaaacggccagccgaagtttggtgttatccgaagatagaaagagtgtgcgttatacacgccagaaaaaaagtctgcccgactctccattgagattcgacggtctgcccgctgtgctgggctttcctggctttagctctggcaggcaccgatggcaggttgatctgcagctcggggacggtggaggctgcactgtgggggttgctggggagggcgtgcgaaggaaaggcgaaatgggactgtcagccgaggatggggtctgggccgtgataatttctcatcaacagtgttgggctagcacttcaccaggaactgatctgccactgagtgagatcccaaggggcgtaagggttgctcttgattacgaggctggccaggtgaccttacacaacgcacagacacaggaacctatcttcacattcaccgcctctttcagtggaaaggtgttcccattctttgctgtgtggaaaaagggctcttgtctgacattaaagggatag

SEQ ID NO: 60415 - DNA, 495 bp, Artificial Sequence
  Description of Artificial Sequence: Synthetic coding sequence
tgaaagaaacaccaggtggaaaccgcctttgagcgcctgcagcaggagctggagcagcagaggtgtttgctgctagcaaggctgagggagctagaacagcagatttggaaagagcgcgacgaatatatcacaaaggtcagcgaagaggtgaccaggctcggcgcacaggttaaggaactggaggagaagtgtcagcagcccgctagcgagctcctccaggacgtgagagtgaatcagtctaggtgtgaaatgaaaacatttgtttcccccgaagcaatcagtcctgacttggtaaaaaaaatcagagatttccatcgtaaaatcttgactctgcccgagatgatgcgcatgttctccgagaacttagctcatcatcttgaaattgactcggatcgacaacctgaacctggcagcctggggcgtcaggaagtctccgaagtacacccagcggaagaagagccagccagacaacccccagccctaagacggccttag

SEQ ID NO: 60416 - DNA, 495 bp, Artificial Sequence
  Description of Artificial Sequence: Synthetic coding sequence
tgaaagaagcaccaggttgaaactgccttcgagcgtctacagcaggagcttgagcagcagcgatgcctgctgctggcccgtttaagagaactcgagcagcagatttggaaggagcgcgacgaatacattacaaaggttagcgaagaggtcactcgccttggcgcacaggttaaggagcttgaggagaaatgccaacagccagcctctgaactgctgcaagatgtgagagtaaaccagtcacgttgtgagatgaaaacttttgtctcacccgaggccatcagtccagaccttgtgaaaaaaatacgcgatttccacagaaagatattaactttgcctgaaatgatgaggatgtttagcgaaaacttggcgcaccatctcgagatagacagtgacagacagccagaacccggatccctgggaaggcaggaggtttccgaggtgcacccggcagaagaggaaccggcaagacaaccccctgcactgagacgtccctag

SEQ ID NO: 60417 - DNA, 495 bp, Artificial Sequence
  Description of Artificial Sequence: Synthetic coding sequence
tgaaagaaacatcaggtggagaccgccttcgagagactgcagcaggagctggaacagcagaggtgtctcctactcgctcgcctgagggaactggagcagcagatatggaaggagcgggacgaatatatcaccaaagtgagcgaggaggtcacacggctgggcgctcaagtgaaggaactggaggagaaatgccagcagcccgcatctgagctattacaggacgtccgcgttaaccagtcacgctgtgagatgaaaacattcgtaagtcccgaagcgatatctcccgatctggtcaagaagatcagggactttcaccgcaaaattctaacgctgcctgagatgatgaggatgttctctgagaatctggctcatcacctcgagatagatagcgaccgccaaccagaacctggcagtttgggtcgccaagaggtaagtgaagtgcatccagcagaggaggagccagctcgccaaccccctgcgctccggcgaccctag

SEQ ID NO: 60418 - DNA, 1191 bp, Artificial Sequence
  Description of Artificial Sequence: Synthetic coding sequence
atggccccagtccctctggggccactcggagaaacctactgtgaggaacacggcgagaagatctacttcttctgtgagaatgacgctgaatttctgtgcgtcttctgtagagagggaccgacccatcaggcccacactgtcggttttttggatgaagccattcaaccttatagagatcggctgagaagccgactcgaagccctctcaaccgaacgggacgagattgaggatgtgaaatgccaggaggatcagaagttgcaggtgctgctcacccagattgaatctaagaagcaccaggtggagacagccttcgagcgactgcagcaagaactggaacaacaaagatgtctgctgctggcaaggttaagggagttagagcagcagatctggaaagagagagacgaatacataaccaaagttagcgaggaagttacaaggctgggggctcaggtaaaggaactcgaagaaaagtgtcagcaaccggcttctgagctgctgcaggtaatacgcgaaggcttgcacggatgtgaaatgaagacattcgtgagtcctgaggccatcagcccggatctggtaaaaaaaattcgcgactttcacagaaagatcttaacgctcccggaaatgatgcgcatgtttagcgaaaatcttgcccaccacctggagattgacagcggggtgattacccttgacccacagacggcttctaggtccttagttttatctgaggacaggaaatccgtacgatacacaagacagaaaaaaaatttgcccgatagtcccctccggtttgatgggctgccagcagtattgggcttccccggattctcttccggacgacatcggtggcaggtcgacctgcagctgggggacggcggtggctgcactgtcggagtcgccggagagggtgttcggcgaaaaggcgagatggggttgagtgcggaagacggagtgtgggccgtgatcattagtcaccagcagtgctgggccagtacgtcgcccggtaccgacctacctctgtctgaaataccaaggggcgttcgagtggcgctcgattacgaggccggacaggtgacgctgcataacgcccagacccaggaacccatctttacttttactgcctctttttccggcaaagtcttccctttcttcgcagtttggaaaaaaggtagctgtcttaccctgaaaggctag

SEQ ID NO: 60419 - DNA, 348 bp, Artificial Sequence
  Description of Artificial Sequence: Synthetic coding sequence
atgccagccacgccttctttgaaggtggtccacgaattacctgcttgtacattgtgcgccggtcccctagaggacgctgtgacaattccttgtggccacaccttttgtcgcctctgcttaccagctctttcacagatgggcgcacaatcatcgggaaaaatactactctgtcccctgtgtcaagaggaggagcaagctgagacccccatggcaccagtgccattgggaccactgggtgagacttattgtgaagagcacggggagaaaatctattttttttgcgagaatgatgctgagtttctttgcgtcagcgagtgtcgcaccaccgatggattcggatgtgcttag

SEQ ID NO: 60420 - DNA, 348 bp, Artificial Sequence
  Description of Artificial Sequence: Synthetic coding sequence
atgcctgctacccctagcctgaaggtagtgcatgaacttcctgcctgcaccctgtgtgccggtccacttgaggacgctgtcacaatcccttgtggtcatacattctgtaggctgtgtctacctgctctgtcccagatgggggctcagtcatcgggaaagatcttgttgtgcccactatgccaggaggaagaacaggcggagacgcccatggcccctgtgccacttggacctcttggagagacatactgcgaagagcatggcgagaaaatatatttcttctgcgagaatgatgctgagttcctctgtgtgtccgaatgtcggacaactgatggctttggttgcgcctag

SEQ ID NO: 60421 - DNA, 1191 bp, Artificial Sequence
  Description of Artificial Sequence: Synthetic coding sequence
atggctcctgtgccccttggccctttgggcgagacctactgcgaagaacatggtgagaaaatttatttcttctgcgagaacgacgccgagtttttatgtgttttctgtcgagaagggcctacgcatcaggcccacaccgtgggattcttggatgaggccatccagccctatcgtgatcggctacgctcccgactcgaggccctgagcaccgaacgggatgaaattgaagacgtaaagtgccaggaggatcaaaagcttcaggtgctgttgacccagattgaatccaagaaacaccaggtggagaccgccttcgaacgattacagcaagagctagaacagcagcggtgcttgcttctcgcccgactgcgggagttagagcaacaaatctggaaagagcgagatgaatatattactaaagtgagtgaggaggttaccaggttgggagctcaggtgaaggagctggaggaaaagtgccagcaacctgcctcggagttgttacaggtgatcagagaaggactccatggctgtgaaatgaaaacctttgtttcaccagaggctatctccccagacctcgtgaagaaaattcgtgatttccatagaaagatactgacactacctgagatgatgcggatgttctcggagaatctagcccaccacctcgaaattgatagtggagtgattacattggatccacagacagcgtcgcggtctttggtcctgtccgaggatcgcaaaagcgtgaggtacactcgccaaaagaagagcctccccgatagtccgcttcggtttgacggactccccgctgtcctgggttttccgggtttttcaagtggaagacatagatggcaggtggacctccagctgggcgacggaggaggatgtacagttggagtagcaggtgaaggagtgcgcagaaaaggggaaatgggactgtccgccgaggacggagtgtgggctgtgatcatttctcaccagcagtgttgggcctccacctctccgggtaccgacctgccactaagtgagatacccagaggggtaagggttgctcttgattacgaggccggacaagtgacactgcataatgcccaaacacaagaacccatttttacatttacagcttctttcagcggtaaggtgttcccgtttttcgccgtgtggaagaagggaagttgtctcactttaaagggctag

SEQ ID NO: 60422 - DNA, 1191 bp, Artificial Sequence
  Description of Artificial Sequence: Synthetic coding sequence
atggcccctgttcccctgggcccacttggcgagacttactgtgaggaacatggtgagaagatctatttcttctgtgagaacgatgccgaattcctgtgtgttttctgccgggagggcccaacccaccaggcacacaccgtgggtttcctggacgaagctatccagccttatcgggacagactcaggagccggctcgaggcactgagtacagagcgcgatgaaatcgaagacgttaagtgtcaggaggaccaaaaacttcaggtacttctcacgcagatcgaaagtaaaaagcatcaggtcgagaccgcatttgagaggttacagcaagagcttgagcagcagagatgtttgctcctggcaagactcagagagctggaacagcagatctggaaagagagagatgagtatatcacaaaagtgtccgaggaggtcaccaggctcggagcccaggtcaaggaactggaggagaagtgccagcagccggcttctgaacttttgcaggtaattcgcgaaggcctgcatggttgtgaaatgaagacattcgtttccccagaggctataagccccgacctggtgaagaaaattagagactttcataggaagatcttgactttacctgagatgatgcgaatgttttccgaaaatcttgctcatcatctggagatcgactccggagtcatcactttggatccacagactgcgtcccgctcacttgtccttagcgaggaccggaaaagcgtgcggtacacaaggcagaaaaaaagtttacccgattcccccctgcgcttcgacggccttccagcagttctgggcttcccaggtttctcatctggtagacatcggtggcaggtggatctgcagttaggagatggcggagggtgcaccgtgggcgtagcaggagagggggtgcggcgtaaaggtgagatgggtctgtccgctgaagatggcgtgtgggctgtaattatttcacaccagcaatgctgggcaagtacatcccctgggacggaccttccactcagtgagattcccaggggtgtgcgagtggcgctggactatgaagctgggcaagtgacactgcacaacgcccaaacacaggagcctatcttcacgtttacagcttccttctctggcaaggtattcccattcttcgcagtctggaaaaaaggctcttgcttaaccttgaaggggtag

SEQ ID NO: 60423 - DNA, 348 bp, Artificial Sequence
  Description of Artificial Sequence: Synthetic coding sequence
atgcccgctactccatccttgaaagtggttcatgaactccctgcgtgcacactgtgcgccggacctctagaggacgccgtgacaataccgtgcggacacaccttttgtaggttatgtctacccgctctatctcagatgggagcccagtcttccgggaagatcctcctttgtcccctgtgccaggaagaggagcaggccgagacccctatggcccctgtgcccctgggcccactgggagagacatactgcgaagagcacggcgagaagatatattttttctgcgagaatgacgccgaatttctctgcgtgagtgagtgcagaactactgatggcttcgggtgtgcatag

SEQ ID NO: 60424 - DNA, 348 bp, Artificial Sequence
  Description of Artificial Sequence: Synthetic coding sequence
atgcccgcaacaccttctttaaaagtggttcacgagctgcctgcttgcacactgtgcgccggacccctagaggacgccgtcacaatcccttgcggacacaccttctgcaggctgtgcctgcccgcattgagccagatgggtgcccagagctcaggaaagatccttctgtgcccactgtgccaagaagaagaacaggccgagactcccatggctcctgtccctttgggccctctcggcgaaacatactgtgaagagcacggcgaaaaaatctactttttctgcgagaatgacgccgaatttctgtgtgtgtctgagtgcaggactaccgacggctttggatgcgcctag

SEQ ID NO: 60425 - DNA, 1191 bp, Artificial Sequence
  Description of Artificial Sequence: Synthetic coding sequence
atggcacccgtccccctaggaccactcggtgaaacatactgcgaggaacacggcgaaaaaatatatttcttctgtgagaacgacgccgagttcttgtgcgtcttctgtcgtgagggtccaactcaccaggcacacaccgtgggcttccttgacgaagccatccagccgtatagggaccgattgcgcagccgcctggaggcattatcgactgagagggacgaaattgaggatgtgaaatgccaagaggaccagaagctgcaggttttattaacgcagatcgagtctaagaaacaccaggtggagaccgcatttgaaaggttgcagcaggaactggaacagcaacgatgtctcttactggccagacttagagagctggaacaacagatctggaaagaaagggatgagtatatcaccaaagtgtccgaggaggtcacgaggttaggcgcacaggtcaaggaacttgaggagaagtgccaacagcctgcgtccgagctactgcaggtgattcgcgaggggttgcatggctgcgaaatgaaaaccttcgtgtctccggaagctatctcaccagatttagtcaagaagattcgggatttccatcggaagatactgacattgcccgagatgatgagaatgttcagtgaaaatctcgcccatcacctggagatcgatagtggcgtgatcaccctggatcctcagaccgcttctagatccctcgttctgagtgaggatagaaagtcggtgagatataccaggcagaagaaatccctgcccgactctcccttacgatttgatggcctgcctgcagtcctgggttttccaggattctcaagcgggcgacatagatggcaggtcgacctacagctgggagacgggggtggatgtactgtgggggtggcaggtgaaggagtacggagaaaaggcgagatgggcttgagtgcagaagacggagtgtgggccgtgattatcagccatcagcagtgctgggcttcgacaagcccgggaacagacctgccactgtctgagatcccacgaggggtaagagttgctctcgattacgaagccggacaggttacccttcacaacgcccagacacaggagccaatttttacatttactgcttctttttcaggcaaggtcttcccgttcttcgctgtttggaagaaagggagctgcctaaccctcaaagggtag

SEQ ID NO: 60426 - DNA, 1191 bp, Artificial Sequence
  Description of Artificial Sequence: Synthetic coding sequence
atggcccctgtgccgctcggcccactgggggaaacctactgcgaggagcatggggagaaaatctatttcttttgcgaaaatgacgccgagttcctatgtgtattctgtcgcgagggtccgacccatcaggctcacaccgtggggtttttggacgaggctatccagccctacagagatcggctgcgctctaggctcgaggccctaagcaccgagcgggacgagattgaagacgtaaagtgtcaggaagaccagaagcttcaggtcctgttgacccaaatagagagcaagaaacatcaggttgaaaccgcttttgagagactccaacaagaactggagcaacagcggtgtctcctgttagccagactccgagaattggaacagcagatctggaaagagagggatgagtatataactaaagtgtcggaggaggtcacacgccttggggcacaggttaaggagctggaagaaaagtgtcaacagcccgctagtgaactccttcaggtcataagggaagggttgcacggctgcgaaatgaagacctttgtctccccagaagccataagcccagatcttgtaaagaagatacgagacttccatcggaaaattcttacccttcccgaaatgatgcgtatgttttctgaaaatctggcccatcacctggaaattgattcaggtgtcatcaccctggatccacagactgccagccgctctctggttctgtctgaggatagaaagtctgttcggtacacccgtcagaagaaaaatctgcccgattcaccattaaggtttgacgggctgcccgctgtccttgggtttcctgggttttcttcaggtcgtcaccggtggcaggtagatcttcagctgggcgacgggggtggatgtactgttggcgtcgcaggtgagggcgtgaggagaaagggcgaaatggggctgtccgccgaggatggtgtgtgggccgtcatcattagccaccagcaatgttgggccagtacgtcacctggcaccgatttacctttgtccgagatcccaaggggcgtgcgcgtcgctctggattatgaggccggacaagtgaccctgcacaacgcccagacccaggagccaattttcacatttacagccagtttttccgggaaggtcttcccttttttcgctgtctggaaaaagggatcttgtctgactcttaagggctag

SEQ ID NO: 60427 - DNA, 1191 bp, Artificial Sequence
  Description of Artificial Sequence: Synthetic coding sequence
atggcgccagtcccacttggacctctcggcgagacatattgtgaggagcacggcgagaagatctactttttctgtgagaatgatgctgagtttctgtgcgtgttctgcagagaaggcccaactcaccaggcacatacagtaggattcctggatgaggctatccagccttatagggataggttgagatcgagactggaggctctgagtacagaacgggatgaaatcgaggatgtcaagtgccaggaagaccaaaaactacaagtgctgttgacacaaatcgagtcaaagaaacatcaggtggagactgctttcgagagactgcaacaagagctggagcagcagagatgtctcttgcttgctcggcttagagagctggagcaacagatctggaaggaacgcgatgaatatattacgaaagtgtccgaggaagttacacgcctgggagctcaggtgaaggagctggaggagaagtgtcagcaacccgctagcgaactgctgcaggtcatcagggaaggactgcatggatgtgaaatgaaaacgttcgtgagccccgaggccatatccccggatctcgtgaaaaaaatcagggattttcatcgcaagattctcaccttgcctgagatgatgcgtatgttcagtgagaatctggctcatcatttagagatcgactccggggttatcaccctggaccctcagacggcatctcggagtcttgtgctgtccgaagacagaaagtccgttcggtacacaagacagaagaagtccctgccagactcaccactgcgtttcgacgggctacctgccgtcctgggcttccccggattcagctctggtcgacataggtggcaggtggacttgcagcttggcgacggcggaggatgcacagtaggcgtcgcaggtgagggagtgagaaggaaaggcgaaatgggactatcagctgaagacggggtgtgggccgttattatctctcaccaacagtgctgggccagtaccagtcccggaactgatcttcccttgtcagagataccgaggggggtgagggtcgccctggattacgaggccggacaggtcacactgcataacgcccagacacaggaacccattttcactttcactgctagcttcagcggtaaggtgttcccgttttttgctgtgtggaagaagggctcttgcttgacacttaaagggtag

SEQ ID NO: 60428 - DNA, 348 bp, Artificial Sequence
  Description of Artificial Sequence: Synthetic coding sequence
atgcctgccaccccctccctcaaagtcgtccatgagctcccggcatgcactctgtgcgctggccctttagaggacgctgtgacgatcccatgtggccacaccttttgtaggctctgcctgcccgctctctcccagatgggggctcaatccagcggaaagatcttactgtgtcctctctgccaagaagaagaacaggctgagacccccatggcacctgtacccctgggccctctcggtgaaacttactgtgaagaacacggcgagaagatatactttttctgcgagaatgacgccgagttcctatgcgtttccgaatgccgcaccaccgatggcttcggatgcgcttag

SEQ ID NO: 60429 - DNA, 1191 bp, Artificial Sequence
  Description of Artificial Sequence: Synthetic coding sequence
atggctcccgtgcctttgggacctctgggtgaaacgtattgcgaggaacacggtgagaagatttattttttctgcgaaaatgatgccgaattcctatgcgtgttttgtcgcgaaggtccgacccaccaggcccacacagtcggatttttggatgaagccatacagccctaccgcgaccggcttcggagcaggctcgaagctctgagcactgaacgagatgaaatagaggatgtaaaatgccaagaggatcagaaactccaggtgttgttgacccagatcgagtcgaaaaaacatcaggttgagaccgcttttgagaggctgcagcaggagctcgaacagcagaggtgcctcttactggctcgcctgcgagagcttgaacagcagatctggaaggaacgtgacgaatatatcacaaaggttagcgaagaagtgactcgcctgggagcacaggtgaaggagctcgaggaaaagtgccagcagcctgcctccgaactgctacaggtgatcagagagggtttgcacgggtgcgagatgaagactttcgtttcaccagaggccatctctccagacctcgtgaagaaaatacgggattttcatcgaaagatcttaacgctccccgaaatgatgcggatgttctccgagaatctggcacatcatctcgagattgactcaggggttattacgctggatcctcagactgcaagccggagtctggtgttgtctgaggaccgaaagtcagttcggtacaccaggcaaaagaagtccttgcccgattccccactgcggttcgatggcctgcctgctgtactgggatttcctggattctcttccgggagacacagatggcaggtggacctgcagctgggagatgggggagggtgcacggtgggcgtggccggagagggcgtgaggaggaagggtgagatggggctcagtgccgaggacggcgtgtgggccgtgatcattagccaccagcagtgctgggccagtacatctcccggaacagacttgccactgagcgagattccaagaggcgtcagggtggccctggactacgaggcaggccaggtcacactccacaatgcccagacgcaggagccaattttcaccttcactgcgtcatttagtggaaaggtgtttccatttttcgccgtctggaagaagggcagttgcctcacgctaaagggatag

SEQ ID NO: 60430 - DNA, 348 bp, Artificial Sequence
  Description of Artificial Sequence: Synthetic coding sequence
atgcctgcgacccccagtcttaaggtggtccacgagcttccagcctgtactctctgtgcaggcccactcgaagatgcagtgacgattccctgcggtcacacgttctgcaggttgtgtctcccagcgctgtcacagatgggtgcgcagtccagtgggaagatactgctgtgccccctatgtcaggaggaagaacaggcagagacacccatggcaccagtgccattggggccactgggcgaaacttattgcgaggagcacggcgagaagatctattttttttgtgaaaacgacgcagagttcctctgtgtctccgagtgccgtaccacagacgggtttggttgcgcctag

SEQ ID NO: 60431 - DNA, 348 bp, Artificial Sequence
  Description of Artificial Sequence: Synthetic coding sequence
atgcccgctaccccctcccttaaggttgttcatgaactacctgcctgcaccctgtgtgcaggaccactcgaggacgctgtcacaataccatgtggccacacgttctgcaggttgtgcctgcctgccctaagccagatgggagcccagagctcagggaagatactcctctgcccactctgccaggaagaagaacaagccgagactcccatggccccagtgccgttaggccctctgggcgagacttactgtgaagagcacggcgaaaaaatttatttcttttgcgagaatgatgcagagtttttatgtgtatcagagtgcagaaccactgacgggttcgggtgcgcctag

SEQ ID NO: 60432 - DNA, 1434 bp, Artificial Sequence
  Description of Artificial Sequence: Synthetic coding sequence
atggaagctgtggagctggctagaaaattacaggaggaagctacctgcagtatctgtctggactattttactgatcccgtgatgaccacctgcggccacaacttctgcagggcatgtatccagttgagctgggaaaaggctcgcggaaagaaggggagacgtaaacgcaagggatccttcccctgtccagaatgtcgggaaatgagtccgcagcgaaacctgctccctaaccgtctgttaacaaaagtagcagagatggctcagcagcaccccggtctccaaaaacaggacctatgtcaggagcaccacgagcctctcaaattattctgccaaaaggaccaatcgccaatctgtgtcgtctgccgcgagtctcgggagcatcgcctgcatagagtgttgcctgctgaagaggcggtccaaggctacaagttgaaacttgaggaggatatggaataccttcgcgaacagattaccagaacgggaaacttgcaggccagagaagagcagtcactggctgagtggcagggcaaagtaaaggagaggcgggagcgaatcgtcctggagttcgagaagatgaacctgtaccttgtcgaggaagagcagaggctgcttcaagctctggagactgaagaagaagaaactgccagccggctcagggagtctgttgcttgtctggaccgccagggccactctctggagctcctgctactgcagcttgaagaacggagcactcagggcccattgcagatgcttcaggatatgaaagagcctttgtccagaaagaacaacgtgagcgtgcagtgcccagaggttgctccccctacccggccaagaacggtgtgccgcgtccccggtcaaatcgaggtcttacgcggatttctggaagatgtggtccctgacgcgacaagtgcctatccatatctcctcctgtatgaatccaggcagagacgctatctcggttcaagtcctgaggggtccggtttctgttcaaaggatagattcgtggcctatccatgcgccgttgggcagactgctttttccagcgggcgacactattgggaagttggaatgaatataaccggtgatgccctgtgggccctgggtgtgtgtagagacaatgtcagtagaaaagatagagtcccgaaatgccccgaaaacggcttctgggtggtgcagctcagcaaaggaacgaaatacctctcaactttcagcgccctcactcccgtgatgctcatggaacctccatcccatatgggtatattcctagattttgaagctggggaggtgtctttttatagcgtgtctgatgggagtcatctacatacgtacagtcaggccacgttcccaggccctcttcagccttttttctgtctgggagccccaaaatccggacagatggtaatctctacagttactatgtgggtgaaaggttag

SEQ ID NO: 60433 - DNA, 528 bp, Artificial Sequence
  Description of Artificial Sequence: Synthetic coding sequence
atggaggctgttgagctcgctcggaagttacaggaggaagccacctgcagtatttgtctcgattactttacggatcctgtcatgactacatgcggccacaacttctgcagggcatgcattcagctctcatgggagaaagcgcgaggaaagaagggacgacgaaaaaggaaaggatctttcccatgcccagaatgccgcgaaatgtctcctcagcgcaatctcctgcctaatcgcctcctgaccaaggtggccgagatggcccaacaacatcccggtttacagaaacaagacctttgtcaggagcatcatgaacctctcaaactcttctgccagaaggatcagtcccccatctgcgtggtgtgccgagaaagcagagagcacaggctgcacagagtcctgcccgctgaggaggcagtgcagggctacaagttgaagttagaggaagacatggagtatctccgggagcagataactcggactggtaaccttcaggccagggaagagcagtctctggcagaatggcagtag

SEQ ID NO: 60434 - DNA, 1434 bp, Artificial Sequence
  Description of Artificial Sequence: Synthetic coding sequence
atggaagccgtcgagctcgctcggaagctacaagaggaagcgacatgctcaatctgcctcgactatttcaccgacccagttatgaccacgtgcggtcacaacttctgtcgtgcctgcattcagttatcctgggaaaaagcaaggggcaagaaagggcgtcgtaaacggaaaggtagctttccgtgcccagagtgccgagagatgagccctcaacggaatcttctgccgaatagactcctcactaaagtggcggaaatggctcaacaacaccccggactgcagaagcaggacctgtgtcaagagcaccatgagcccctaaagctcttttgccagaaggaccagagccctatctgcgtagtatgtagggagtcccgggagcatcgcctgcatcgggtgcttcccgctgaggaggcagtccaggggtacaaactgaagctggaagaggacatggagtacctgcgcgagcagatcacacggacgggaaaccttcaggcacgggaagaacagagcctcgcggaatggcagggcaaggtcaaggaaaggagggagagaattgtgttagagttcgaaaaaatgaacctgtatctggttgaagaggaacagagattgctccaggcactggaaacagaagaagaggagactgcaagcagactgcgcgagtcagtggcatgtctggacagacaggggcatagtcttgagttgctgctgctgcagttggaagaacgcagtacgcagggacctttgcagatgttgcaggacatgaaagagcccctgagtagaaagaataatgtttccgtccagtgccccgaagtagcaccacctacccgtcctagaacagtttgtcgggtgcctggtcaaattgaggtccttcggggattcttggaggacgtggtgccggacgctaccagtgcctacccatacttgctgctgtatgagtccagacaacgaagatatctgggctcaagccctgaaggctccggcttttgcagcaaggatagatttgttgcctatccatgcgctgtaggtcagacggcattctcaagtgggagacactattgggaagtaggtatgaacattacaggagatgctctatgggctctcggggtttgtcgagacaacgtgtctcggaaggacagggtccctaaatgtcccgagaacggcttctgggtggtgcagctgtctaaggggaccaagtacctttcaaccttctccgcactcacccccgtgatgcttatggaacccccaagccacatgggcatcttcctggactttgaagctggtgaagtttcgttctactcagtcagcgacggaagccacctccatacctacagtcaggctacttttcccggtcccttacaacccttcttctgcctaggggcacccaagtcggggcagatggttatttcaacagtgaccatgtgggtgaaaggatag

SEQ ID NO: 60435 - DNA, 1434 bp, Artificial Sequence
  Description of Artificial Sequence: Synthetic coding sequence
atggaagccgttgaactggcacgcaaactgcaggaggaagcaacttgcagcatttgcttagactatttcaccgaccccgtgatgaccacttgtgggcataatttctgcagggcatgcatccagttgtcatgggagaaagcccgaggaaagaagggcagacggaagcgaaaggggtcttttccttgccctgagtgcagagagatgagtccccagaggaacctgttgccgaaccggcttcttacaaaagtggcagaaatggcccagcagcaccctggtctacagaaacaggatttgtgtcaggaacaccatgagcctctgaaactcttctgccaaaaggaccagtcgcctatttgtgtggtctgtcgtgagagtcgcgaacatcgattacaccgggtcctgccagccgaagaagccgtccagggctataaactgaaactggaggaggatatggagtaccttcgcgagcagattacacgcaccgggaacctgcaggcgcgagaggagcagagtttggccgagtggcaggggaaagtgaaggaacgcagggagaggatcgttctggagtttgagaaaatgaacctgtacctagttgaggaagaacaacggctgctgcaggccttagagactgaagaggaagaaactgcaagtagactgagggaatcagttgcatgtctagaccgccagggacattcgctggagcttctcctgctgcagttggaagagagatccacccagggacctctgcaaatgcttcaggacatgaaggaacctctttccagaaagaacaatgtgagtgtccagtgccctgaggtcgcacctccaacgaggccacggaccgtgtgtagagtgcccggacagattgaagtacttcggggttttttagaggacgtcgtcccagatgccacatccgcctacccttatctcctgctctacgaaagccggcagcggaggtatctgggatcgtcaccggagggctccggattctgctccaaggacaggtttgtagcttacccctgcgcagtgggccagacagccttctcttcaggccgtcactactgggaagtcggcatgaatatcacaggggatgctctctgggctctcggcgtgtgccgcgataacgtaagtcggaaagatagggtgcccaagtgtcccgagaatggcttttgggtggtacaactgtcaaaaggtacgaaatatttaagtacattttctgcactgactcctgtcatgttaatggaacctcctagccatatgggaatatttctcgactttgaggctggggaagtgtctttctactcagtatcggacgggtcccatctgcacacgtacagtcaggctacatttcctgggccactgcaaccatttttttgtctcggcgctcctaagtccggccagatggtcatttccacagtgacaatgtgggtgaagggttag

SEQ ID NO: 60436 - DNA, 1032 bp, Artificial Sequence
  Description of Artificial Sequence: Synthetic coding sequence
atggaggccgttgagctggcacggaagctgcaggaggaagctacctgtagtatctgtctggattacttcactgacccagtgatgaccacctgtggacataacttttgtagggcttgcatccagctatcctgggagaaagcccgaggaaaaaagggcaggaggaagcgtaaggggtctttcccctgtcccgagtgcagagaaatgtctcctcagcggaatcttttacccaaccggctcctgacaaaggtggctgagatggcacagcagcaccccggactccaaaagcaggatctatgccaggagcatcatgaacccctgaaactcttctgccagaaggaccagagcccgatttgtgtggtctgtagagagagcagggaacacagactgcacagggtgctccctgctgaagaggccgtgcaggggtataagctcaagctggaggaagacatggaatatctaagggaacagattacacggacaggtaacttacaggcgagggaagagcagagtctggcagagtggcaagggaaagtgaaggaaaggagggagagaattgtgttagagtttgaaaagatgaatctgtacctggtcgaagaggagcagagactcttacaggcattagaaactgaggaagaggaaaccgcctccaggctgcgtgagtcagtggcatgcctcgacagacagggccactctctcgagctgttgcttctccagctggaggaacgtagtacgcaaggccctctccagatgctacaggatatgaaagaaccgctgagcagaaaaaacaacgtgtcagtccaatgccctgaggtggcaccccctacccgtcctaggaccgtatgtagggttccgggacagatcgaagtgcttcgcggttttctgggcaagtgggctcccagggcaagaaccagtgatcccggttccctgggagacgctcccctctatcctctcgcttcggaggccacgaatggcggaggcagtaccagcgcccttcctggcgacggtcactggctgttcacggtgcctagctag

SEQ ID NO: 60437 - DNA, 153 bp, Artificial Sequence
  Description of Artificial Sequence: Synthetic coding sequence
atggaagctgtggagctggccaggaagctccaggaggaagccacctgttctatctgcttagattattttactgacccggtgatgactacttgcgggcataatttttgtcgtgcttgcattcagctgagttgggagaaggcaaggggcaagtag

SEQ ID NO: 60438 - DNA, 1398 bp, Artificial Sequence
  Description of Artificial Sequence: Synthetic coding sequence
atggcctccacaacgtccactaagaaaatgatggaagaggctacatgcagcatctgcctgtcgctgatgacaaatcccgtctctatcaactgcggccattcttattgccatctctgcatcacggacttttttaaaaacccttcccagaaacagctccggcaggaaaccttctgctgtccgcagtgcagagcccctttccacatggacagccttcgacccaataagcaacttggctctctcatcgaggccctcaaggaaacggatcaagagatgagttgtgaagagcacggtgaacagtttcatcttttctgtgaagatgaagggcagttgatttgttggcgatgtgagcgggctccgcagcataaaggccacactactgcccttgtggaagatgtctgccaagggtataaggaaaaattgcagaaagctgtgactaaactgaagcagctagaagatcgttgtactgagcagaaactgagcacggcaatgaggataactaagtggaaagaaaaagtgcagatacaacgacagaagattcggtcagacttcaaaaacctccagtgtttccttcacgaggaggagaagtcttacctctggcgcctggagaaggaagaacagcagacgttaagccgcctgcgcgactatgaagctggactagggctgaaatctaatgaactgaagtcacacattctggagctggaagagaaatgtcaaggatcggcccagaagctgttgcagaatgtcaatgataccctgtcacgctcttgggcagtcaagcttgaaacctcagaggcggtgtcactggagctgcacactatgtgtaatgtgtctaagctctactttgatgtgaaaaaaatgttgcgctctcaccaggtcagcgtgacgctggacccggatactgcccaccatgaactgattctgtctgaagacaggcggcaggtgaccagaggatatacgcaagaaaatcaggacacaagcagtaggcggtttaccgcctttccatgcgtgctgggctgcgagggcttcacgagcggcagacgttattttgaagtcgacgttggggaagggactggctgggacctgggagtgtgcatggaaaatgtacagcgcggaaccggcatgaaacaagagccccagtctggcttttggactcttagactgtgcaagaagaagggatatgttgcactgacgtctccccctacatcactgcacctccatgagcagccactgcttgtgggtattttcctggactacgaggccggagtggtctccttctataatgggaacaccggctgtcacatctttaccttccctaaagcatcattttcagacaccttgaggccatatttccaggtgtaccagtattcacctctatttctgccccctcccggtgactag

SEQ ID NO: 60439 - DNA, 1398 bp, Artificial Sequence
  Description of Artificial Sequence: Synthetic coding sequence
atggcttcaaccacatctacgaagaagatgatggaggaggccacttgtagtatttgcttatccctgatgacaaaccctgtgtccatcaactgtggccacagctattgccacttgtgtatcactgatttttttaagaacccgagccagaagcagctgcggcaggagactttctgttgcccccaatgcagggctcctttccacatggactccctcaggcctaataagcaactgggcagcctgattgaagcactcaaggagacggaccaagagatgagctgcgaagagcacggcgagcagttccacctgttctgcgaagatgagggccagctgatctgttggaggtgcgaacgcgctccacagcataaagggcacaccaccgctttagtggaggatgtgtgtcaggggtataaagagaagttacagaaagctgtcactaagttaaagcagttagaggaccggtgcaccgagcagaagcttagcactgctatgaggataactaagtggaaggagaaggttcaaatccagagacagaaaatccgatcggattttaagaacctccagtgtttccttcacgaggaagagaagtcgtacctgtggcgactcgaaaaggaggaacagcaaaccctctcgcgcctccgtgactacgaagctggccttggactcaagtccaacgagttgaagagccacatcctcgagctggaggagaagtgccaggggtcggctcagaaactgcttcagaacgttaatgacacacttagcaggagctgggctgtgaaattggaaacttccgaggcggtttcactggaactgcacacgatgtgcaatgtgtccaaactctattttgacgtgaagaaaatgctgcggagtcatcaggtatcagtaaccctggaccccgacacagcacatcacgaactgattctctccgaggaccggcgtcaagttactagaggctacacacaggagaatcaagacacttccagtagacgcttcaccgcctttccatgtgtgctggggtgtgaaggatttacgagcggaagaaggtatttcgaggtcgatgtgggtgagggaactgggtgggacttaggcgtgtgcatggaaaatgtccaacgaggaactggcatgaagcaggaaccacagagcggtttctggaccttacgactttgcaaaaaaaaaggctatgtggctttaacctcaccccctaccagcctgcatttgcatgaacagccacttctggtcgggatttttttggactatgaggccggagttgtaagcttttataatggaaacacaggatgtcatattttcacattccccaaagcgtcatttagtgacacattgaggccttacttccaggtgtaccagtatagtcccctctttctcccaccccctggcgactag

SEQ ID NO: 60440 - DNA, 1398 bp, Artificial Sequence
  Description of Artificial Sequence: Synthetic coding sequence
atggcaagtacaacatctacgaagaagatgatggaggaggccacctgttctatctgtctaagtctgatgaccaacccagtgtccattaactgcggtcactcgtattgtcacctgtgcattaccgatttctttaaaaatccttcccagaaacaactgaggcaggaaacgttttgctgccctcagtgcagggctcccttccatatggactcactgcgcccaaacaagcagctaggtagccttatagaggcactaaaggagacagatcaggaaatgagctgtgaggaacacggcgagcagttccatcttttctgcgaggatgagggacagctcatttgctggcggtgtgagcgtgctcctcagcacaagggccataccacagctctggtggaagacgtgtgccaggggtacaaggagaaactccaaaaggccgttactaaactgaagcagctcgaagaccggtgtacggagcagaaactttcgaccgctatgcgaataaccaagtggaaagagaaagttcagattcagaggcagaagattcgatctgattttaagaatttacaatgttttttacatgaggaagagaaaagctacctctggcgcctagagaaagaggagcaacagaccttaagccgcctgagagactatgaggccggtctcggactgaagtccaacgaactcaagtctcacatcttggagctggaggagaagtgccaaggtagcgctcagaagttactgcaaaacgtgaacgataccttgtccagatcttgggccgtcaagctggaaaccagcgaggcagtgtctctcgaactacataccatgtgtaacgtaagcaagctgtatttcgacgttaagaagatgctgagatctcaccaggtgtccgtgacactggaccctgataccgcccatcatgaactaatcctctcggaggatcgccgtcaggtgacccgcggttatacacaagaaaaccaagatactagctcccggagatttacagcgtttccatgcgtactcgggtgtgaaggctttactagcggcaggaggtacttcgaagttgatgttggcgaaggaaccggctgggacttaggggtctgcatggaaaacgtccaacgagggacaggcatgaagcaggaacctcaatccggattttggacgttacgactttgtaagaagaaggggtacgtagcactgactagcccaccaacctcgctgcacctccatgagcagcctttgctcgtagggatcttcctagactatgaggccggagtggtctccttttataatggaaacaccgggtgtcatatttttacctttcccaaggcctctttttcagatacactcagaccgtactttcaggtatatcaatattctcctctctttctgccaccacctggcgactag

SEQ ID NO: 60441 - DNA, 690 bp, Artificial Sequence
  Description of Artificial Sequence: Synthetic coding sequence
atgatcccgctccagaaggataaccaggaagaaggcgtttgtcctatttgccaggaatcgcttaaggaggccgtatcaaccaactgcggccatctgttctgtagagtgtgcctcacacagcatgttgagaaagcgagtgcatccggagtgttctgctgccccctgtgcaggaaaccctgttcggaagaagtgcttggtactggttatatctgccccaatcatcagaagcgcgtgtgcagattctgcgaagagtcccggctgcttctctgtgtagagtgtctcgtaagccccgagcacatgagtcaccatgagttgaccatcgaaaatgcattatcccattacaaagagagactgaacagaaggagcaggaagctgaggaaagatattgccgaactgcagcgcctgaaagcacaacaggagaagaagctgcaagctctgcagcagtggctcggccaactggaacatatgccggctgaagccgctagaatcctggacattagtagagccgtgactcagctgcgatccctggtgatcgacctcgagaggaccgcaaaggagcttgatacaaataccctcaaaaacgctggcgacttgctcaacagaagtgcacctcaaaagcttgaggtaatttatccgcagctagagaagggggtatcagaactgctgctgcagccacctcagaagctgtag

SEQ ID NO: 60442 - DNA, 777 bp, Artificial Sequence
  Description of Artificial Sequence: Synthetic coding sequence
atgatcccactgcagaaggacaatcaggaggaaggtgtctgtcccatttgccaagaatcactgaaagaggccgttagtaccaattgcggccacctgttctgccgggtctgcttaacccaacatgtcgaaaaagcaagtgcaagtggcgtgttttgctgtcccctgtgcagaaagccgtgtagtgaagaagtcctaggaactgggtacatctgccccaatcaccagaaacgagtttgcaggttttgtgaggagagccggttgctcctgtgcgttgaatgcctcgtgagccctgaacacatgtctcaccacgagctgaccatcgaaaacgcactgagccactataaggaaaggcttaatcgtcgtagcaggaagctccggaaagatattgccgagctgcagagactgaaagcacagcaggaaaaaaagctccaggccctacaatttcaggtggaccacgggaaccatagattggaggccggaccagaatcccagcatcaaacacgcgaacagctcggtgcactgccacagcagtggctgggacagttggagcacatgcccgctgaagcagccaggatcctggacatctcaagggccgtcacacagctcagatccctcgtgatcgaccttgagaggaccgccaaagaacttgacaccaatactcttaagaatgctggtgacttactgaaccgcagtgccccacagaagcttgaggtgatttacccgcagttagagaagggcgtgagcgagctgctcttgcagccaccccagaagctgtag

SEQ ID NO: 60443 - DNA, 777 bp, Artificial Sequence
  Description of Artificial Sequence: Synthetic coding sequence
atgatcccccttcagaaagacaaccaagaagagggagtgtgcccaatatgtcaggagagcctgaaggaagctgtgtccacaaattgtgggcacctgttctgtagagtctgcctgacacagcacgtggaaaaggcttcagccagtggcgtgttctgctgtcctttatgccgtaaaccatgtagcgaggaggtgctcggcaccgggtacatctgtcccaaccaccagaaacgagtctgccggttttgtgaagaaagccggctcctgctttgtgttgagtgtctggtttcacccgagcacatgagccaccatgagctgaccatcgagaatgccctctcacactataaagagagattaaatcgcaggtcgagaaagctgagaaaggatattgccgaacttcaacgtctgaaggctcagcaggaaaagaagctgcaagcgctgcagttccaggtggaccatgggaaccaccggctcgaagcaggccctgaatcacagcatcagacccgagaacagctgggggctctcccccaacaatggctcggtcagttggagcacatgcctgccgaggccgctaggatcctagatatcagtcgagccgtcacccaactgcggtctcttgttatcgacctggaaagaacggctaaggaactggacaccaataccttgaaaaatgcaggcgacctcctgaaccggtcagctccacagaagttggaggtaatttacccccaattggagaagggtgtatcagaactcctcctgcagcccccacagaagttgtag

SEQ ID NO: 60444 - DNA, 777 bp, Artificial Sequence
  Description of Artificial Sequence: Synthetic coding sequence
atgatcccgctgcagaaagacaatcaggaggagggtgtgtgtccgatctgccaggaatcactgaaagaagccgtgagtacgaattgcggtcacctgttctgccgagtgtgtcttacccagcacgttgagaaagcttcggcgagcggagtgttctgctgtcccctttgtaggaaaccttgctctgaggaagtcctgggcacaggttatatttgtccgaatcatcagaaacgcgtgtgtcgcttttgcgaggagtctcggctacttttatgtgtggaatgcttggtttctcccgagcacatgtctcatcatgagctcaccatcgagaatgcattgtctcactataaagagcggctcaatcggaggagccgtaagctcagaaaagatatcgcagagctgcagaggctcaaggcacaacaagagaagaagttgcaggcactgcagtttcaggtggatcatggcaaccataggttggaggcaggcccagaaagccaacaccaaaccagggaacagctgggcgcactgccccagcagtggcttggtcagcttgagcacatgcccgctgaagcagcaaggatcctcgacatttcccgtgcagtcacccagctccggagtctggttatagacttggaacggacagctaaggaactggacacgaacaccttgaagaacgcaggcgatctgcttaacagatccgcaccacagaaactggaagttatctacccccagctagaaaagggggtttcggagctgctgttgcagcccccacagaagttgtag

SEQ ID NO: 60445 - DNA, 690 bp, Artificial Sequence
  Description of Artificial Sequence: Synthetic coding sequence
atgattcccctgcagaaggataatcaagaagaaggcgtctgccccatctgtcaagaaagcctaaaggaggccgtctcaaccaattgtggacacctgttctgtagggtttgcctgacgcagcatgtggaaaaagcctccgctagcggggtgttctgttgccccctctgtcgcaaaccatgctcggaggaggtgctgggtacaggatatatctgtccaaaccaccagaaaagggtctgtaggttctgcgaagagagccggctcctgttatgcgttgagtgtctggtgtccccagaacatatgtcccatcatgagttaacaatcgaaaatgctctgtctcactacaaggagaggctgaacaggcgcagccgaaagctgcggaaggatatcgccgagctccagaggcttaaggctcaacaggagaaaaaactgcaagctttgcaacaatggctgggtcagcttgaacatatgcccgctgaggctgctcggattctcgacatctcaagggcagtcacccagctccgatcacttgtgatcgatctcgagcgtacggcgaaggaacttgacaccaacactttgaagaacgctggggacctgctgaatcgaagcgcaccgcagaagctcgaggtgatctacccccaattagagaaaggtgtcagcgagctccttttgcagcctccgcagaagctgtag

SEQ ID NO: 60446 - DNA, 690 bp, Artificial Sequence
  Description of Artificial Sequence: Synthetic coding sequence
atgattcccttgcagaaagataatcaggaagagggcgtatgtcctatctgccaggaaagcctcaaagaggccgtcagtaccaattgtggccatcttttctgtagagtgtgtctcacccaacacgtagagaaggcgtctgccagcggcgttttctgttgtcctctgtgtaggaaaccctgcagtgaggaagtgctgggcacaggctatatttgtccgaatcatcagaagcgggtgtgtcgtttttgcgaagagagccgactgctcctctgcgttgagtgcctcgtcagcccagaacatatgtctcaccatgaactcaccattgagaatgctctgtcccactataaagaacggttaaacaggcggtcacgcaagctcagaaaggacatcgccgaactgcagaggctcaaggcacaacaggagaagaaactgcaggctctgcagcagtggctgggccagttggagcacatgcctgctgaggccgctcgtattctagatatatcaagagccgtaacccaacttcgctcattagtgatcgatctggaacgcatggcgaaagaactagataccaacacacttaaaaatgcaggggacctccttaacagatccgcccctcagaagctcgaagttatctatccccagctcaaaaagggcgtgtcagaactcctcctacaaccccctcaaaaactgtag

SEQ ID NO: 60447 - DNA, 690 bp, Artificial Sequence
  Description of Artificial Sequence: Synthetic coding sequence
atgatacccctgcagaaggataatcaagaggaaggcgtgtgccctatctgccaagaaagcctcaaggaagccgtttccacaaactgcgggcacctcttttgccgagtgtgcttgacacaacatgtggagaaggcctccgcatctggagtcttttgctgccccctgtgccgcaagccttgcagtgaggaggtcctcggcacaggatacatttgtcccaaccaccagaaacgcgtgtgtagattttgtgaggagagtcgtctgctcctgtgtgttgagtgtctcgtaagtcccgagcacatgtctcaccatgagctgacgatagagaatgccctgagccactacaaagaacgacttaatcggaggtcccgcaaactgcgtaaagacattgctgagttacaacgccttaaagcccagcaggaaaagaaactgcaagctctgcagcagtggctgggacagctagaacacatgccagccgaagctgccagaatcctagacatctccagagcagtaacccagttgcgcagcttggtcatcgatctcgagcgcaccgcaaaggagctggacacaaataccctcaagaacgcaggagacttactaaataggagcgccccacagaaattagaagtcatttacccacagcttgaaaagggtgttagcgagctgctgctccaacccccacagaagctgtag

SEQ ID NO: 60448 - DNA, 777 bp, Artificial Sequence
  Description of Artificial Sequence: Synthetic coding sequence
atgattccactgcagaaggacaaccaggaggagggcgtctgcccaatatgccaagagtcattaaaagaagccgtgtctaccaattgcgggcacttgttctgtagggtatgtctgacacagcacgtagagaaggcttctgcatcaggcgtgttctgctgccccctgtgccgcaagccctgtagcgaggaggtgctgggaactggctacatatgtcccaatcatcagaagagagtttgtagattttgtgaggaatccagacttcttctgtgtgtggagtgtcttgtcagccctgagcacatgtcacaccatgaactgaccatagaaaacgcgctctcccattacaaggaacggctgaacaggcgctcacggaagctgaggaaagacatcgccgagctccagaggctaaaggctcagcaggagaagaagcttcaggctctccaattccaagtagatcatggaaaccataggcttgaagccggtccggaatcccagcaccagacaagagaacagttaggcgcactgcctcagcagtggctcgggcagttagaacacatgcccgctgaagccgctcgtattctggatatttcccgtgcggtaactcagctaaggagcctggtaattgacctcgaacgcatggccaaggagcttgatacgaacacactgaagaacgccggtgaccttctgaaccgaagcgccccacaaaaactagaggtgatttatccacagctgaagaagggggtttctgaacttttgttacaacctccacagaaattgtag

SEQ ID NO: 60449 - DNA, 690 bp, Artificial Sequence
  Description of Artificial Sequence: Synthetic coding sequence
atgattcctctgcaaaaagataaccaggaggaaggagtctgcccaatttgtcaggagtccctcaaagaggcagtgtctaccaactgtggtcacttgttctgccgtgtatgtctgacacagcatgtagagaaagcttctgcaagcggggtgttttgctgtcctctttgccgcaagccttgtagcgaggaggttctcggcaccggatacatatgccctaatcatcagaaacgcgtgtgcagattttgtgaggagtccaggctgctgttgtgtgtggaatgccttgttagccctgagcacatgtctcaccatgagttgaccattgaaaatgccttgtctcattataaagagcgacttaaccgcaggtctcgcaaactgcgcaaggatattgccgagttgcaaaggctcaaggctcagcaggagaagaaacttcaagctttacagcagtggcttgggcaactggaacatatgcccgcagaagccgcacggatcctggatatctcaagggccgtaacccagctcaggagtctggtcattgacctcgaaaggaccgccaaggagttggacactaatacactgaagaatgccggtgatctgctgaaccgctcagccccacaaaaactggaagtgatttacccccagctggagaagggtgtctctgaattgctgttacaaccaccccagaagctatag

SEQ ID NO: 60450 - DNA, 777 bp, Artificial Sequence
  Description of Artificial Sequence: Synthetic coding sequence
atgatacctttgcaaaaggacaaccaggaggagggggtgtgtccaatttgccaagagagcttgaaagaggcagtttctacgaattgcgggcaccttttttgccgcgtttgtctgacccagcatgtggagaaagctagcgctagcggggtcttttgctgtcctctgtgcagaaagccttgcagcgaggaggtcctgggtactggctacatctgccctaaccaccagaagagggtgtgtagattctgcgaggagtcgcggctattattgtgtgtcgagtgcctggtgtcaccagaacacatgtcacaccatgagctgaccatagagaacgctctgtcacactacaaagaacgcctgaatcgtaggagcaggaagctgaggaaggacatcgcagagttgcaaaggttaaaagctcagcaggagaaaaagctgcaggccctgcagttccaggtggaccacggcaaccatcgcctcgaggccggaccagaaagtcagcaccagacccgcgaacaattgggggctcttccacagcaatggctgggccagctggagcatatgccagccgaggccgctagaattcttgacatttcaagggccgtaacccagcttcgctctctggtcattgacttagagagaatggctaaagagttggacacaaacacccttaaaaacgctggggacctcttaaatcgctctgcacctcaaaagctggaggtcatctatccacagctgaagaagggcgtgagcgaacttctccttcaaccaccccagaaactctag

SEQ ID NO: 60451 - DNA, 777 bp, Artificial Sequence
  Description of Artificial Sequence: Synthetic coding sequence
atgataccccttcagaaagacaaccaggaagagggcgtgtgccctatatgccaggagtccctcaaggaggcagtgagcacgaactgtggccacctcttctgcagagtgtgtttgacacagcatgtggagaaggccagtgcatcaggggtcttttgctgccctctgtgtagaaaaccttgttccgaggaggtactcggtactggctatatctgcccaaatcatcaaaagagagtgtgcagattctgtgaagaatcaaggctactgctatgtgtggaatgcctggtgtcccccgaacacatgtcacaccacgaactgacaatcgaaaacgctctttcccactgcaaggagcgcctgaaccgcagatctagaaagctcaggaaggacatcgctgaattacagaggcttaaagctcagcaggagaagaaattgcaggctctccagttccaggtggaccacggcaaccaccgactggaggctggcccagaatcccaacatcaaaccagagagcaactgggagctctccctcagcagtggctgggacaactcgagcatatgccagccgaggcagccagaatccttgatattagccgcgctgtgacccagttgcgtagcctggttattgacttggagagaactgcgaaggaactggatacaaatacacttaagaatgccggtgacctgctgaaccgcagcgcccctcaaaagctggaggttatctatcctcaactcgaaaaaggcgtgagcgaactattactccagcccccacagaagctgtag

SEQ ID NO: 60452 - DNA, 777 bp, Artificial Sequence
  Description of Artificial Sequence: Synthetic coding sequence
atgattcctctacaaaaggacaatcaggaagagggagtgtgtccaatttgtcaggaatcactcaaggaggccgtgtcaacaaattgtggccacctcttttgtagggtgtgcttgacccagcatgtggagaaagcttcagcaagtggagtcttctgctgtcctttgtgtaggaaaccatgctcagaggaagttctggggacaggctatatctgtccaaatcaccaaaaacgtgtgtgtcggttttgcgaagagagccgccttctgctgtgtgtggaatgtctcgtgagccctgaacatatgtcccatcatgaattaaccatagagaacgctctttcacactataaagaaaggctgaacaggcgttctcgaaagctgaggaaggacatcgccgagctgcagaggctcaaagcccaacaagagaaaaagctccaggcgttacagtttcaggtcgatcatggtaaccacagactcgaggctggccctgagagccagcaccagacgagggaacaacttggggcattgccccagcagtggctgggtcagctggagcacatgcccgcagaagctgcgaggattctagacatctcaagagccgtcacgcaactaagatctctcgtcatcgatctggaaaggacagcgaaagagctggatactaacactttgaagaatgctggggacctattaaaccgctccgcaccgcagaagctggaggtcatctacccccagctggaaaaaggcgtgtcagagctcctcctgcagccacctcagaaactgtag

SEQ ID NO: 60453 - DNA, 777 bp, Artificial Sequence
  Description of Artificial Sequence: Synthetic coding sequence
atgataccactgcagaaggacaaccaggaggaaggagtttgcccaatctgccaagagtcactgaaggaagctgtgagtaccaactgtggccatctgttttgtcgggtgtgcttgacacagcatgtggagaaggcctctgcgagtggagttttctgctgtcctttgtgcaggaaaccttgcagcgaggaagtgctcggcactgggtacatctgccccaaccatcaaaaacgagtgtgcagattctgtgaagagtcacgactcctcctgtgtgttgagtgtcttgttagccctgagcatatgtcacatcacgaattgactattgaaaacgccttatcacactataaggagcgcctgaaccggagatcaaggaaacttcggaaagacatagctgagctgcaacggctcaaggcccaacaggagaaaaagttacaggcactgcagtttcaggtcgatcacggcaaccatcgactggaagccggacccgagtctcagcaccaaacacgggagcagctgggggctctgcctcagcagtggctggggcagcttgagcacatgcccgctgaagccgctcgcattctcgacatcagtcgtgcagtgacccagctgcggagcttggtgatcgacctagagcggaccgccaaggagttggacacaaacacgttgaaaaatgcaggggacttactgaacaggagcgcacctcagaagctggaggtgatttatccccagcttgaaaaaggagtctccgagcttctgctgcaaccaccacagaagctctag

SEQ ID NO: 60454 - DNA, 690 bp, Artificial Sequence
  Description of Artificial Sequence: Synthetic coding sequence
atgatccctctccaaaaggacaatcaggaggaaggcgtctgccctatatgtcaggaatcccttaaagaggcggtgtctactaattgcggacatctgttttgccgcgtgtgcctcacacagcatgtggaaaaagcaagcgcaagcggcgtgttctgttgtcctctatgtagaaaaccttgtagtgaagaggtgcttggtactggatatatttgccccaaccatcaaaagcgggtctgtcggttttgcgaggaatcacgcctcctactgtgcgtggagtgcctggtcagtcccgagcatatgagccaccatgagctgaccatcgaaaatgctctctcacattacaaggagaggctcaatcggaggtctaggaagttaagaaaggacattgccgaactccagagactgaaggcccagcaggagaagaagctgcaggcgctacaacagtggctgggccagctcgagcatatgcccgctgaagcagccagaatactcgacatctctcgtgcagtcactcagcttcgctctctcgttatagatttggagaggactgcaaaggaactggacactaacacgctgaaaaatgctggagacctgctgaacaggagcgcaccccagaaattggaggtaatttacccccaactagaaaagggagtctcagagttgttgcttcagcctccgcagaagctctag

SEQ ID NO: 60455 - DNA, 777 bp, Artificial Sequence
  Description of Artificial Sequence: Synthetic coding sequence
atgatcccactccagaaggataatcaggaagagggagtatgcccaatctgccaagagtcccttaaagaggccgtatctacgaactgtggccacctgttttgccgcgtgtgcctaacgcagcacgtagagaaggctagtgcctctggtgtattctgttgccctctgtgcaggaagccctgtagcgaagaggtcctggggacaggctacatttgtcccaatcaccagaaacgggtctgccgattttgtgaagagagtagactgctgctgtgcgttgaatgtttagtcagcccagagcatatgagccatcacgagctaacaatcgaaaatgccctcagccattacaaggagcgccttaacagaaggtcccgtaaactgcgcaaagacatcgcggaactacagaggcttaaggcgcagcaggagaagaagctgcaggcgctccagttccaagtggatcatggcaaccacagactcgaggcaggcccagagagtcaacatcagactcgcgagcagctcggtgccctccctcagcagtggctcgggcaactggaacacatgccggctgaagctgcacgcattctcgatatttctagagctgtgacacagttgagaagcttggtgattgacctggagcggacagctaaggaactcgataccaacacgctgaaaaacgctggggacttgttgaatcgttccgcgccacagaaactggaggtgatctacccgcagctggaaaagggggtgtctgaactcctcttgcagcccccacagaaattgtag

SEQ ID NO: 60456 - DNA, 690 bp, Artificial Sequence
  Description of Artificial Sequence: Synthetic coding sequence
atgattcccctgcagaaggacaatcaggaggagggggtatgtcctatctgtcaggaaagcctcaaggaggcagttagcacaaactgtggccatctgttctgtagagtttgtctgacacagcatgttgagaaggcaagcgcgtctggagttttctgttgcccattgtgtcgcaagccgtgctccgaggaagtactcggaactgggtacatctgcccaaaccaccagaaaagagtatgtagattctgtgaagagagccgactgctgttgtgtgtagagtgcctcgtttcgcccgaacacatgtcccaccacgaactcacaatagagaatgcactgagtcactgcaaggagcggctgaaccgcagatctagaaaactgaggaaggatatcgctgaactccagaggctcaaagcccagcaggaaaagaagcttcaggccttacagcagtggctgggccagctagaacacatgcccgcagaagccgcacggatactcgacatctctcgagccgtcactcagttgcgtagcctcgttatcgatctggagaggacggcaaaagagttggatacaaataccctgaagaacgctggggatctcctgaataggagcgcaccacagaaactagaggtaatctatcctcagttggaaaagggtgtaagtgaactcctcctacagccaccccagaagttatag

SEQ ID NO: 60457 - DNA, 690 bp, Artificial Sequence
  Description of Artificial Sequence: Synthetic coding sequence
atgataccattacagaaagacaatcaagaggagggagtttgtcctatctgccaagaatctctgaaggaagctgtctcaactaactgtggacacttgttctgtagagtgtgtttgacccaacacgtggagaaagcttctgccagtggtgtgttttgctgcccactctgcaggaaaccatgttccgaagaggtgttgggcaccggatatatatgtcccaatcaccagaagagagtgtgcaggttctgtgaggaatcaagacttctgctttgcgtagaatgcctggtgagtcccgagcacatgagtcaccacgaattgactatcgagaacgccctgagccactataaggagagactgaatcgcagaagcaggaagctacgtaaagatatcgcagagcttcagcgtttgaaagctcagcaagagaagaaattgcaggctctgcagcaatggctgggacagctagagcatatgcctgccgaagccgcacggatcttagacatctctcgggcagtgactcagctgcggagtctggtgatcgatctggagcgcatggctaaagagctcgacacgaacaccctgaagaacgccggagacttgctgaaccgctcagcacctcagaagctcgaggtgatttaccctcagctcaaaaaaggggtgtcagagctccttctgcagccacctcagaaactttag

SEQ ID NO: 60458 - DNA, 777 bp, Artificial Sequence
  Description of Artificial Sequence: Synthetic coding sequence
atgattcccctccagaaggacaaccaggaagagggagtatgcccaatctgccaagagagtctgaaggaggccgtgtctactaattgcggccacctcttctgcagggtgtgtttgactcagcacgtggagaaggccagtgcttctggcgtgttctgctgtccactttgtcggaagccatgctccgaagaggttctcgggactggctacatctgccccaatcatcagaagcgggtatgcaggttttgtgaggagagtcgcctgctgctgtgtgtggaatgcctggtgagtccggaacacatgtctcatcacgagcttactattgagaacgctctgtcacattacaaggaaagacttaatagacgaagccggaagctgaggaaggatattgccgagcttcagcgcctaaaggcgcagcaggaaaaaaagctgcaagctctccagttccaggtggatcacggtaaccataggttggaggccggacctgagtcccagcatcaaaccagagaacagttaggcgctctgcctcagcaatggttgggccagctcgagcatatgcccgcagaagccgctcgcattcttgatattagcagggcagtaacccaactgaggtccctagtgatcgatcttgaaaggactgccaaggagctcgacactaatactctgaagaacgccggtgacctgcttaaccgctccgcccctcaaaaactggaggtcatatatccacaactggagaagggggtgagtgagttgctgctgcagccacctcaaaaactttag

SEQ ID NO: 60459 - DNA, 777 bp, Artificial Sequence
  Description of Artificial Sequence: Synthetic coding sequence
atgattcctctgcaaaaggacaatcaggaggagggggtctgcccaatatgtcaggaatccctcaaggaggccgtttccacgaactgtggacatttgttctgcagagtgtgcctgacacagcacgtggagaaggcctccgcctcaggggtcttctgttgccctctctgtcggaagccttgctccgaagaagtgctgggtaccggctacatctgccctaaccatcagaaacgcgtgtgtagattctgtgaggagtccagacttctgttatgcgtagagtgccttgtaagcccggaacatatgagtcaccatgaactcaccattgagaatgctcttagccattgtaaagagaggctgaataggagatccagaaaacttagaaaagacattgcagagttgcaaaggctgaaggcccagcaggagaaaaaactgcaggccctgcaatttcaggtagatcatggcaatcacaggctggaggctgggcctgaatcgcagcatcaaactcgggagcagttgggggcactgcctcaacagtggctgggtcagctcgaacacatgccagccgaagctgccagaattttggacatcagtcgtgcagtcactcaactccggtctctggtcatcgacctcgaaagaaccgccaaggaactggacactaataccttgaagaatgccggagatttgttgaaccggagcgctccccagaaattagaagttatataccctcagctcgaaaagggcgtatcagagcttctgcttcagcccccacagaagctgtag

SEQ ID NO: 60460 - DNA, 777 bp, Artificial Sequence
  Description of Artificial Sequence: Synthetic coding sequence
atgattccactccagaaagataaccaggaggaaggcgtctgccccatctgccaggagtctttaaaggaagctgtgtccacaaattgcgggcacctcttttgcagagtctgcctcacccagcacgtcgaaaaggccagtgcctcgggggtgttctgttgtcctctgtgccgcaagccatgcagcgaggaggtcctgggcaccggatatatttgcccaaatcatcagaaacgcgtttgtagattttgtgaggagtcgcgcctcctattgtgcgtggagtgcctcgtaagtcccgagcacatgtcgcatcacgagctcaccatcgagaatgctctgagccactataaagagaggctgaaccggaggagcagaaagctcaggaaagatattgccgaacttcagaggctgaaagcacagcaagagaaaaagcttcaggcgctccagtttcaagtcgatcatggtaatcataggctggaggcgggtccggagtcgcagcaccagacacgggaacagctcggggcacttccccagcagtggttgggtcagttagaacatatgcccgcagaagcagctcgcattttagacatctctcgcgcagtcacccagctgagatcgttagtgatcgacctagagagaaccgccaaagaactcgatacaaacacactgaagaatgcgggagaccttctgaatcggagtgctccccagaaattggaggtcatttaccctcaactggaaaagggggtctctgaattattgctgcagccgccacagaagctttag

SEQ ID NO: 60461 - DNA, 777 bp, Artificial Sequence
  Description of Artificial Sequence: Synthetic coding sequence
atgattcccctacaaaaggataaccaggaagaaggcgtttgccctatctgccaggagtcccttaaagaggctgtatccactaattgtggacatctcttttgcagggtctgcctcacacagcacgtggaaaaagcctccgcaagtggcgttttctgctgtcctttatgtcgcaaaccctgttcagaggaagtcctaggcaccggctacatctgcccgaaccatcagaaaagagtttgtcggttctgtgaggagtccaggctgctgctatgtgttgaatgcctggtgagccccgagcatatgtctcatcacgaactaacgatcgagaacgcactctcacattacaaggagcggcttaatcggaggtctcgcaagctcagaaaggacatcgccgagttgcagcgcctgaaggcacagcaggagaagaagcttcaggccttacagtttcaggtcgatcacggaaatcaccgcttggaggccggacccgagtctcagcatcagacaagggagcaactaggtgccttgccccagcagtggctcggccagctggagcacatgcctgcagaggcggctaggattttggatataagccgggcagtgacacagttacgatctctcgtaatagaccttgagcgaactgcgaaggagctggacacaaatacactgaagaatgccggtgacctcctcaatcgcagtgcacctcagaagctggaggtcatttatccccagctggagaaaggagtttcagagctcctcctgcagcctccgcagaagctgtag

SEQ ID NO: 60462 - DNA, 2172 bp, Artificial Sequence
  Description of Artificial Sequence: Synthetic coding sequence
atggagacggccatgtgcgtttgctgtccgtgttgtacgtggcaaaggtgctgtccccaactgtgtagctgcctgtgctgcaaattcatttttacaagcgaaagaaattgtacctgttttccctgtccatacaaggatgagaggaactgccagttttgtcattgcacctgctcggagagcccaaattgtcactggtgttgctgctcctgggccaacgatcctaattgcaaatgttgctgtacagccagctcaaatctgaactgttactactacgagtcacggtgctgtcgcaacacgatcatcacttttcacaaggggcgactgcgctcaattcacacttcctccaagacagcactaagaaccgggtcctctgatacgcaggtggacgaggtgaagtctatacccgctaactcacatctggtgaatcacctcaactgccctatgtgcagtaggctccgcctgcactcattcatgctgccctgcaatcactccctctgcgagaagtgcctaagacaattgcagaagcatgcagaggtgaccgagaacttctttatactcatttgcccggtgtgcgaccgttcccattgtatgccttattcaaataagatgcagcttccagaaaactatctgcacggacgcctgaccaaaaggtatatgcaggaacatggatatctcaaatggagattcgataggtcctcgggccctatactttgccaggtttgtagaaataaaaggatcgcatataagcgttgcataacatgtagactgaatttgtgcaacgactgtctcaaggcgttccattctgatgtggccatgcaggatcatgtattcgttgacaccagtgcagaagagcaggatgagaagatttgtatccaccaccctagtagtcgtatcattgagtattgccgaaacgataataagctgttatgtacgttttgtaagttttccttccacaatggtcatgatacaatttcacttatcgatgcgtgcagcgaacgggctgccagcctgttttccgcgatagctaaattcaaggccgtgcggtatgagattgataatgatctcatggagttcaacatactgaagaattcctttaaggccgataaggaggccaaacgaaaggagatccgtaatgggttcctaaaattacgttccattctgcaagagaaggaaaagattatcatggagcagattgaaaacctggaggtgtcccgccaaaaagaaatcgaaaagtatgtgtatgtgaccaccatgaaagtgaatgagatggacgggctaatcgcctacagcaaagaggccctgaaggaaaccggccaagttgcttttctgcagtccgcgaagatcctggtggatcagatcgaagacggcatccagaccacctaccgaccagacccacagctgcgactccatagtatcaactacgttcctctggactttgtggaactgagtagcgcaatccatgagctctttccaacggggccaaaaaaggtccgatcatctggcgattccctgcccagcccttaccctgtacactcagagactatgatcgcgcgaaaagtgacgtttagcacacactctctgggaaaccagcacatctatcagaggagcagctcaatgctgtcattttctaacaccgacaagaaagccaaggttggattggaggcatgcggtcgcgctcagtctgctactcctgctaaacctacggacggtctgtatacttattggtccgcaggcgcagattctcagtctgtgcaaaactcctccagcttccataactggtacagcttcaacgacggttccgtgaaaacgcctggcccaatagtgatctaccagacgcttgtatatccccgagccgctaaagtctactggacatgtccagccgaggacgtggacagctttgaaatggaattctatgaggtgatcacaagccccccaaacaatgtacagatggaactctgcgggcagattcgagatatcatgcagcagaacctggaactgcataacctgaccccaaacaccgagtacgtctttaaggtgagagcaatcaatgacaatgggcctgggcagtggtctgatatatgcaaagtggtaactcctgacgggcacggtaagaatcgggcaaagtggggcttactcaagaacatacagtcggctcttcagaaacacttctag

SEQ ID NO: 60463 - DNA, 1341 bp, Artificial Sequence
  Description of Artificial Sequence: Synthetic coding sequence
atggacagcgactttagccacgctttccagaaggagttgacgtgcgttatctgtctgaactacttggtggacccggtgaccatctgctgcggtcacagtttttgcaggccctgcctgtgtctctcttgggaagaggctcagagccctgcgaattgcccggcttgccgtgaaccaagcccaaaaatggacttcaaaaccaacatcctgctgaagaacctcgtgaccattgcgaggaaagcaagtctatggcagttcttaagcagcgagaaacagatctgtgggacccatagacaaactaagaagatgttttgtgatatggataagtcactgctatgtttgttatgttccaacagccaggaacatggggcacacaaacaccacccaattgaggaggccgcagaagaacaccgcgagaaactgctgaagcaaatgaggatactctggaaaaagatccaggaaaaccagaggaacctgtacgaagaagggcgaacagctttcctgtggcgcggtaacgtagttctgcgagcccagatgattcgcaacgagtacagaaaactgcaccctgtactacataaagaggaaaagcaacacctggaacgactaaataaggagtaccaagagatcttccagcagctacaacgctcatgggtgaagatggaccagaagagcaaacacctgaaggaaatgtaccaggagctgatggagatgtgccacaaaccggacgtggaactgttacaggacctgggagatatcgttgctaggagtgagagcgtgcttctccacatgccgcagccagtgaaccccgagctgacggcagggcctatcacaggcctggtgtatcgtctgaatcggtttcgcgtggaaatctctttccacttcgaagtcaccaaccacaacatccgtttgtttgaagatgtgcgaagttggatgtttcgaagaggcccactgaactcagataggtctgactacttcgctgcatggggcgcacgcgttttcagctttgggaagcactactgggaattggatgtggataatagttgcgattgggcgctgggcgtgtgtaataacagttggatccggaagaacagcactatggtgaactcagaggatatttttctcctgctgtgtcttaaagtcgataaccatttcaatctccttaccacctccccagtctttccgcactacatcgagaaacccctgggcagggtgggcgtattcttagattttgaaagcgggtcagtttcatttctgaacgttacgaagtctagcctgatctggtcgtatcccgctggaagtctgaccttccccgtgcgacctttcttctacaccggccatcggtag

SEQ ID NO: 60464 - DNA, 2280 bp, Artificial Sequence
  Description of Artificial Sequence: Synthetic coding sequence
atggcagaaggagaagacatgcagacatttacctccatcatggacgccctcgtgcggatttctacgtccatgaagaacatggagaaggagcttctttgtccagtgtgtcaggagatgtacaagcagccactcgtactgccatgcacacacaacgtgtgtcaggcctgcgcaagggaggtgctgggccaacaggggtatattgggcacgggggtgaccctagctctgagcctacatcccctgcctccaccccatccaccagatcgccgagactgagcaggcggaccctccctaagcctgatcgactggaccgcctgctaaagtctggattcggaacttatccaggtcgtaagagaggcgcactccatcctcaggtgatcatgtttccatgccccgcttgccaaggcgacgtcgagctgggcgagagaggtctcgctgggctgttccgaaatctgaccctggaacgggtagtcgagcggtatagacagtctgtgtcagttgggggagccattctctgtcagctttgtaagcccccacctctggaggcaaccaagggttgcaccgaatgccgcgctactttttgcaacgagtgcttcaagctgttccacccatggggaacacaaaaggcacagcatgaaccgacgctgcccacactctctttcaggcccaaaggactgatgtgccccgatcataaagaggaggtgacgcattattgtaaaacatgtcagcgtctggtgtgccagttgtgccgagtccgacggacacacagtggacataagatcacaccagtgttgtccgcctaccaagcgctgaaagataaactgactaaaagtctgacatatatcttggggaaccaggataccgttcaaacccagatctgtgagttggaggaggccgttagacatactgaagtcagcgggcagcaggctaaagaggaggtgagccaactcgtacgtgggctgggcgctgttctagaagaaaagcgggcaagcctgctgcaggctatagaagagtgtcagcaggagcggctggcaaggctgtccgcccagattcaagagcaccgctctttgctggatggctccggcttggttggatatgcacaggaagtactgaaggagaccgaccagccatgttttgtgcaggccgctaaacagcttcataatcgtatcgcgcgagccacagaagctctccaaacattccgccctgcggctagctcttcctttaggcattgtcagctggatgtaggtcgcgagatgaaactgctgacggagctgaattttctacgggtgcctgaggctcctgtgatcgatacacagcgcacgtttgcatacgatcagatttttctctgctggaggttgccaccacacagtcccccagcctggcattacaccgttgaattcaggagaacagacgtgcctgcccagccagggcctacccgctggcagcggagagaggaagttagggggacatctgccttactcgaaaaccctgacacagggtccgtgtacgtcctgcgggtccgagggtgcaataaggccggatacggcgagtactccgaggatgttcacctgcacactcctccagcgcctgtactgcatttcttcctggactcccggtggggcgcaagccgggaacgcttggcgatttcaaaagatcaacgcgctgtccgtagtgtgccgggtctgcccctcttgctggccgctgatagattgctgactggatgtcacctaagcgtcgacgtagtcctgggtgacgtggcggtcacccagggcagatcctattgggcctgcgcggtggacccagcaagctacctggtcaaagtcggggtgggactcgaaagcaaattgcaggagagtttccaaggcgctccagacgtgataagccccaggtatgaccccgactcaggacatgattccggggcagaagacgccacagttgaggcctcccctccttttgccttcttgaccatcgggatgggcaaaatcctgctgggaagcggagcaagttcaaatgctggtctcacggggagggatgggcctaccgcgggatgcacagtgcctttgccaccaaggctgggcatttgcctggattatgagcgtggacgtgtgagtttcctcgatgccgtttctttccgaggtttgctcgaatgccctctcgactgcagcgggcctgtgtgtccagcattttgcttcatcggcggaggcgcagtacagctgcaggagccggtcggcactaagcccgaacgaaaggtgacgatcggaggcttcgcaaagctcgactag

SEQ ID NO: 60465 - DNA, 2211 bp, Artificial Sequence
  Description of Artificial Sequence: Synthetic coding sequence
atgaagaatatggagaaggaattactctgcccggtgtgtcaggagatgtataagcaacctttagtgttaccatgtactcataatgtttgtcaggcgtgtgcccgagaggttctaggtcagcaaggctatataggccacggtggggatccatccagtgagcctactagtcccgcttctacaccatcaacccggtcacctaggttgtctcggaggactctccccaagcccgaccggctcgacagacttttgaagagcgggttcggaacctaccccggaagaaagagaggggctctgcacccacaggtgatcatgtttccttgtcctgcatgccaaggcgacgtggaacttggagagcgcggacttgcgggtcttttccgcaacttgacactggagcgtgtggtggagcggtaccgacagtcagtgagtgtcggcggagccattctatgccaactctgcaagcccccacccttggaggctacaaagggctgcactgaatgccgagctactttctgcaatgagtgtttcaaactcttccatccatgggggacccagaaggcccagcatgagcctactctacctaccctgagttttcggccaaagggactgatgtgtccagatcataaggaagaggtgactcactactgtaagacatgccaacgcttggtctgccagctctgtcgggtgcgtaggacacactcaggacacaagataactcctgtgctgagcgcataccaggccctgaaagacaaactcaccaaaagcctgacctatatcctgggcaatcaagataccgtgcaaacacagatctgtgagttagaggaagctgtccgtcataccgaagtctccggacagcaggctaaagaggaagtctcccagctcgttagaggactcggggctgtgctggaagagaagcgagcctccctcctccaggcaatcgaagaatgtcagcaggagagattagccaggcttagcgcacagatacaagagcataggtcgctgctcgacgggtctggcctggtcggttacgctcaggaggtgctaaaagagacggaccagccatgttttgtgcaagcagcaaagcaactgcataataggattgctcgcgctacggaggctcttcagacctttcggcctgccgcatcttcatcatttaggcactgccaattagatgttggccgagagatgaagctgctcaccgaactaaatttcttgcgggtgccagaagctccggtaatcgacacccaacgcacattcgcctatgatcaaattttcttgtgttggcggctaccgcctcacagtcccccagcctggcactacaccgttgaattccggaggaccgacgttcccgcacagccaggtccaacgcgatggcagcgcagagaggaagtgcgaggtaccagcgccttgttggagaatcccgatactggatccgtctacgtgctgcgggtgcgtggctgcaataaagccggatatggagaatacagcgaagacgttcatctgcacactcccccagcacccgtgctgcatttcttcctagactctcggtggggggcatctcgagagcggctggcgatctcaaaagatcaaagggcagttcgcagcgtgcccggactgccactgctccttgccgctgaccggttgttgaccggatgccatctgtctgttgacgtggtgcttggagacgtggccgtgacgcagggcagaagctactgggcctgtgccgttgacccagcttcttacctagtgaaagtgggtgtcggactcgagtccaaactccaggagtcatttcagggggctcccgacgtcattagtcctcgctacgaccccgattcaggtcatgattctggagccgaagacgcaaccgtagaggcatcccccccttttgctttcttgaccatcggcatggggaaaattctgctaggaagcggggcttccagcaatgctggcttgaccggtcgcgatggccctactgccggatgtaccgtgcctttacccccaagactggggatttgcctggactacgagcgtggcagagttagcttcctcgatgccgtctccttccgcggactcttggaatgccccctcgactgttcaggcccagtatgcccagccttttgtttcatcgggggtggcgctgttcagctgcaggaacctgtgggtactaaacccgaacggaaggtcacaattggtggattcgctaaactggattag

SEQ ID NO: 60466 - DNA, 1935 bp, Artificial Sequence
  Description of Artificial Sequence: Synthetic coding sequence
atggccgagggcgaggatatgcaaaccttcactagcatcatggacgcgctggtaagaataagtacatctatgaagaatatggaaaaggagctcctgtgccctgtatgtcaagagatgtataaacaaccactggtcttaccgtgcactcacaatgtgtgtcaagcttgcgccagggaggtactgggacagcaggggtatatagggcacggtggcgatccatcttccgaacctacatctcctgcctccacaccaagtacacgctcccccaggctcagccggcgaacccttcctaaaccagatcgcctagaccgcctgctgaagtcaggttttggtacgtatcccggacgaaagcgaggagccctgcatccacaggtgatcatgtttccctgccctgcctgtcagggggatgtcgaactgggagaacgcggtctagctggtctttttcgcaacctgacactcgagcgggtcgtcgaacgttaccgacaatccgtgtcggtgggaggtgcgattctgtgtcagctttgcaaaccgcctcctttggaggccactaaaggttgtactgaatgcagagccacgttctgcaatgagtgttttaaactgtttcacccctggggcactcagaaagcacagcacgagcccaccttgccaacgttgagcttccgtcctaaaggtctgatgtgtccggatcacaaagaagaggtgacgcattattgtaaaacatgtcagcggctggtgtgccagctatgcagagtgcgtagaacacatagcggacacaaaataacacctgtgctcagcgcctatcaagcccttaaagacaagctcaccaaatccctgacctacatcttggggaatcaggatactgtccaaacccagatttgtgagctcgaagaagctgtgaggcatactgaggtgtccggacagcaggctaaggaagaggtcagccagctggtgagaggtttgggtgcagtcctggaagaaaaaagagcttccctgctccaggcaatcgaagagtgccagcaagaacgactggcccgactatctgcgcagattcaggagcaccgcagtttactggatggctcaggactcgtgggatatgcccaggaggtactcaaagaaactgatcaaccctgctttgtgcaggcagcaaagcagctgcacaacagaatcgccagggccacagaggctctgcaaacttttcggcctgccgcatcttcgtcatttcgtcactgtcagctggatgtaggaagggagatgaagctgctgaccgagctgaattttctccgcgtccccgaggcacctgtgattgatacacagagaacttttgcttacgatcagatatttttgtgctggcgactaccaccacactcccctccagcgtggcactatacagttgagtttcggagaacggacgtgcccgcacagccgggacctacaagatggcagaggcgcgaggaggtgcgtggcaccagcgctctacttgaaaacccggacacaggatctgtatatgtactgcgcgtcagaggctgtaacaaagcaggatatggcgagtattcggaggatgttcaccttcacactccaccagctcctgtgctgcacttttttctagatagtcggtggggcgcttccagagagcggcttgctataagtaaagaccagcgcgcagtcaggtctgttcccggtctaccgctccttctcgcggctgatcggttgctgaccgggtgccatctcagcgttgacgttgttctgggcgatgtggcagtgacacagggaagatcatactgggcctgcgctgtggacccagcatcctatttagtcaaagtcggcgtagggcttgagtccaaactgcaggagtccttccagggggcacccgatgttatcagtcctcgttccgacccgtccggcagggacggtgtttggggctcatggtgggaatag

SEQ ID NO: 60467 - DNA, 1656 bp, Artificial Sequence
  Description of Artificial Sequence: Synthetic coding sequence
atggctgaaggagaggatatgcagaccttcacctctattatggatgctctggtccgcatttccacttccatgaaaaatatggagaaagagctcctttgccccgtgtgccaggaaatgtacaagcagccgctggtccttccctgcacccacaatgtgtgccaggcctgtgcgagagaagtcttgggccagcagggctacatcggccacggaggcgatccttcctcagagcctacatctcctgccagcacaccctccactagatcaccaaggctgtctaggaggacacttccaaagcctgaccgactggaccgtctcctcaaatcagggtttggaacttacccaggccgaaagcgtggcgcacttcaccctcaggtaattatgttcccctgtcccgcttgtcaaggggatgtggagcttggcgagagggggctagccggactgttccgaaacctgactctcgaacgggtggtggaaagatatcggcagagcgtgtccgtagggggagccattctctgccaactttgtaaacctccccctctggaagccaccaagggctgtactgaatgtcgcgctactttttgcaacgagtgctttaagctcttccacccatggggaacccaaaaagcacaacacgagcccacactcccgacattgtcttttcgtcctaaagggctgatgtgtcccgatcataaagaagaggtgacacactactgtaagacatgtcagagactcgtgtgtcagctgtgccgcgtgaggcgtacacattctggccataagatcacacccgtcctgtctgcctaccaggccctgaaggataaactcaccaaatctctgacctatatcctgggtaatcaagatacggtgcagacacagatttgtgagctcgaggaagccgttcgacatacagaggtaagtgggcagcaagctaaggaggaggtatcacagttagtgcgaggtctgggtgccgtgctggaagaaaaaagggcctctcttttacaggccattgaagagtgtcaacaggaacgtttagccaggctgagcgcccaaattcaggagcataggtccctactggacggttctggtctcgtgggatacgctcaggaagtcctgaaagagaccgaccagccatgctttgtgcaagctgctaagcaactgcataaccggatcgccagagcgactgaggctcttcagactttccgacccgctgcaagttcgagcttcaggcactgtcagcttgacgtgggacgcgagatgaaattactcacggagttgaattttctacgcgttcctgaagctccagtgatcgatacccagcgcacttttgcctatgatcaaatatttctgtgctggaggctccctccacactcgccccctgcttggcactataccgtcgaattcagacgtactgacgtcccggcacagcctggtccaacccgctggcagaggagggaagaggtgagggggacctctgctctgctggaaaacccagatactggatcagtctacgttcttagagtgcggggatgtaacaaagccggatacggcgagtatagtgaggacgtgcacctccacacgcccccagcccctggcatacagaatttggcccgacggggaggggcatgcctgcaattccagctcctcgggaggctccgctag

SEQ ID NO: 60468 - DNA, 1497 bp, Artificial Sequence
  Description of Artificial Sequence: Synthetic coding sequence
atggccgagggcgaggacatgcagactttcacctccattatggacgcactcgttcgaattagcacatccatgaaaaatatggagaaggaactgttatgtcctgtgtgtcaagaaatgtacaaacagccactggtgttaccctgcacacacaacgtatgccaggcatgtgcaagagaagtactgggacaacagggctacataggtcacggtggtgatccctcttctgaacccactagtccggcttcaacaccaagcactaggagtcctcgcctttctcgcaggactttgcctaaaccagacaggcttgatagattgttgaagtctggtttcggaacctacccagggcgaaagcgcggagctctccatccccaagttatcatgtttccctgtcctgcttgtcaaggagacgtggaactgggtgaaaggggcttggcaggcctgtttcgaaatctaacgcttgagcgagtcgttgagcgctatcgacaaagcgtgagcgtcgggggtgctattctctgccaactgtgtaaacctcctccccttgaggcgaccaaaggttgtacagaatgtagagctaccttctgtaacgaatgttttaaactctttcacccttggggaacacagaaggcgcagcatgaaccaactttgcctacactttcctttaggccaaagggcctgatgtgccccgaccacaaggaagaagttacccactactgcaagacctgccagagactcgtctgtcagctgtgcagggtgcggaggacccactccggccataaaatcacacctgtcttgagcgcctaccaggccctgaaagataaactcaccaagtccctcacctatatcctgggcaaccaggacacagtacagacacagatttgtgagctcgaagaagcagttcggcacaccgaagtgtctggacagcaggctaaggaagaggtctctcagttagtccggggactaggagccgtcctggaggagaagcgcgcttcgcttcttcaggctattgaagaatgccaacaggagcgcctcgcacggctctcagcccaaatccaagagcataggtcgctgctggacggcagtggcctggtgggatatgctcaggaagtgttgaaagagacagaccagccttgttttgtgcaggctgccaagcagcttcataacaggatcgcccgtgccaccgaagcgcttcagacctttcgcccagccgcttctagctcattcagacattgtcagctggacgtcggtcgcgagatgaagctattgacagaattaaactttcttcggggatgcggccaccggggattgtgcagtggagcgcctcagtgcttaagacccccatctctcacgccctcagctcctttgccgatgatacggagctcttgtgctggtggatgtcctcccatccatcacctgcccggtactattcccctttctagtggcgctcgtatgtgtctcctctcacaggcacccccagcaggctcagggggaagacgctag

SEQ ID NO: 60469 - DNA, 2154 bp, Artificial Sequence
  Description of Artificial Sequence: Synthetic coding sequence
atggcagcaaagcgtggcacaaaaacttccatgaagaacatggagaaggagctactgtgccctgtgtgccaggagatgtacaagcagccactcgtcttgccatgtactcacaatgtttgccaggcctgcgctcgtgaagtgctgggccagcagggctacatagggcatggcggtgatcctagctccgagcctaccagccccgcttctacaccatctacgcgaagccccaggctctccaggagaactctgcccaaaccggaccgtcttgatcgacttcttaaaagcggattcggaacttacccaggaagaaaaagaggcgcactgcacccccaagtcatcatgtttccatgtcctgcctgccagggagacgtcgagctcggcgagcgaggcttggccggactctttagaaatctcaccctggaacgagtagtggagcggtacagacagtccgtgtccgtgggcggagccattttgtgccagctctgcaaaccgcctccactggaagcaaccaagggttgcacagaatgccgcgcaactttctgtaatgagtgctttaagctcttccatccctgggggacgcaaaaggctcaacacgagcccacactccccactcttagttttaggcctaaaggacttatgtgtcccgaccataaggaggaggtgacccactactgtaagacatgccagcgtttagtttgccagctttgccgagttaggcggacccatagtgggcataagattacacccgtcttgagcgcctaccaggcccttaaagacaaactaacgaaatctctcacctatattctggggaatcaagacacagtccagacacagatatgcgagcttgaagaaaaacgcgcttcactccttcaagcaatcgaggagtgtcagcaagagagactcgccaggttgagtgcgcagatacaggaacatcggtcactgctcgatggctcaggtctcgttggctacgcccaggaagttctgaaggagaccgatcaaccgtgcttcgtacaggctgctaaacaactgcataatcggattgcaagagcaaccgaagccttgcagacattcagaccagccgctagctctagcttccgccattgtcaactggatgtgggtagggagatgaaactactgactgaacttaacttcttacgcgttccagaggctcccgtaatcgacacccagaggacctttgcttacgatcaaatattcctttgttggaggctgcccccacatagcccccctgcctggcactatacggtggaatttcgaagaaccgatgtgcctgcacagcctgggccaacgaggtggcaaagacgggaggaggtgagggggacatccgccctgctggaaaatccagacacaggatccgtttacgtgttgagagtacgcggttgtaacaaagctggttatggggagtatagtgaggatgtgcatttacatacgcccccagcgccagtgctccacttctttctagattcccgttggggggcaagcagggagcgcctggccatttccaaggatcagagggcagtgagatcagtgcctgggctcccgctcctccttgccgctgaccgtctcctgaccggatgccatctaagcgtagacgtcgtgctcggagacgttgctgtgacccaggggagaagctattgggcgtgcgccgttgacccggcatcatatctggtgaaggtgggcgtaggcttggaatcgaaacttcaggagtccttccaaggggcacccgacgtcatctctcccaggtacgatccagactctgggcatgactcaggagcagaggacgccacagtggaagcatcaccaccctttgcgttcctcacgatcggcatgggaaagatcctgctggggtctggggcttctagtaatgcaggccttactggcagggacggacccacagcaggttgtacagtgccattaccaccccgtttgggtatttgtctggactatgagagaggtcgggtgagttttctcgatgccgtctcctttaggggccttctggaatgccctctggattgcagcggcccagtatgccccgcattctgcttcatcggcggaggagccgtacagcttcaggagcctgtagggacaaaaccagaacggaaggtgacgataggcggattcgccaagcttgactag

SEQ ID NO: 60470 - DNA, 1518 bp, Artificial Sequence
  Description of Artificial Sequence: Synthetic coding sequence
atgcggagagggggaatcttaggccaccgcccagggccacaggccttcctggtccctggcgcttccgccgctactttgtataagacttctatgaaaaacatggagaaggaactgctttgccccgtgtgtcaggaaatgtacaagcagcccttggtgctgccatgtacacataacgtttgccaggcatgtgcgagggaggtccttggccagcagggttatattgggcacggaggcgacccgagcagcgagccaacttcacccgcatctacccccagtacccgtagccctcgactttctcgacggaccttgcccaagccagaccgcttagacaggctcctgaagagtgggtttggcacctaccccggtagaaaacgaggggctctgcacccccaggtgatcatgtttccctgccccgcatgccagggcgacgtagagttgggtgagagaggcttagctggactatttagaaacttgaccctggagcgggttgtggagcgatatagacagtccgtcagtgtgggcggagctatcctgtgtcagctgtgtaagcctccaccactggaggcgaccaaggggtgcaccgaatgcagggccacattttgtaatgaatgcttcaagttattccacccctggggcacacagaaggcacagcacgagcctacactgccaactctgagctttcggccaaaaggccttatgtgcccggaccataaggaggaggtgacccattattgtaaaacatgccagcgcttggtctgtcagctgtgtcgagtgaggcgcactcacagcggccataagataacacccgtcctctccgcctaccaggccttgaaggataaactgaccaaatcattgacctacattctgggaaaccaggacacagtccaaacacaaatttgtgaattggaggaagccgtgaggcacactgaagtgtcaggccagcaggctaaggaagaggtgtctcagttagtccgaggactgggggctgtgctggaagaaaaacgagcttccctgttgcaggctattgaagaatgccaacaggaacggctggcccgactgagcgcccagatacaagagcacagatcgctgttggacggatccgggctcgtcggatacgcccaggaggtcctgaaggaaaccgaccagccttgcttcgtgcaagccgctaagcagctgcacaacaggatcgctcgggcaaccgaagctctgcagacgtttcgcccagccgcttcctcttccttccgacattgccagctagacgtgggaagagagatgaagctgctgaccgaacttaacttcctgagaggctgcgggcaccgcggtctctgcagtggtgctccacagtgcctgcggcctccgtcactgacacctagtgcaccactccccatgatccggtcgtcatgcgctggcggatgcccccctatccatcacctgccaggtactattcctttgtccagtggcgcaagaatgtgccttctatcccaggcacctcctgccggtagcgggggacggagatag

SEQ ID NO: 60471 - DNA, 1902 bp, Artificial Sequence
  Description of Artificial Sequence: Synthetic coding sequence
atgttcccttgtcctgcctgtcagggcgatgttgaactgggagaaaggggcctggccggtctgtttcgcaatctgacactcgaacgcgtggtggagcgctatcgccagtccgtgagcgtcgggggtgcaattctttgccagctgtgcaaacctccacctctggaggctaccaaggggtgtaccgaatgtcgagccacgttctgcaacgaatgttttaagctgttccacccctgggggacgcagaaagctcagcacgaacccacgctcccaactctttccttccggccaaaaggtctcatgtgccccgaccacaaagaagaggttacgcattattgtaaaacatgccagagactggtctgccagctttgcagggttcgtcgcacccattcaggccataaaattactccagttctgagcgcctaccaggcactgaaagacaagctgacaaagagcctgacttacatactcggcaatcaggacacagtgcagacacaaatctgcgagctcgaagaggccgtgagacatacagaggtcagtggacaacaggccaaggaggaagtgtcacagttagtaaggggactgggagccgtcctggaagaaaaacgtgcgagcctgttacaggccatagaggagtgccaacaagagcggcttgcgagactctccgctcagatccaggaacatagaagtctgctagacggcagcgggctggtcggatatgcacaggaagtgctaaaagagaccgatcagccgtgcttcgtgcaggccgcaaaacagctacacaatagaattgccagggctaccgaggcactacagacatttaggccagccgcatcttcgagtttcaggcattgtcaactggatgtggggcgagaaatgaaacttctcacagagcttaattttcttcgcgttccagaggcccctgtgatcgatacacaaagaacgttcgcctacgatcagatcttcttatgctggagactgccccctcacagtccaccagcctggcattacacagtggagttcagacggacggacgtgcctgcccagccagggcctactaggtggcagcgcagagaggaggtgagaggtacctcagctctgttggaaaaccctgataccgggagtgtgtacgtgctgcgagtgagaggatgtaataaagcaggatacggagagtacagtgaagacgtccacctgcacacccccccagcacctgttctccatttttttctggactccaggtggggggcatcaagggagaggctggccattagcaaagatcagcgagccgttcggtctgtcccgggtttgcctctgctgcttgcagcagatcgactgctcactggatgtcacctgagtgtggacgttgtcctgggtgatgtggcagtcacacaaggcagaagctattgggcgtgtgccgtagatcctgccagctacctcgtgaaagtcggagtcgggctcgagtcgaaactgcaggagtcgtttcagggagcacctgacgtcatcagccctcgctacgatcctgatagtgggcacgattcgggagcagaagacgcgaccgtggaagccagccccccatttgcctttctaaccattggcatgggtaagatactgctgggcagcggcgcttctagcaacgcaggcctgaccggcagggatggtccaaccgccggatgcaccgttccgctaccaccacggctcgggatctgtctagattatgaaagagggagggtgagcttcctagacgcagtgtcttttaggggcctgttggagtgtcctctggattgctccgggccagtctgcccggcattttgcttcatcgggggaggagctgtccagctccaggagccagtgggcacaaaaccggagcggaaagtgacaattggcggattcgccaaactcgactag

SEQ ID NO: 60472 - DNA, 675 bp, Artificial Sequence
  Description of Artificial Sequence: Synthetic coding sequence
atgagcaggagaattatcgtaggtaccctgcagcgtacacagcggaatatgaatagtggcatcagccaggtgttccaacgggagttgacgtgtcccatctgtatgaactactttatcgatccggttaccattgactgcgggcactctttttgtaggccatgcttctatctcaattggcaggacatacccattcttacccagtgtttcgagtgcattaaaactatacagcagcgcaatttgaagaccaacattcgcctgaagaaaatggctagcttagccagaaaagcctcattgtggttgttcttaagtagtgaggagcagatgtgtggtatccatcgcgagactaaaaaaatgttttgcgaagttgatcggagtctgctgtgcttgttgtgttcttcttcccaagagcatcggtaccaccgccactgccccgctgaatgggccgcagaagagcactgggagaaattgctgaagaagatgcagagtctgtgggaaaaagcttgcgagaatcagagaaatcttaatgtggaaaccactcgaatctcacattggaaggcgtttggggatatcctctacaggagcgaatccgttctgctgcatatgccccagccgctcaatctggccctccgcgctggcccaatcaccggccttagagatagactaaatcaattttag

SEQ ID NO: 60473 - DNA, 1359 bp, Artificial Sequence
  Description of Artificial Sequence: Synthetic coding sequence
atgaatagcggcatcttgcaggtttttcagggagaactgatttgtccactgtgtatgaactactttatcgaccctgtgacaatcgactgcggccatagcttttgtcgtccgtgtttctaccttaattggcaagatatcccatttctggtccagtgctcagagtgcactaagagtaccgagcagattaacttgaagaccaatattcacctgaaaaagatggctagtctagccaggaaagtttccctttggctttttctgagttctgaggagcagatgtgcggcacacatagagagactaagaagattttctgcgaggtggaccgaagcctgttgtgcttgttgtgtagttcttctcaggagcacagatatcacagacatcggcctatcgaatgggctgccgaggagcatcgcgaaaagctgctgcagaagatgcagtccctgtgggagaaagcctgtgagaaccaccgaaacctcaatgtggagaccactcgcacccgctgttggaaggactacgtcaacctcagactcgaagccattagggctgaatatcagaagatgcccgcattccaccacgaagaggaaaagcacaaccttgagatgctgaagaagaaggggaaagaaatcttccaccggcttcacctttccaaggccaaaatggctcatcgtatggagatactgcgaggaatgtatgaggaactgaatgagatgtgtcacaagcccgacgtggaactgctgcaggcctttggtgacatcttgcaccgatcagagtctgtcttgctgcacatgcctcaaccacttaatccagagttaagcgccggaccaattacaggactccgagatcgattaaaccagtttcgagtccacatcaccttgcatcatgaggaggcaaataacgacattttcttgtacgaaatcctgcggtcaatgtgtattggatgtgaccaccaggatgtaccttattttacagccactccgcgttcattccttgcatggggggtccaaacttttacgagcggaaaatactactgggaagtccacgtaggtgactcctggaattgggctttcggcgtttgcaatatgtaccgaaaggagaagaaccagaatgaaaaaatagacggtaaggctggtctctttctactgggctgtgtgaagaatgatattcagtgttccctgttcactacctcacccttaatgttgcagtatatacctaaacccacatctagggttggcctgttcttggactgcgaagcaaagactgtttcctttgtggatgtgaaccagagtagccttatctacacgattcccaattgcagttttagtcccccactgcggccaatcttctgctgcattcatttctag

SEQ ID NO: 60474 - DNA, 1341 bp, Artificial Sequence
  Description of Artificial Sequence: Synthetic coding sequence
atgaattctggcattctgcaggtgttccagggtgagctgatttgccctttgtgtatgaactactttatagaccctgtgacaatcgattgtgggcactcattttgccgaccgtgcttctatctcaactggcaggatattccattcttggttcagtgctccgagtgtactaaaagcaccgagcagatcaacctcaaaacaaacatccaccttaaaaagatggcgagcctggctcggaaggtgtcattgtggctgttcctttcatcagaggaacagatgtgcgggacccaccgggagaccaagaaaattttctgcgaagtggataggtccttactttgtcttctgtgctcctctagccaggaacaccggtatcatagacaccggcctatcgagtgggccgctgaggaacaccgcgagaagcttctacagaagatgcaatcactgtgggagaaagcttgtgagaaccatcgcaatttaaatgtggaaaccacacgaacacgctgctggaaggattacgttaacctgaggttggaggccattcgggcagagtatcagaaaatgccagcttttcatcatgaagaagagaaacataatctggaaatgttaaaaaaaaagggtaaggagatctttcatagactgcacttgtctaaggcgaagatggcccacaggatggagatactcagagggatgtatgaggagctgaacgagatgtgtcacaagccagacgtcgaactccttcaggaccttggggacatggtagctcggagcgagtccgtccttctgcatatgttgcaacccgtgaatcccgaattacccaccggcccaattacaggacctgtcgatcgactgaatcatttccgcgtagaaatctcctttacttgggaagggaccaattacaacatcggtctttttgaagatgtccggagtctgatgtttcgtcgaggatccctcaattctgaccgcagtgattattttgctgcttggggggcttgggttttctcttccggaaaacactattgggagctagatgttgacaacagttgggactgggctcttggggtttgcaaggactcttggattcggaaaaatagcacgatgttcaactccaaggacatctttctgctcctgtgtgtcaaggtcgacaatcacttctctctactcacaacttctccaatgttccctcactacgtggagaagcctttggtcagggtgggcgtgttcctgaactttgaaagcggatccgtcagttttctcaacgttaccaaaaattctctcatttggaactacccagctggcagtctgaatttccccgtgaggtcctttttttataccggccatcgctag

SEQ ID NO: 60475 - DNA, 1359 bp, Artificial Sequence
  Description of Artificial Sequence: Synthetic coding sequence
atgaatagcggaatactgcaagtatttcagggcgaattgatctgcccactctgcatgaattatttcatagatcccgtcacgattgactgtggccatagcttttgtagaccctgtttctacctgaattggcaggatattcccttcctggtccagtgtagtgagtgcaccaaatcgactgaacagattaatcttaagactaacattcacctgaaaaaaatggccagcctcgctcggaaggtctccctgtggctttttctgtccagtgaggaacagatgtgtggaacgcacagagaaacgaaaaaaatcttttgtgaggtggacaggagccttctttgtcttctgtgcagcagttcgcaggagcatcgttatcaccgacacagacctatcgagtgggcagccgaggaacacagagagaagctgttgcaaaaaatgcagtctctctgggaaaaggcttgtgagaaccaccgtaatttaaatgtggaaacaacccgcactcgctgttggaaggattatgtcaatctgaggctagaagcgatcagagctgagtatcagaagatgccagctttccatcacgaggaggaaaagcataacctggaaatgttgaagaagaagggaaaggagatctttcaccgcctacacctgagtaaagctaaaatggcgcataggatggaaatcttgagagggatgtatgaggagttgaatgagatgtgtcataaaccagacgtcgaactgcttcaggccttcggagacatactccaccgcagcgagtctgtactccttcatatgccccagccattgaatccggagctttctgccggacctattaccggcttgcgcgaccgattgaaccagttccgcgttcacattacactacaccacgaagaggcaaattcagacatattcctctacgaaattctcagatccatgtgtatcgggtgtgaccatcaggacgtgccctacttcacagcaacacccagatcctttttggcctggggagtgcagacatttactagcgggaaatactattgggaagtccacgttggggattcttggaactgggcctttggtgtgtgcaatatgtacagaaaggagaagaatcagaatgaaaagatcgacggtaaagaggggctgttcctcctcggttgtataaagaatgatattcaatgctcactgttcaccacatcacccctgatgctgcagtacattcctaagcccacatccagagttgggctttttttggactgcgaagcaaaaacggttagtttcgtggatgttaaccaaagtagcctgatctacacaatcccaaactgcagcttctccccgcctctgcggcctatcttttgctgtatacacttctag

SEQ ID NO: 60476 - DNA, 894 bp, Artificial Sequence
  Description of Artificial Sequence: Synthetic coding sequence
atggctggatacgccactactccaagtcccatgcagacattgcaagaagaggcggtgtgcgcgatttgtctcgactactttaaagacccagtgtccatcagctgcggacacaatttttgccgcggatgtgtgacccagttatggtccaaggaagatgaagaggatcagaatgaagaagaagacgagtgggaagaggaggaagatgaagaagccgtcggcgctatggacggctgggatgggtcgatacgggaagtgctctataggggtaacgcagatgaggaactgttccaggaccaggacgatgacgagctgtggttgggagattcagggataaccaattgggacaacgtcgactacatgtgggatgaagaagaggaggaggaagaggaagatcaggactactatcttggcggactgcgtcccgatctgagaatcgacgtttacagggaagaggagattctggaggcctacgatgaggacgaagatgaggaactgtaccctgacattcatcccccaccttctctgcctctcccaggccagttcacttgcccacagtgtcgtaaatcattcacacgtaggtctttccggcctaaccttcaactggcgaacatggtgcagatcatcaggcagatgtgcccaactccctaccgagggaatcgcagtaatgatcagggaatgtgctttaaacatcaggaagctctgaaactgttctgcgaggttgacaaggaagcaatctgcgtggtgtgtagagagtctcgctctcataagcagcacagtgttctcccacttgaggaggtggtgcaagaatatcaagagatcaagctggagaccaccctggtcggcatccttcaaatagaacaagagagcattcattccaaggcgtataatcagtag

SEQ ID NO: 60477 - DNA, 1461 bp, Artificial Sequence
  Description of Artificial Sequence: Synthetic coding sequence
atggcttgggctcctccaggcgaacgcctaagagaggatgccagatgtcctgtgtgtcttgattttttacaggagccagtgtctgtagattgtgggcattctttttgcttaaggtgcatatctgagttctgcgagaagtccgatggagcacaaggaggcgtctacgcctgtcctcagtgtcgcggtccgtttagaccatccggttttaggcccaatagacaactagccggacttgttgaatctgtcagacggctcggcctgggggcaggaccaggcgctcgacggtgtgcccgtcacggcgaggacttatcacgcttttgtgaagaggacgaggccgcactatgctgggtttgcgacgccggaccagaacacagaacccacagaaccgcccctcttcaagaggctgcaggaagctaccaggtgaagcttcagatggccctggagctgatgaggaaggagctcgaggacgccctcactcaggaggcaaatgtcgggaagaagacagtgatttggaaggagaaggtcgagatgcaaagacagcggttcagattggagttcgagaagcatagaggtttcttagctcaggaggagcagcgccagctgagaaggcttgaggctgaggagcgggctacactacagcgcctgagagagagtaaaagtaggctggttcaacagtctaaggccttgaaggagctcgcagacgaactccaggagcggtgtcagcgccctgccctgggccttttggaaggagtacggggagtactgagccgatcaaaggccgtcacccgcctggaagccgaaaacatccccatggagctgaagactgcttgctgtatccctggtcgtagggagctcttaaggaaattccaagtggatgtgaaactcgacccagccacggctcaccccagtttgctgctgacagcagatcttcgatcggtgcaggacggagagccgtggcgggatgtgccaaataaccccgagaggttcgatacctggccctgcatcttaggactacagagttttagctctggcagacactattgggaagtgcttgtgggcgaaggggcagagtggggattaggagtctgtcaggatacgctgcccagaaagggcgagactacaccctctccagaaaatggagtgtgggccctttggttgctgaaaggcaacgagtacatggtgctggcaagtccaagcgtgccattactccagttggaaagtccccgttgcattggcatattcctggattatgaggccggtgagatttcattttataatgtgaccgacggctcttacatttacacttttaaccagctattttccggactgctcaggccctacttcttcatttgcgacgccacacccctcattctgccacctaccaccatcgcaggaagcgggaactgggcttcacgggaccatctggacccagcatcggatgtccgggatgaccatctctag

SEQ ID NO: 60478 - DNA, 1416 bp, Artificial Sequence
  Description of Artificial Sequence: Synthetic coding sequence
atggaatttgtcaccgccctggtcaaccttcaggaagagagtagctgccccatctgtctggagtacttgaaggatcctgtgaccatcaactgtggccacaatttctgtcgttcttgcctgtccgtgagttggaaagatcttgacgacacattcccctgtccggtctgtcgattttgcttcccatacaaaagctttcgaaggaaccctcaacttcgaaacctgacagaaattgctaaacagcttcagattcgtcgaagtaagagaaagcgtcaaaaagagaacgccatgtgcgaaaagcataaccaattcctcacgctattctgcgtgaaagatctggagatcctgtgtacgcagtgctctttttctacaaaacatcaaaagcactacatctgcccaatcaagaaagccgcttcttatcacagggaaatactggaagggtcattggagcccttgcggaataacattgagcgagtggagaaagtaattattttacagggctctaaatcagtggagctgaaaaaaaaagtcgaatacaagcgtgaggagatcaatagcgagttcgaacagatccgcttgttcctccagaacgagcaggaaatgatcctgcggcagatccaagatgaggagatgaacatactggcgaagttgaatgaaaatttggtggagctctcagactacgtgagcactctgaagcaccttctgcgggaggtagaggggaagtctgtacagtcaaacctggagcttctgacccaggctaagtcaatgcatcacaaatatcaaaaccttaagtgccccgagctattctcttttcgactaaccaagtatggattctcgctacctccacagtactcagggctcgataggatcatcaaacctttccaggtggatgtgatcctggatttgaatactgcccacccccagctgctggtgagcgaagatcggaaagccgttagatatgaacgcaaaaaacgcaacatatgttatgatcccaggaggttttacgtgtgcccagcagtccttgggagccagagatttagctcaggtagacattattgggaagtggaggtcggaaacaagccaaagtggatcctaggcgtgtgccaggattgtctgctgaggaactggcaggaccagcctagcgttctcggagggttttgggccattgggcgttacatgaagtccggatacgtggcctctggtcctaagaccactcagttactgcctgtcgtaaaacccagcaagatcggtatttttctagattacgagctgggcgacctgtctttctataatatgaacgataggtctatcctatatacattcaatgactgctttacggaagctgtctggccttatttctacactggaactgatagcgaaccactgaaaatctgctctgtgtctgattccgaaaggtag

SEQ ID NO: 60479 - DNA, 273 bp, Artificial Sequence
  Description of Artificial Sequence: Synthetic coding sequence
atggagtttgtgactgctctcgtcaaccttcaggaggagtcatcttgtccaatctgcctggaatacctgaaagacccagtgacaataaattgcgggcacaacttttgtcggagctgtcttagcgtgagttggaaggacttggatgacacatttccctgcccagtgtgcaggttctgcttcccttataagagctttagacggaacccacagctgagaaatctgactgaaatagctaaacagctgcaaatcaggcgttcaaagcgcaaaagatag

SEQ ID NO: 60480 - DNA, 1416 bp, Artificial Sequence
  Description of Artificial Sequence: Synthetic coding sequence
atggagttcgtgacggccctagtgaatttgcaggaggaatcctcatgtcccatatgcctcgaatacctcaaggatcccgtcaccattaattgtggtcacaacttttgcaggtcgtgtctctcagtgtcgtggaaggacctggatgatacttttccttgtcccgtgtgtcgcttctgttttccctataaatcattccgccgtaaccctcagctccggaacctgacggaaatcgcaaagcaattacagatccgacgatcaaagaggaagcgtcagaaagagaacgcaatgtgtgagaaacacaaccagtttctgaccctgttttgtgtgaaggatctggaaatcctttgcacccagtgctccttctcaacaaagcatcagaagcattacatctgtccaataaagaaggctgcttcttatcaccgcgagatccttgaggggagtctcgagccgctgagaaacaatattgaacgggtagaaaaagtgatcatactgcagggctccaagagtgtggaattaaagaaaaaagtggagtacaaacgggaggagattaatagtgagttcgagcagattaggctttttctccagaatgagcaggaaatgatccttaggcagatacaggacgaggaaatgaacatcctcgcgaagctgaatgagaatctggtagagctatcagactatgtctcgacacttaagcacctgcttagggaggtggaaggaaaaagtgttcagagcaacctcgaactgctgacgcaagctaagagcatgcatcataaatatcagaatttgaagtgcccagaactgtttagttttcgactcactaagtacggtttctctctgccccctcagtacagcgggctagatcgaataatcaaacccttccaagtcgacgtgatcctggatctgaacactgctcacccacaattgttggtgagcgaagaccggaaagctgttcgctacgaacgcaaaaagaggaatatatgctacgatcccaggcgtttttacgtgtgccccgcagtgctcggaagtcagaggttttccagcggccgacattattgggaggtggaagtgggtaacaagcccaagtggatactcggtgtctgtcaggattgcttattgcgcaactggcaagaccagcctagcgtcctcgggggattctgggcgatcggacgatatatgaaaagtggctatgtggctagcggacccaagaccacacaactccttcccgtggtcaagccctcaaaaattggaatcttcctggactatgaacttggagacctatcattctataatatgaacgatcgctctatcctgtacacctttaacgattgcttcactgaggccgtgtggccctatttttatactggtaccgactctgaacctttgaagatctgttccgtctctgacagcgagagatag

SEQ ID NO: 60481 - DNA, 1416 bp, Artificial Sequence
  Description of Artificial Sequence: Synthetic coding sequence
atggagttcgttacagctttagtgaacctgcaggaggagtcttcttgccctatttgcttggaatatttgaaggatcccgtgacaatcaattgtggccacaatttctgccgatcctgcctcagcgtcagctggaaagatctggacgacacattcccgtgccccgtgtgcagattttgctttccgtacaagagcttccgacggaatccgcagttaagaaacctgactgaaatcgccaagcagctccagatacgtcggagcaaaagaaagcgtcaaaaagaaaacgcaatgtgcgagaaacacaaccagttccttacccttttttgcgtgaaggacctagagatcctgtgcacacagtgtagcttctctaccaaacatcagaaacactacatttgcccaatcaaaaaggcagctagttatcaccgcgagatccttgagggaagtctcgagcccctgagaaataatattgaaagagtagaaaaggtcattatcctacaggggagcaaatcagtagagttgaagaagaaggtagagtacaaaagagaagagatcaatagcgaattcgaacagatccgactgtttctgcagaacgagcaggaaatgatattgcggcaaatacaagatgaggagatgaacattcttgccaagctaaacgaaaacctggtagaactcagtgattacgtgagtactctaaaacatttgttacgggaggtggagggaaaatctgttcagtcaaaccttgaacttctgacccaggccaaaagcatgcaccacaagtaccagaacctgaagtgccctgaactcttctccttcaggctgacgaaatacgggttcagcctacccccacagtacagtggcctggatagaattattaaacccttccaggttgacgtcatactggacctgaacactgcccaccctcagttactggtgtcagaggaccggaaagccgtgcggtacgagcggaaaaagagaaacatttgctatgacccaagaagattctatgtctgcccagccgtcctgggaagccagcggttctcctctggaagacactactgggaggtcgaagtaggcaacaaacccaaatggatcctgggcgtctgccaggactgcctccttcgaaattggcaggaccagccctcagtcctcggcggtttctgggccatcgggaggtatatgaaaagcgggtacgtggctagcggccctaaaactacacagttgttacctgtggtcaagccatcaaagatcggcatctttctcgactatgagctgggggaccttagtttttacaacatgaacgaccggagcattctgtacacttttaacgattgttttacggaagcagtgtggccttacttttacacgggaacagactccgaacctctgaagatctgctccgtgagcgacagcgaaaggtag

SEQ ID NO: 60482 - DNA, 630 bp, Artificial Sequence
  Description of Artificial Sequence: Synthetic coding sequence
atggagttcgtgacagcgctcgcagacctaagggctgaagcttcctgtccaatctgcctggactatctgaaagatccagtgaccatcagctgtggccataatttctgtctgagttgtatcatcatgtcatggaaggacctgcatgatagtttcccctgtccattttgtcacttctgttgcccagaaaggaagttcatcagtaatccacaactgggcagcctcactgagattgctaagcaactgcagatccggagcaaaaagcgcaagcggcaggaagaaaaacatgtctgtaagaagcacaatcaagttctgaccttcttctgccagaaagacctagagctactttgcccgagatgctctctgtccacagatcatcagcatcactgcgtctggccaattaaaaaagctgcctcctaccaccgcaagaagttagaggaatataatgcgccttggaaagaacgagtcgaactcatcgaaaaggttattactatgcagacgcgcaaaagcctagaactcaaaaagaaaatggaatcgccgagtgtcaccagattagaatgtagttgcaccatctctgctcatttcaatctgaggttgcccggatcctccgactcatcagcaagcggttcctag

SEQ ID NO: 60483 - DNA, 1428 bp, Artificial Sequence
  Description of Artificial Sequence: Synthetic coding sequence
atggcatgctcccttaaggacgaattgctttgcagtatctgtctgtcaatttaccaggaccccgtgagcctcggatgcgagcattatttctgtaggcggtgcataacggagcattgggtgaggcaagaggctcagggtgctcgggactgccctgaatgtaggagaaccttcgcggaacctgctcttgccccatctttaaaactggcaaacattgtcgaacgatactctagcttcccgctggacgcgattctaaatgcaagacgggcagccaggccctgtcaggcacatgacaaagtcaagctgttttgtttaaccgaccgcgctttattgtgctttttctgtgatgaacccgctctccatgagcaacatcaggtcaccggtatcgatgacgccttcgacgaactccagcgggagctaaaggaccagctgcaggcactacaggattcagagcgggagcacacagaagccctgcaactgcttaaacggcaactcgctgagaccaagtcttccactaagtcactgcggacgacaatcggtgaagccttcgagcgcctccataggttgctacgggaaagacagaaggccatgctggaagaactggaagccgacaccgccaggactcttacggacatcgaacagaaggttcagcgctattctcagcagctgagaaaagtgcaggaaggtgcccagatcctccaggagcgcctcgcggaaaccgaccgccataccttcttggctggcgtggcctccttatctgagcgcctgaaggggaaaattcatgaaaccaacctgacctacgaggactttccaacaagcaagtataccggtccactccaatacaccatttggaaaagcctctttcaggacatccacccagtacccgctgcccttactctggatcccggaacagcacaccaaagactgatactgagcgacgactgcaccatcgtggcttatggtaatcttcacccacagcccctccaggatagccctaaaagattcgatgtggaggtcagcgtgctgggctccgaagccttcagctccggggtgcattattgggaggtggtggtggctgaaaaaacacaatgggtcatcggtctggcccatgaagcggcatcgcgtaaagggagcatccagatccaaccgtcgagaggattctactgcattgtgatgcacgatggcaaccaatactcagcatgcaccgagccctggactaggttgaatgtccgagacaagctggacaaagtgggggtcttcctggattacgaccaaggcttactaatcttttataatgctgacgacatgtcctggctgtacacattccgcgaaaaattccccggaaagctttgctcctatttcagccctggtcagtctcacgctaacggaaagaatgttcagcccctacgaattaacactgtcagaatctag

SEQ ID NO: 60484 - DNA, 1185 bp, Artificial Sequence
  Description of Artificial Sequence: Synthetic coding sequence
atggcttgcagtctgaaagacgagctgctgtgcagtatttgtctgtcgatttatcaggatcccgtctccctgggatgcgaacattacttttgtcgccgatgcattactgagcattgggtgcgccaagaggcccagggggctagggattgccctgaatgcagaaggactttcgccgagcctgctctcgccccatctctgaaactggccaatatcgtggagaggtactcatcgtttccactcgacgctatccttaatgcccgacgggctgccaggccatgccaagcccacgacaaggtaaagctgttttgcttgaccgatcgcgctctgttgtgttttttctgcgacgagccagctttacacgagcagcatcaggtgaccggcatagacgacgccttcgatgagcttcaacgggaactgaaggaccagctgcaggcattgcaggactcagagcgcgagcacaccgaggcacttcagcttcttaaacgccagctcgccgaaacgaaaagctccaccaagtcgctaagaaccacaatcggcgaagcttttgagaggctccaccggctacttagagaacgtcaaaaggcgatgctcgaggagcttgaggccgataccgccaggacattgaccgatattgaacaaaaagttcagaggtattcccagcaactgcgcaaagtacaggagggcgcacagatcctgcaggagagactcgcagaaacagaccgacacacttttctagccggagtggctagtctgtccgagagactaaaaggtaaaattcatgagactaacctgacgtacgaagattttcctacctccaaatatactggacccttgcaatacacaatctggaagtccctctttcaggacatccacccagtaccagctgccctcacgctcgatccaggtacagcgcaccagagactgatcctttccgacgactgcaccattgttgcatatggcaacctccatccacagcccttacaggacagccctaagcgcttcgacgtcgaggtaagtgttttggggtcagaagctttctcaagtggcgtccattactgggaggtggttgtagcagaaaaaacgcagtgggtgatcggactggcacatgaagctgcttctaggaaaggatccatacagatacaaaacttgggttgtaaaggggtttgggagatgagctttccttag

SEQ ID NO: 60485 - DNA, 1185 bp, Artificial Sequence
  Description of Artificial Sequence: Synthetic coding sequence
atggcgtgttccctgaaagacgagctcctgtgttccatctgccttagtatctaccaagaccccgtctctttgggctgtgagcactacttctgtcgacggtgcattaccgagcactgggtgcggcaggaagcgcagggcgctcgggattgtccagagtgccggaggacatttgcagaaccagcccttgcccctagcttaaagttggctaatattgtggagcggtactcctccttcccactggacgctatcttaaacgccagaagagctgccagaccatgccaggctcacgataaggttaaattgttctgtctgactgacagggcgctattatgtttcttctgcgatgagcccgctctgcatgagcaacaccaggtgacagggatcgacgacgccttcgatgaactgcagcgagagcttaaggaccagctgcaggcactccaggactccgagcgggaacataccgaagcccttcagcttctcaagaggcagctggctgaaacaaaaagtagcaccaagtccctgcggactactatcggggaggcattcgagcggctgcaccggctgctgcgtgagcgccaaaaagccatgctagaagaacttgaagccgacaccgctaggaccctcactgacattgagcagaaggtgcaaagatactcccagcagctgaggaaggtacaggaaggcgctcagattctgcaagaaaggctggctgaaacggataggcacacatttctagctggggtggcctctttgtcagagcgcctgaaaggtaaaattcacgagacgaacctgacctacgaagactttcccacgtcgaagtatacgggaccgctacagtacacaatttggaagtctttgtttcaggatatccaccctgttccagcagctttgactctagaccctgggacggctcatcagcgtttgattctgagcgatgattgtacgatagttgcctacgggaacctgcaccctcagccgttgcaggacagcccaaaaaggttcgacgtggaagtgtcagtcctggggtctgaagctttcagctcaggggtccattattgggaggtagtcgtggccgaaaaaactcagtgggtgatcggcttagcccatgaggcggcatcaagaaaaggaagcattcaaatccagaacctgggctgcaaaggggtctgggaaatgagctttccatag

SEQ ID NO: 60486 - DNA, 1428 bp, Artificial Sequence
  Description of Artificial Sequence: Synthetic coding sequence
atggcttgtagcttaaaggacgagttgctctgctccatatgcctgagcatttatcaagatccggtatctctcggctgcgaacattatttctgtcgacgatgcattacagagcactgggtgaggcaggaggctcagggagccagagactgcccagaatgtagaaggacattcgccgaaccagccctggcaccttccctgaagttggctaatattgtggagaggtactcctcattccccttagacgctattctaaacgcccgtagggcagccagaccatgccaggcacacgataaggtgaaactcttctgcctgacggaccgggctcttctttgctttttttgcgacgagcccgcactgcacgagcagcatcaggttacaggaatcgacgatgcatttgatgagctccagcgcgaactcaaggaccagctacaagcgctgcaggattccgaaagggagcacaccgaagctctgcaattactgaagcgccagctcgcagagaccaagagcagtactaagagcttgcgtacaacaatcggagaagccttcgagaggttgcacaggctcctgagggaaaggcaaaaagctatgcttgaggaactcgaggcggacactgccagaaccctaaccgacattgagcagaaagtacagaggtactcacagcagctcaggaaagtgcaagagggggctcagatcctacaggaacggctcgcggagaccgatagacacacatttttggctggtgtggcttctctctccgagcgcctgaagggaaagatccacgagactaatttaacatacgaggatttcccaactagcaagtacacgggccctcttcagtacacaatctggaaatctctgttccaggatattcatcccgtgcctgcagctctgacattggatccaggcacagcacaccagcgtttgattttgagtgatgattgcacaatcgtcgcctacggtaatctgcacccccagcccctccaagacagcccgaagagatttgacgtggaggtaagcgtcctgggatccgaagcgttctcaagcggcgtgcactactgggaggtggtggtggccgaaaagactcaatgggtgattggccttgctcacgaagctgccagcagaaaaggctcgattcagatacaaccgtcacgcggattttattgcattgtcatgcacgacggcaatcagtacagtgcttgtactgagccttggaccaggttaaacgtgcgggataagctggacaaggtgggggtttttctagactatgatcagggtcttctgatattctacaatgctgatgatatgagctggctgtataccttcagagaaaaattccctgggaagctgtgtagttacttttcccctggtcagtctcacgctaatgggaagaacgtgcaacccctgcgaattaatacagtgcgaatttag

SEQ ID NO: 60487 - DNA, 1065 bp, Artificial Sequence
  Description of Artificial Sequence: Synthetic coding sequence
atgcccgagaagaccgcagtggatcaaccgtggacgcaagcactccgggagctgaaggatcagctccaagctctgcaggacagcgagcgcgaacacaccgaagcgttacagttattgaagcggcagctcgccgagacaaagtcttccactaaaagcctgagaaccacgattggtgaggccttcgagcgcctccaccggctgctgagggaaaggcaaaaagcaatgctcgaggaacttgaggccgacacagctagaaccctcaccgacatagaacagaaggtgcagaggtacagccaacagcttcgcaaagtgcaggaaggcgctcagattcttcaagagaggctggccgagaccgacagacacaccttcttagctggcgttgcaagcctgagcgagcggctgaagggcaagattcatgagacaaaccttacctacgaagatttccccacatctaagtatactggacctctgcagtacactatatggaagtcactgttccaggatattcatcccgttccagctgctttgaccctggaccctggaacagcacatcagcgtctgatcttgagcgatgactgcactatagtggcctatggcaatcttcatccccagcccctgcaggatagtcctaaaagattcgatgtcgaagtttccgtcctaggaagtgaggcgttctcatctggggttcattattgggaggtcgtggtggccgagaagacacagtgggtgatcggtctcgcccatgaagctgctagccggaaaggcagcattcagattcagccctccagaggcttctactgtatcgtcatgcatgacggcaatcagtactcggcgtgcaccgagccttggacccgactgaacgttcgagataagctggataaggtgggcgtcttcttggactacgaccagggtcttctaatattttataacgcggatgatatgtcttggctatacactttccgcgagaagtttcctggtaagttgtgcagctattttagtccaggccagtctcacgcaaatggaaaaaatgtccaaccgctacggatcaatacggtgcggatctag

SEQ ID NO: 60488 - DNA, 1350 bp, Artificial Sequence
  Description of Artificial Sequence: Synthetic coding sequence
atggactcggacgacttgcaagtgttccaaaacgaactgatttgttgcatttgcgtgaactactttatcgatcccgtgacaatagattgtggccactcattctgcaggccgtgtctgtgcctgtgctctgaggaggggagggcccctatgcggtgccctagctgtaggaagactagtgaaaaaccaaatttcaataccaatctcgtcctgaaaaagctgtcaagtttggctaggcaaactcggcctcagaacattaactcatctgacaacatttgcgtgctgcacgaagaaaccaaggagctgttctgcgaagccgacaagcgtttgctctgcggcccatgttctgagagccccgaacacatggcgcactcccacagccctattggttgggccgctgaggaatgtcgggagaagttgattaaagagatggattatttatgggaaattaatcaggagacccggaataatttgaaccaggaaacatctacttttcactcgctgaaagactacgtgagtgtgagaaaacggattatcaccattcagtaccagaagatgccaatcttcctggatgaggaagaacagagacaccttcaggcgctcgaacgcgaggccgaggagctgttccagcagctccaagatagccaagtgaggatgacacagcacctggaacgaatgaaggacatgtatcgggagttgtgggagacctgccacatgcccgacgtggttctgcttcaggatgtgaggaacgtgtcagcgcgtaccgacctagctcagatgcagaaaccccagcctgtgaatccagaacttacctcttggtgtatcacaggagtactggatatgttgaataactttcgcgttgatagcgcactttcaaccgaaatgattccttgttacatttccctcagcgaggatgtgcgctacgtgattttcggggatgatcacttgtctgcccctaccgatccacaaggcgtcgattcttttgccgtgtggggagcgcaggccttcacctcaggcaagcactactgggaggttgatgtgaccctgtcatcgaactggatactgggagtgtgccgggatagccgcaccgcagatgcaaattttgtgattgatagcgacgagagatttttcctgatcagttccaagcgaagcaatcattattccctgtccaccaattccccccctcttatccagtacgtgcagcgcccattgggacgcgtaggggtctttttggattacgataatggcagcgttagctttttcgacgtaagcaaagggtctctgatctatggcttccctcccagtagcttcagttccccactgcgcccatttttttgctttggatgcacctag

SEQ ID NO: 60489 - DNA, 1344 bp, Artificial Sequence
  Description of Artificial Sequence: Synthetic coding sequence
atggattctgatactctgcgtgttttccagaacgagctcatatgctgcatttgtgttaactattttattgatcctgtgaccactgattgtgtgcattctttctgtcggccatgcctgtgtctttgctccgaagagggtcgggcacctatgcgctgtcctttgtgtcggaagatttcagagaagcccaattttaatactaacgtggccctgaagaagctggcaagcctcgcccgtcagactcgacctcagaatatcaactcttcagataatatctgcgttttacacgaggaaaccaaagagctgttctgtgaggccgataagagactgctgtgcgggccatgttctgagagtccagagcacatggcccattcccactccccaattggctgggctgccgaggagtgtagggtgcagaagcttattaaagagatggactatctatggaagatcaaccaagagacacagaataaccttaaccaggaaactagcaaattttgcagtctggtggaggacaagcggaatcggattgtataccgataccagaagatgcatatctttcttgatgaagaagagcagagacacctgcaggcattagagcgtgaggccaaggaactgttccagcagttgcaagattctcaggttaggatgacccagcacctcgaaggtatgaaggacatgtatagggaactgtgggagacgtatcatatgccagacgtcgagctgctgcaggacgtggggaatattagtgcaaggacggacctcgcgcagatgcccaaaccacaaccagttaaccctgagctgacgtcatggtgcataactggagtcctcgatatgctcaacaactttagagtcgacaacgctctgtccaccgaaatgaccccttgttatatttccctaagtgaggatgtgcgcagagtgatcttcggggatgatcatcgctctgctccgatggatcctcagggtgtggagagctttgctgtctggtgcgcacaggcctttacatctggaaaacactactgggaagtggatgtaacacacagcagcaattggatactgggtgtgtgcagggacagccgcaccgccgacactaacattgttatcgattccgacaaaacctttttttccatttccagcaagacctccaaccattattcattgtccactaacagcccacctctgatccagtacgtccagcgcccactcggatgggtaggcgtctttctggattatgacaatgggtcagttagcttttttgacgtgagtaagggcagccttatctacggttttcctcctagcagcttctctagtccactgcggccatttttttgtttcgggtgcacctag

SEQ ID NO: 60490 - DNA, 1554 bp, Artificial Sequence
  Description of Artificial Sequence: Synthetic coding sequence
atggcagcacaattgcttgaagaaaagctgacttgcgctatttgtctcggcctgtaccaggatcctgtgaccctaccatgtggccacaacttttgcggtgcgtgcatccgcgattggtgggacaggtgtggaaaggcatgccccgaatgcagagagcctttccccgacggagcagagctccggaggaatgtcgctctgagtggagtgctcgaggttgttcgagccggtcctgctcgcgaccccggacctgatccaggacccggtcccgaccccgcagcacggtgccccagacacggaagaccactggaactcttttgccgcactgaaggtcggtgtgtgtgctccgtatgcacagtcagagagtgtagattacacgagagagcactcttagacgccgagcggctaaagcgggaggcccagctgcgggcttctctagaagtcactcaacagcaggctactcaggccgaaggacaattgctggaactcaggaagcaatcaagtcaaatccagaactccgcctgcatcctggcaagctgggtgtcggggaagtttagttctttgcttcaagccctcgagattcagcatacaactgccctccgttcaatcgaggtggcgaagacccaagcgctggcccaggcccgagatgaggagcaaaggctacgggttcacttagaagccgtggcgaggcacggatgtcgaatccgcgagttgctcgaacaagttgacgagcagacatttctccaggagtctcagctcttacagccccctggaccactgggacctctcaccccactgcaatgggatgaagaccaacagctgggagatcttaaacagctgctgtctagactatgcgggttgctgctagaagagggtagtcatcctggagctcctgctaagccagtcgacttggcccctgtggaggccccaggcccactggcacctgtgccatccactgtgtgccctctgaggcggaagctttggcagaactaccgtaatttaacgttcgacccggtttccgcgaaccgacatttctatctgagcagacaggaccagcaggtgaaacattgccgccaaagcagggggccaggaggccctggcagctttgagctgtggcaggtgcaatgcgcgcagtcatttcaggctggccaccattactgggaagttcgggcttcggatcatagcgtgaccttgggagtctcttacccccaactcccccgatgcagactcggaccccacacagataatatcggcagagggccttgttcgtggggtctgtgtgtgcaagaggactccctgcaagcctggcataacggagaagcccagagactgccaggagtgtcaggcagattgttggggatggatctggacctagctagtggttgcttgacgttttacagcctggaaccccaaacgcagcccctatatacctttcacgctctcttcaatcagccactcaccccagttttttggctcctcgaaggcaggacgctgaccctttgtcatcaaccaggcgcagtgttccctctcggccctcaagaagaggtcctctcttag

SEQ ID NO: 60491 - DNA, 1407 bp, Artificial Sequence
  Description of Artificial Sequence: Synthetic coding sequence
atgtctactgcagacttgatggagaacctacgtgaggagctcacttgtttcatctgcttggactattttagtagccccgtgacaacagagtgcggacatagcttttgtctcgtgtgtcttctgaggtcttgggaggagcacaatacaccacttagctgtccggagtgctggcggactctcgagggacctcattttcagtcaaacgaacgactaggacgactggcttcaatagcgagacagctcaggagccaggtcctgcaatcagaagatgaacagggcagctacggccgaatgcccacaaccgccaaggctctctcagatgacgaacagggtggcagcgctttcgtggcacagtcacacggggctaatagggtgcatctgagtagcgaggcagaggaacaccacagagaaaaactgcaggagattctaaatctcttaagagtgcgcagaaaagaagcccaagcagttctgacacatgaaaaggagagagtgaaactgtgtcaggaagaaacgaagacctgcaaacaggtagtggtgtcggagtacatgaaaatgcaccagttcttgaaggaagaagaacaactgcagttgcagctattggagcaggaggagaaggagaacatgagaaagttgcggaacaacgaaattaagttaacacagcagatccggtcactctcgaagatgatcgcccaaatagagtcttctagccagtccagtgcattcgagagcctggaggaggtgagaggcgcattggagaggtctgagcccctgcttctgcagtgtcctgaggccaccactaccgagttatctctgtgtaggatcaccgggatgaaggaaatgttgagaaagtttagtaccgagataacacttgacccagctactgcaaacgcatatctggtgctttctgaagatcttaaatctgttaagtatggcggatccagacagcagctgccagataaccccgaaaggtttgatcagtccgcgacagtgttaggcacccagatctttacttccggtagacattactgggaagttgaagttggaaacaaaactgagtgggaggtgggcatctgtaaagattccgtgagtcgtaaaggtaatttacctaagcctcccggtgacctgttttccctcattggactcaaaatcggcgatgactacagtttgtgggtgagctcgccccttaaaggtcaacatgtgcgcgagcccgtttgtaaggtcggagtcttcctggattacgagtctggccacattgccttctacaatggcaccgatgaatccctcatttatagttttcctcaggcgtcctttcaggaggcgcttcgtcccatcttttctccgtgtctgccaaacgagggaactaacacagacccactcacgatctgttcacttaactcccacgtatag

SEQ ID NO: 60492 - DNA, 1164 bp, Artificial Sequence
  Description of Artificial Sequence: Synthetic coding sequence
atggtttgtgggatccaggaggcggcagagaactatcgcaagctcttccaggaaatattgaatacttctcgggaaaaactggaggccgctaagtccattttaacggatgaacaggagagaatggcaatgatccaagaggaggaacaaaactttaaaaagatgatcgaaagcgagtactcgatgagattacgcctgctcaacgaggaatgcgaacagaacctgcaaagacagcaggaatgcatatctgacctcaacctccgggaaacactcctcaaccaggccatcaaactggcaacggagttggaagagatgttccaagagatgctccagcggctgggcagagtcggcagagagaacatggagaagcttaaagagagtgaggccagagcctcagagcaggtacgctcgctcctgaaattgatcgtggaactggaaaaaaagtgtggtgaaggaaccctggccttgctcaagaatgcaaagtactcgctggagcgcagcaaaagcctcttgctggagcacctcgagcctgctcacatcaccgacttatcactctgccatattcgaggactttcctctatgttcagagttctacaaagacacttgaccctagatcctgagacagcacatccatgtctagccctcagtgaggatttgcgaactatgagattgcggcacggccaacaagatggcgcagggaacccagaacgtctggacttctcagcgatggtgctcgccgctgagagcttcactagtggaaggcactattgggaagtcgatgtggaaaaagctactcggtggcaggtgggaatttatcatgggtctgccgatgccaagggctctacggccagagcctccggcgagaaagttctactgaccggctcagtgatgggcacggagtggacactgtgggtgttccctccactcaagcggcttttcctcgaaaagaaattagataccgtaggggtgtttctcgattgtgagcatgggcagatcagcttctataacgttacagaaatgagcctgatctataatttctcccactgtgcgtttcagggtgcccttaggcccgttttctctctgtgtatccccaatggggatacctctcctgacagtcttaccatcttacaacacggaccttcctgcgacgccacagtgtccccttag

SEQ ID NO: 60493 - DNA, 666 bp, Artificial Sequence
  Description of Artificial Sequence: Synthetic coding sequence
atgagcaagcgactgtccccccaactccagcacaacattactgaggatgcatattgcgagacccaccttgaacctacccgtctcttctgtgacgtggaccagatcacactgtgttccaagtgctttcagagccaagagcacaagcaccacatggtgtgtggaatccaggaggccgcagagaattatcgcaagctattccaggagattctgaacacttcccgtgaaaaactggaagccgcaaagtctattttaactgacgaacaagaaagaatggccatgattcaggaggaggagcaaaatttcaagaaaatgatagaatcagaatactctatgagactgcggttgctcaacgaagagtgtgagcagaacttacagcgacagcaagagtgcatctccgacctgaatctccgggaaactctcttaaaccaggccataaagctcgccaccgaactggaggaaatgtttcaggaaatgttgcaacggctgggtcgcgtgggacgagaaaacatggagaagcttaaggaatcagaagcaagggcctccgagcaagtcaggtccctactgaagctgattgtcgaactggagaaaaaatgcggtgaaggaactctggctctcctcaaagtaaggtgctgggagaaagagaacaagatacatagttctatctag

SEQ ID NO: 60494 - DNA, 1173 bp, Artificial Sequence
  Description of Artificial Sequence: Synthetic coding sequence
atgtgtatttgccacctgccctgtagaccggttaaacccaacatcattggggagcagataactagcaagatgggcgctcactatcattgtattatttgcagtgccaccataacacggaggaccgacatgctgggccatgtgagaagacatatgaacaaaggtgaaaccaagtcctcatatattgcagcctctacagctaagccacccaaagagattttaaaagaggcggacaccgatgtgcaagtttgccccaactactcaatcccgcaaaaaaccgatagttacttcaatcccaagatgaaactgaatcggcagttgatcttctgtaccttggcggctctcgccgaggagcgaaaacccctggagtgcttggatgccttcggcgcaaccggaataatgggcctacagtgggctaagcacctgggaaacgcagtgaaagtaaccattaatgacctgaacgagaactctgtaactcttattcaggaaaactgccacctgaacaaacttaaggtagtggtggactccaaagaaaaagaaaagagcgacgacatcctggaggagggtgaaaagaacctaggcaacataaaggtgacaaagatggacgccaacgtgctgatgcacttgcggtcgtttgacttcatacacctagatcccttcggcactagtgtcaattacttagattcagcattccgcaatatccggaacctgggtatagtctcagtcacttctacagacatcagttcgctctacgccaaagcccagcatgttgcacggcgtcactacggatgcaatatagttaggactgaatactataaagagctcgcagcccgtattgtagtagctgcggttgccagggctgctgctcggtgcaataaaggcatcgaagtgctcttcgctgtggccttggaacattttgttctggtcgtggtaagggtattaagagggccaacctctgcggacgagaccgctaagaagattcaatacctgattcattgtcagtggtgcgaggagcgcatcttccaaaaggacgggaacatggttgaggactactctgctaattttgtgatctcttacaccggatttccttttgtgaatcgccaggatattaggaagacacatatcgactcttgtctggtgaccgtgatggaggcatgtctggaacgtcagcagtag

SEQ ID NO: 60495 - DNA, 2202 bp, Artificial Sequence
  Description of Artificial Sequence: Synthetic coding sequence
atggagaacatggccgaagaggaactcctacccctggagaaggaggaggtggaagtggcacaggtgcaggttcccacccccgctagggattcagccggagtgccagccccagctccagactcagccctcgattctgcccctacacccgcttcagccccagcacccgctcccgcattagcgcaagcccctgccctcagtccaagcctggcctctgcgcctgaagaagcgaaatcaaaacgacatattagcatccaaagacagctagcggacctggagaatctggctttcgttaccgatggaaattttgactcagcctcaagcctgaattctgacaatctggacgctggtaaccggcaagcctgtccactgtgccccaaagaaaaattcagagcttgtaacagccacaaactgaggcgccatctgcaaaatctacactggaaggtctctgtggaatttgagggatacaggatgtgtatttgtcacctgccatgtaggcctgttaaacccaacatcatcggggagcagatcactagcaaaatgggcgcacattaccactgcatcatttgctctgccacgatcacgagaaggacagacatgcttggacatgtgcggaggcatatgaacaaaggggagactaaatcctcatatatagctgcctccacagcaaaaccacccaaggagatactgaaggaagccgataccgatgtgcaggtgtgccccaactactccattccacagaagaccgattcatatttcaaccccaagatgaagctgaacagacaactgattttttgcacactggctgccctcgccgaagaaaggaagccattggagtgcctcgatgcttttggagcaactgggatcatgggcttgcagtgggctaagcacctgggcaatgcagtcaaggtcaccatcaacgatctcaacgagaatagcgtgacactcatacaggagaattgtcacttaaataaactgaaggtggttgtggatagtaaggagaaggaaaagagcgacgacatcttagaagagggcgaaaaaaacctggggaacattaaagtcacaaaaatggatgcgaatgtgctaatgcaccttcggagctttgatttcatccacttggacccctttggtacctccgtcaactatctggactctgcctttcgaaatataagaaatctagggatagtgtccgtgacctcaactgatatttcttcgctctatgccaaggcgcagcacgtggcccgaagacattacggatgcaacatcgtcaggactgagtactacaaagagctggctgccaggatcgttgtggccgctgtcgccagagcggctgcacggtgtaacaagggtatcgaggtgctttttgctgtagcactggagcatttcgtcctcgttgtcgtgcgggtactccggggaccaacatcagccgatgaaacagcaaagaagattcagtatctgatccattgccaatggtgcgaagaaaggatcttccagaaggatggcaacatggtagaggagaacccctaccggcagctgccgtgcaactgtcacggaagtatgcctgggaagacagccatcgaattgggacccctgtggtcatcatcactgtttaataccggtttcttgaaacggatgctattcgaaagcctccatcacggtctggatgatatccaaaccttaatcaaaactctgattttcgagtcagagtgcacaccacagtcacaatttagtatacacgccagcagcaacgtgaacaagcaggaggagaatggcgtttttatcaagacaaccgatgacactacaactgacaattatattgcccagggcaaaaggaagagcaatgagatgataaccaatcttggaaaaaagcagaaaactgacgtgtctacagaacacccccctttttactacaacatacacagacactccatcaaggggatgaatatgccaaagttgaagaagttcctctgctatctgtcccaagcaggcttcagagtcagccggacacactttgacccgatgggagttaggactgatgccccactgatgcagttcaaatccatactccttaagtacagcacgccaacatacaccggtggccagtcggaaagccacgtccagtctgcaagcgaagacacagtcacagagcgcgtagagatgagtgtgaacgacaaggcagaagcttcagggtgtcggaggtggtag

SEQ ID NO: 60496 - DNA, 639 bp, Artificial Sequence
  Description of Artificial Sequence: Synthetic coding sequence
acatcagtgaattacctggattccgcctttcgaaacatcaggaatcttggcattgtcagcgtcacgagcacagatattagttctctttacgcaaaagcccaacatgttgcaaggcgtcattatgggtgtaatatagtgcggactgagtattataaggaacttgccgctcgtatcgttgtggccgctgtggccagagctgccgctcgttgcaacaaggggattgaggtgctgttcgccgtggccctggaacacttcgtgcttgtggtggtgagggtactaagaggccctacaagcgccgatgaaaccgctaaaaaaatccaatacttaatccactgtcagtggtgcgaggagagaatcttccaaaaggatggaaatatggtggaggaaaatccttacagacagttgccttgtaattgccatggatcaatgccgggtaagacggccatagaacttgggcctctctggtcctcctcattgttcaacaccggattcctgaagcggatgttgtttgagtcactgcatcatgggctggacgatatccagactttgataaaaacacttatcttcgagagcgaatgtacccctcagtcccagttctctattcacgcaagcagtaatgttaataaacagggcgactag

SEQ ID NO: 60497 - DNA, 1392 bp, Artificial Sequence
  Description of Artificial Sequence: Synthetic coding sequence
atggccttgagttgcacgcttaatagatatcttctacttatggcccaggaacacttagaatttcggctacctgagattaagagtctgctactgctctttggtggtcagtttgcctccagccaggaaacttacgggaagtctccattttggattctctctatcccctctgaggacattgcccgaaacctcatgaagcggactgtgtgcgcaaagagtattttcgagttgtggggccatggacagagtccggaggagttatattcctcactgaaaaattaccctgtggagaaaatggtgccttttctgcactccgattctacctataagattaaaatccacacattcaataaaacgctgacccaggaagagaagatcaaaagaattgacgccctggaatttttaccctttgagggaaaggttaatcttaagaaaccccaacacgtgtttagtgtactggaagattatggcctggatcctaactgcattccagaaaacccacacaacatttacttcggaaggtggatcgcggatgggcagagagagctaattgaaagctactccgttaagaaacgccactttattggaaacacctcaatggacgctgggctgagtttcattatggccaaccacggaaaggtaaaggagaacgacattgtttttgatccctttgttgggacagggggtcttcttattgcctgcgcccattttggcgcatacgtgtatggtacagatattgactacaacaccgtgcacggcctgggcaaagccacccggaagaatcagaagtggcgcggaccggacgaaaacattagagcaaatctgcgacagtatggcctggaaaagtactatctggacgtcctagttagcgatgcctctaaaccaagctggcgcaagggcacgtattttgatgctatcatcacagacccaccgtatggaatccgcgaatccactcgtaggaccggatcccagaaagagatccccaagggaattgaaaagtgggaaaaatgccctgagagccacgttccagtctcgctttcatatcatctgagtgatatgtttctggacctcttaaatttcgcagccgaaactctcgtacttggtggcaggctcgtctactggctcccagtgtacaccccagaatacaccgaagaaatggtcccctggcatccttgccttgagctggtctccaactgcgagcaaaagctcagctctcacacatcaagacgtcttataacaatggagaaggttaaaaaattcgagaatcgtgatcagtactcccatttgctttctgaccacttcttgccataccagggccataactcatttcgggagaagtattttagcggcgtcaccaagaggatcgccaaagaggagaaatctacccaagagtag

SEQ ID NO: 60498 - DNA, 1377 bp, Artificial Sequence
  Description of Artificial Sequence: Synthetic coding sequence
atggcgctgagctgtactctgaatagatacttgctcctgatggcccaggagcacctggagtttcgattgccagaaataaagtcgctcctgttattattcggaggtcaatttgccagttctcaggaaacctatggaaaatcaccattctggattcttagtatcccttccgaggacatcgccaggaacttgatgaaacgcactgtgtgcgcgaagtccattttcgaactatggggccatggacagagccccgaagaactgtactccagcctgaaaaactaccccgtagaaaagatggtccctttcctccacagcgactcaacctataaaataaaaatacacacgtttaacaagacgttgacccaagaggagaagatcaaacggatcgacgcacttgaatttttgccattcgaaggcaaggttaacctcaagaaaccacagcacgttttcagtgtgctcgaggattatggactcgaccctaattgtatccccgaaaatccacataacatctacttcggcaggtggatagccgatgggcagagggaactgatcgagtcctactccgttaagaagcgccattttatcggaaatacaagcatggacgcagggctgtccttcattatggcaaaccatggcaaggtcaaggaaaacgacatagtgtttgatcctttcgtaggtaccggcggactgctcatagcttgtgcccatttcggtgcatatgtgtacgggactgatatcgactacaatactgttcatgggttgggaaaggctacccggaagaatcaaaaatggagagggcctgacgagaacatccgggctaatctgagacagtacgggctggagaagtactacctcgatgtgttagtgtcagacgctagtaagccatcgtggagaaaaggaacctacttcgacgcaataattacggatccaccctacgggatcagagaaagcacgcgtaggacgggaagtcagaaagagattcctaaaggcattgagaagtgggagaagtgccctgagtcccatgtgccggtgtcactttcctaccacttaagcgatatgttcttagatctgttgaattttgccgctgaaaccctagtgttgggtgggagactggtgtattggctacccgtgtacaccccagagtatactgaggaaatggtcccatggcacccatgcctggagcttgtttccaattgcgaacaaaagttatcaagccatacaagccgcaggctgataacaatggaaaagaacagggaccagtattctcatctgctttctgatcattttctaccctaccaaggacacaattcctttcgggagaagtacttctccggcgtgaccaagaggatcgcaaaagaggagaagtctacccaagagtag

SEQ ID NO: 60499 - DNA, 282 bp, Artificial Sequence
  Description of Artificial Sequence: Synthetic coding sequence
atgaagcgtaccgtgtgcgcaaagagtatatttgagctgtggggccacgggcaatctcccgaggaactctattcatccctcaagaactaccctgtcgagaagatggtgccattcctccattctgatagcacatataaaattaagatccatacattcaataaaacgctgacacaggaggagaagatcaagcggatcgacgccctagagttcctgccctttgaagggaaggtgaacttgaagaaaccccagcatgtttttagcgtacttgaggactatggctag

SEQ ID NO: 60500 - DNA, 405 bp, Artificial Sequence
  Description of Artificial Sequence: Synthetic coding sequence
atgaagcggactgtttgcgccaagtccattttcgagctgtggggccatggacagagccccgaagagctatactcctcgctcaagaactacccagttgaaaagatggtgccctttctgcactctgactcgacatacaagattaagattcatacgtttaacaaaacattgactcaagaagaaaagattaagaggattgatgccctggaattcttgcccttcgagggaaaggttaacctaaagaaaccccagcacgtattctctgtgttagaggactatgggctggacccgaattgcatcccagagaatccacacaatatatatttcggccgatggatagccgatggccagagagaacttatcgagagttacagtgtcaagaaacggcacttcatcgggaacacatag

SEQ ID NO: 60501 - DNA, 774 bp, Artificial Sequence
  Description of Artificial Sequence: Synthetic coding sequence
atggctctcagttgtaccctcaaccgttatctgctgctcatggcccaggaacacttggaattcagattgccagagatcaagtctctactcctcctgttcggcggtcaatttgcttcaagccaggaaacgtacgggaagtcacctttttggatattatccatccctagcgaggatatcgccaggaatctgatgaaacgaacagtctgtgccaaaagtatttttgagctgtggggccatggccagtcccccgaggagctgtatagcagtctcaaaaattacccagtggagaaaatggtgccctttctgcattctgactcaacttataaaatcaagatccacaccttcaataaaaccctgactcaggaagaaaagattaagcgaatcgacgccttagagttcctaccctttgaaggcaaggtcaatctcaagaaacctcagcacgtattctccgtactggaagattatggcctggaccctaattgcatacccgagaaccctcacaatatctatttcggcagatggatcgctgatggccagcgcgaactaatagagagttatagtgtaaagaaaaggcatttcataggcaatacctccatggacgctgggttatcgttcattatggctaaccacggcaaggtgaaggaaaatgatattgtgtttgacccattcgtgggaaccggtggcctcctcatcgcttgtgctcatttcggtgcatacgtatatggcacagacatagattacaacactgtgcacggacttgcctgtagtacatag

SEQ ID NO: 60502 - DNA, 513 bp, Artificial Sequence
  Description of Artificial Sequence: Synthetic coding sequence
taactcagtttcataatggcgaaccacggcaaggttaaagagaacgatatcgtctttgacccattcgttggcactggcggtctgctgattgcttgcgctcacttcggcgcttacgtatacggcacggatatagactacaacacagtgcacggcctgggcaaagcgactcgcaagaaccagaaatggcggggtcctgatgagaacataagggcaaacctgcgccagtatgggctcgaaaagtattatcttgatgtccttgtgtccgacgcatctaagccctcctggcgcaagggcacttatttcgacgctatcataacagaccccccatatggcatacgggaatctacaaggcgcactgggtcacagaaggagatccctaaaggaattgaaaaatgcccagagagccatgtgcctgtgagtctttcctaccatctgagcgatatgtttttagatctgctcaactttgcggctgagactctagttctgggcggtcgtcttgtgtactggctctag

SEQ ID NO: 60503 - DNA, 378 bp, Artificial Sequence
  Description of Artificial Sequence: Synthetic coding sequence
atgaagctgctgacccacaatctcctctcatcccacgtcaggggcgttggtagcaggggcttccctctaagacttcaagcaaccgaggtaaggatctgccccgttgagtttaatcctaattttgtggccaggatgatccctaaggtggagtggtccgcctttctggaagccgctgacaatctccggctgattcaggtgccaaagggcccagtagaaggttacgaggaaaacgaagagttccttagaacaatgcaccatctgctgttggaagtagaggtaatcgagggcaccctgcaatgtccggagtcggggagaatgtttcctatctcccgaggtattcccaacatgctgctgtctgaagaagagaccgaatcctag

SEQ ID NO: 60504 - DNA, 1347 bp, Artificial Sequence
  Description of Artificial Sequence: Synthetic coding sequence
atgcgagagaatgtcgtcgtctcaaatatggagcgggaaagtgggaagcctgtagcagtggtggcagtggtgacagaaccttggttcactcaacggtatagggagtatctccagagacagaaactctttgatacacaacaccgggtggagaaaatgcccgatggcagcgtggcactccctgtgctgggggaaacactgcctgagcagcacttgcaggagctccgtaatcgagtcgcccctggctccccttgcatgttgacacaactgccagaccccgttccatccaagcgagcacagggatgctctcctgcccagaaactgtgccttgaggtcagccgatgggtagagggcaggggggtgaaatggtctgccgagctcgaggccgacttacctcgaagctggcagaggcacggcaaccttctgctcttaagcgaggattgctttcaggcaaaacagtggaaaaatctgggtcctgagctgtgggagacagtggcccttgcactaggagttcagaggttggcgaaaagggggagagtgtccccagacgggacacgcacaccagcagttacgctgctgttgggggaccatggatgggttgagcacgtcgacaatggcattcgttataagttcgacgtgacccagtgcatgttctctttcggaaatataaccgaaaaactgcgcgtggcgagccttagttgcgccggagaagtgctggtggatttgtatgccggaatcggatattttacgttgccttttctcgtgcatgcgggagccgctttcgtgcacgcctgtgagtggaatcctcacgctgttgtggccttgaggaataacttagagattaatggcgtggcagataggtgccagatccattttggagacaataggaaacttaagctgagcaacatcgcagatcgcgtgattctgggcctcattccgtcctccgaggaaggttggcctatagcctgtcaggtgttgagacaggatgccggaggtatcctgcacatacaccagaatgtggagagcttccccggaaagaatctacaggctctcggcgtgtcaaaagtcgaaaaggaacactggctttatccccagcagatcaccaccaaccagtggaagaatggagccacgagagattcaagggggaagatgttgagtcccgctaccaagcctgaatggcagaggtgggcagagtcagcagaaacccgtatcgccaccttgctgcagcaagtgcacgggaagccttggaagacacagattctccacatccagcctgtcaagtcatacgctcctcacgtggaccacatcgtcctggacctggaatgctgtccctgcccatcagtgggttag

SEQ ID NO: 60505 - DNA, 1434 bp, Artificial Sequence
  Description of Artificial Sequence: Synthetic coding sequence
atgctgatggcatggtgtcgagggcctgttctactttgcttgcgacaggggctcggcaccaactccttcctgcatggactcggccaggaaccattcgagggagcacggagcctctgttgtagaagcagcccacgggacctccgagatggagagcgagaacacgaggccgcacagcggaaggccccaggcgctgaaagctgcccatcactgccactgtctatatctgacatcggaacgggttgtttaagttcattggagaacctgaggctgcctaccctcagggaagaaagcagccctcgagagttggaggattcatccggcgaccaaggccgatgcggccctacccatcagggatcggaagatccgtcgatgctgagtcaagcgcaatcagcaacagaggtcgaggagaggcatgtgtcgccaagttgcagcacatcgcgggagaggccttttcaggccggtgagttgatccttgcagaaacaggcgagggggagaccaagttcaagaagctctttcgcttaaataattttgggttactgaactctaactggggggcagtgccttttggtaagatcgtaggcaagtttccaggccaaatactcaggtcttcatttggaaaacagtatatgctgcgacggcctgcattagaagactacgtggttttaatgaagcgcggaaccgcaataaccttcccgaaagatattaatatgattctgagtatgatggacattaacccaggcgataccgtactggaagctggatctggtagtggcggtatgtccctgtttttgagtaaggcggttgggtcgcagggacgggtgatttcgtttgaggttaggaaggaccaccatgacctagctaaaaagaactacaaacactggagggactcttggaaattaagccatgttgaggagtggcctgataacgtcgatttcattcacaaggatatctcaggcgcaacggaagatatcaagtctctgaccttcgatgccgtcgcactggatatgctgaatccccatgtgacactgcctgtgttctatccgcacttaaagcacggcggtgtgtgtgccgtttacgtggttaatattacacaggttatcgagttacttgacggtatcagaacctgcgaactggccctctcttgcgagaagatttctgaggtcattgtgcgcgactggttagtctgtcttgccaaacaaaagaacgggatcttggcccaaaaagtggaatctaagattaatacggacgttcagctcgactctcaggagaagataggcgtcaagggcgagttgtttcaggaagacgatcatgaggagtctcattccgattttccctacgggagctttccatacgtggccaggcctgttcactggcaaccaggtcacactgccttcctcgtaaaactgcggaaggtcaaaccccagctgaattag

SEQ ID NO: 60506 - DNA, 933 bp, Artificial Sequence
  Description of Artificial Sequence: Synthetic coding sequence
atgttagtcgtcgaggttgccaacggacggagtctcgtatggggcgctgaggccgtgcaagcactcagggagagactgggcgtggggggacggacagttggtgctctgccacgcggtcctaggcagaactcccgacttggattgcccctgctcctcatgccggaggaagctcggctgttggccgaaatcggggcagttacgctggtttccgcgccacggcctgacagccgacatcattccctggccctgacatcattcaaacgacaacaggaggagtctttccaagagcaaagcgccctggctgccgaggctcgggaaacgcggcgtcaggaactcctcgagaaaattactgaaggtcaagcagccaagaaacaaaaactggaacaagcttctggcgcatcgtcgagccaagaggcgggtagcagtcaagcagcgaaggaagatgaaacgtctgatggacaggcctctggggagcaggaagaggcgggtcccagcagctcccaagccggtcctagcaacggagtggcccctctcccaaggagcgcacttttggtgcagctggccaccgccaggcccaggcctgtgaaggctcggccacttgattggcgggtgcagtctaaagattggccacatgctgggcgtcccgctcatgagctgagatacagcatctacagagacctttgggaacgcggattcttcctgagcgccgctgggaaattcggtggggattttctcgtgtaccccggtgatccgctcaggtttcatgcccactacattgcgcagtgctgggctcctgaggacacaattccccttcaggatttggtggcagcaggcagacttgggacatccgtgcgcaagacattgctgctctgctcccctcagcccgatggtaaggttgtttatactagcctgcagtgggcctctcttcagtag

SEQ ID NO: 60507 - DNA, 933 bp, Artificial Sequence
  Description of Artificial Sequence: Synthetic coding sequence
atgctggtggtagaggtcgccaacgggaggagcttggtctggggcgctgaagcggtacaggcactccgggaaaggctgggagtcggaggcaggacagtgggtgcactgcccagaggcccacggcaaaattcccgattaggcctgccactgctgttgatgcccgaagaggccaggctgctggccgagatcggggcagtgacgttagtcagcgccccacgacctgatagtcggcaccactccctggctcttaccagcttcaaaaggcagcaggaggagagttttcaagaacagagcgcgcttgctgcggaagctcgcgagacccgacgccaggagctgctggaaaaaataactgaggggcaggctgccaagaaacaaaaattggagcaggcaagcggcgcatcctcctcccaagaggccggttccagtcaagcggcaaaagaggacgaaacttcggatggccaggcatccggagagcaggaagaagctgggccttccagcagccaggccggaccatctaatggcgtcgctcccctaccacggagcgcactgctcgtgcaactcgcgactgcgagacctaggcccgtgaaggcccgaccactcgattggagagtgcagagcaaagactggccacacgcaggccgaccggctcacgagttacgttacagcatctatcgagatctttgggagcgtggatttttcttatccgctgcaggcaaattcggaggagattttctggtgtacccgggtgatccccttcgtttccatgcacattacatcgcccagtgttgggcaccagaagacacaattccattgcaggacctggtggctgccggtcggttggggacatcggtccggaaaacccttcttctttgtagccctcaacccgacggtaaggtcgtctacacctccctgcagtgggccagtcttcagtag

SEQ ID NO: 60508 - DNA, 933 bp, Artificial Sequence
  Description of Artificial Sequence: Synthetic coding sequence
atgctggtcgttgaggtagccaacggcagatcgttggtctggggggcagaggccgttcaggcactgcgggaacggctcggcgtggggggtaggaccgtaggcgcactccccagaggtcctcgacagaacagccggctagggctgccgctactgctgatgccggaggaggccaggttgctggctgagattggtgccgtgaccctcgtgagcgctccgaggcctgactctcgtcatcattcactggcattgacgtccttcaagcggcagcaagaagagagtttccaggagcagagcgccttagcagccgaagctagggagacgaggcggcaggagttgctcgaaaaaattaccgagggccaagcagctaaaaagcagaagctggagcaggcttccggcgcttcttcttcccaagaagcgggttcgtcccaggcagctaaagaagacgaaacgagcgatgggcaggcctctggtgagcaggaggaggccggtcctagctccagtcaggccggacctagcaatggcgtggcccctctccccaggtccgcactcctggtgcagctggcgactgccagaccaaggcctgttaaggctcggccactggattggagggtacagagcaaagactggccccatgcgggtcgccctgcccacgaactgcggtactccatctatagggatctgtgggagcgcggtttctttctcagtgctgccggaaagtttggaggggactttttggtgtatcccggagaccctctgcggtttcacgctcattatatagcccagtgctgggcccctgaggacactatcccgcttcaggacttggtggctgctggcagacttggcacttctgttcggaagaccctgctcctgtgctcaccccagcctgatgggaaagtggtgtatacaagtcttcagtgggcatccctccagtag

SEQ ID NO: 60509 - DNA, 933 bp, Artificial Sequence
  Description of Artificial Sequence: Synthetic coding sequence
atgcttgtagttgaggtggctaatggacggtcactagtgtggggcgcagaggccgtacaggccctacgggagcggttgggggtggggggaaggactgtaggggcactccccaggggaccaagacagaattcccgtttgggactacccttgcttctgatgcccgaggaggctcggctcttggcagaaatcggggcagtcactctggtctcggcaccacgcccagattcacgccaccattctctcgcactcacgtccttcaagagacagcaggaggagtcctttcaggaacaaagtgcgctcgccgcagaagctagggaaactcgaagacaggaactacttgagaaaattactgagggacaggctgcaaagaaacagaagctggagcaggcctcgggagcaagtagttcgcaggaagccggaagctctcaggcagccaaagaggacgaaacaagtgatggacaggcctctggagagcaggaggaggcaggtccaagctctagccaagccggaccctccaatggagtggccccactaccgagatctgctctgctcgtgcaactggccaccgcacgccctcggcctgttaaggcccgtccgctcgactggcgtgtccagtctaaggattggcctcatgctgggcgtcctgctcatgaactgcggtactccatatatcgggacctgtgggaaagaggctttttcctgagtgctgccggaaaattcggcggtgactttttagtttacccaggggatcccctgagattccatgctcactatatagcccaatgttgggctccagaggacacaatcccactccaagacctagtggctgcaggcaggcttggtacaagcgttcgcaagactcttctcctctgcagtccacaaccagatggcaaagttgtgtatacctctctgcagtgggccagcttacagtag

SEQ ID NO: 60510 - DNA, 933 bp, Artificial Sequence
  Description of Artificial Sequence: Synthetic coding sequence
atgctggtagtggaggtggcaaacggacgctccctggtttggggagccgaggcagtccaggctctcagggagaggctgggtgtgggtggaagaaccgtaggcgcattacctcgcggtccccgtcagaattcccgtctgggcttacctctgctgttgatgcccgaggaggctaggctcctggccgagattggtgccgtgacactagtctcagctcccagacctgatagtcgacatcactcactcgcccttacgtcatttaaaagacagcaagaggaatcctttcaggaacagagtgccctggccgcagaggcaagagagacccggcgacaggagctcttggaaaagatcacggaaggccaagctgcaaaaaagcagaagctggagcaggcgtcaggcgcaagctcctcccaggaggccggttcctctcaggcagctaaagaagacgaaaccagcgacgggcaggcaagcggcgagcaggaggaggctgggccatcttcttctcaggctggaccaagcaacggtgtagcaccgcttccaaggagcgctctgctagtccagttagcgaccgcaaggccccgtccggtgaaggcaagaccgcttgattggagagtgcagtcaaaggattggccccacgcgggaaggcccgctcacgagctgcgctacagtatttatagggacttgtgggagcgcggtttttttctatctgctgccggaaaattcgggggagattttctagtatacccaggagatccgctcagatttcacgcacactatattgcgcagtgctgggcacccgaggacaccatacccttacaagacctggtggcagccggtagactgggtacaagcgtacggaaaactttactgctgtgctcccctcagcctgatggcaaggtcgtgtacacttccctgcaatgggctagcctgcagtag

SEQ ID NO: 60511 - DNA, 933 bp, Artificial Sequence
  Description of Artificial Sequence: Synthetic coding sequence
atgctggtggtggaagttgcaaatgggaggagcttggtctggggcgcagaggccgttcaggccctcagggagcgcttgggtgtcggtggtcgcacagtaggagcactccccagagggccacgccagaacagcaggttgggtctcccactgctgctcatgccagaagaggccaggttgctggccgagattggcgcagtgacgctagtttcagcgcctaggccagatagccgtcatcattcattagcgctgaccagctttaagcggcaacaggaggaaagcttccaggagcagtcagccttggccgctgaagcgagagaaactcgacgacaggagcttctggagaagatcaccgaaggccaggcggcaaagaagcagaaactagagcaggctagtggtgcttctagctcacaggaagcaggctcatcacaagccgcaaaggaagacgagaccagcgatgggcaggcgtccggggagcaggaagaagcgggacctagttctagtcaggcgggacccagcaatggggtggccccactgccgaggagcgccctacttgttcagctggcaacagccagaccgaggcctgtgaaggcaaggcccctggactggcgcgtccagagcaaggactggcctcacgcgggtcgccctgcgcacgaactcaggtacagtatctaccgcgatctgtgggagcggggattttttttatccgccgcagggaaatttgggggagatttccttgtgtatcctggcgaccccttacggttccatgcacactatatcgcacaatgctgggccccagaggataccattcccttgcaggatctcgtggctgctggccgtctgggaacatcagtgagaaaaacactcctactgtgttccccccagcctgacgggaaggtcgtctacacatccttgcagtgggcaagcctgcagtag

SEQ ID NO: 60512 - DNA, 933 bp, Artificial Sequence
  Description of Artificial Sequence: Synthetic coding sequence
atgctggtggtcgaggtggccaatggccgatccctggtatggggcgcagaggcggtgcaagccctgagagagagactgggggtgggcggacgcactgtaggcgctctaccccgtgggcctaggcaaaattccagactcggcctcccactcctgctgatgccagaagaggcaagactgctggccgagataggagctgtgacattggtgtccgccccaaggccggactcacggcaccactctctggcgttgacatccttcaagagacaacaggaggaatcttttcaggagcagtcggctctggcagcggaggctcgggagactcgtaggcaggagttgttggagaaaattaccgaaggtcaggctgccaagaagcagaaactggaacaggcttccggcgcatcttcctcccaagaggccggtagcagtcaggccgctaaggaagacgagactagcgatggtcaggcaagcggagagcaggaagaggcaggtcctagttcctcacaggctggccctagtaacggcgtggctccccttccgagatctgcgcttctggtgcagctggcaacagcacgtccacgtcctgtcaaagccagaccccttgactggagagttcagtcgaaggactggccgcacgcagggcgacccgctcatgagctccggtacagcatctaccgagacctgtgggagcgtgggttcttcctgagcgccgctggtaaatttggtggtgatttcttagtctaccctggcgacccactacgttttcacgcgcattatatcgcacagtgctgggctccagaagacacgatcccccttcaggacctggtggctgcagggaggctcggcacgtccgttcgcaagacattgctcctctgctccccccagcctgacggaaaggtcgtttataccagtttacaatgggcctccctgcagtag

SEQ ID NO: 60513 - DNA, 933 bp, Artificial Sequence
  Description of Artificial Sequence: Synthetic coding sequence
atgctggtcgtggaggttgcaaatggcaggtccttggtttggggcgcagaggccgtgcaggccttgcgggagcgattaggagttggcggacgcacagtgggcgctctgcctagggggcctcgccagaactccagacttggcttacctctcttattgatgcccgaggaggcccgactcctggccgaaattggagcagtgacacttgtgtccgctccaagaccagactccaggcaccacagtttggccctcacgtcttttaagagacagcaggaagagtcctttcaagaacagtccgcgttagccgctgaagcaagagagacccgaaggcaggagctcttggagaagattacagagggccaagccgctaaaaagcagaagcttgaacaagcgagcggtgccagttctagccaggaagcgggatcttcacaggcagcaaaggaggacgaaacgtccgacggccaggccagcggcgagcaggaggaagcaggcccaagctcaagtcaggcgggtcccagcaacggcgtagcaccgttgccaaggagcgccttgcttgtccagctggcaaccgcaagacctcgccctgtgaaggcgaggccattagattggcgggtgcagagcaaagactggccacatgccggtaggcctgcacacgaactgcgttattcgatttaccgcgacctgtgggaacgcggatttttccttagcgctgccggaaaatttgggggagacttcctcgtgtatccaggtgatcctctccgtttccacgcccactatatcgctcaatgctgggctccggaggacacaatccccctccaggacctggttgcggctggcagattgggaaccagcgtgcgaaaaaccctgctcctttgctcaccccagccagacggaaaagtggtctacacctctctgcagtgggccagcctgcaatag

SEQ ID NO: 60514 - DNA, 933 bp, Artificial Sequence
  Description of Artificial Sequence: Synthetic coding sequence
atgctcgtggttgaggtggccaatgggaggtccctcgtctggggagctgaggccgtgcaagcgttacgggagagactaggagttggcggtagaacagtcggagcactgcccagggggccaaggcaaaactctcgcctagggctacctctgctgctcatgcctgaagaagccaggcttctggccgagatcggcgctgtcaccctggtgagtgccccacggccagactcaaggcatcactcattggcccttacgagtttcaaaaggcagcaagaagagtcttttcaagaacagtccgctctggctgctgaagcacgggaaacaagacgacaggagctgctagagaaaattacggaaggccaggcagctaagaagcagaaacttgagcaagcctctggagccagcagctcccaggaagcgggaagttcccaagccgctaaggaggacgaaactagtgatggacaggcatccggcgagcaagaggaagcaggcccatcatcttctcaggccggaccatctaatggtgtggccccactcccaaggagcgctctgctggtccaactcgcgaccgcccgtcccaggccagtgaaagcccgacctcttgactggcgtgtccaatctaaagactggcctcacgctggccgtccagcccatgagctgcggtactcgatctaccgcgacctgtgggagaggggcttttttctgtccgccgcaggaaagtttggtggggatttcttagtgtaccccggtgatccactgagatttcacgcccattatatcgcacagtgctgggctccggaggatacaatccccctacaggacctcgtggctgctggtcgtctcggtacttccgtccggaagaccttgctgctgtgctctccccagcccgatggtaaggtcgtctacaccagccttcagtgggcttctctccaatag

SEQ ID NO: 60515 - DNA, 933 bp, Artificial Sequence
  Description of Artificial Sequence: Synthetic coding sequence
atgctggtggtcgaggttgcaaacggacgttctctggtgtggggtgctgaagcagtccaggcactccgggaacgtctaggagttgggggtaggactgttggtgcactgcccagaggaccaagacagaactcaagactcggcttgcccctcctgctgatgccagaggaggcccgactcctcgcagaaatcggagcggtaacacttgtgagcgcccctcggccagactctcggcaccactcattggccttgacaagttttaaacgccaacaggaggaatcctttcaggaacagtcggccctcgcagccgaggctcgggagacacggagacaggaactgctggaaaaaatcacagaaggccaagcggcaaaaaagcaaaaactcgagcaggccagtggggcttcaagttctcaagaggcgggaagttctcaggccgctaaagaggatgagacttccgatgggcaggcctctggtgagcaagaagaagccggacctagctcaagccaggcgggaccctctaatggcgtagctcctttacctcggtcggctctgctggtgcaactggccactgcaagacctagacctgtgaaagccagaccccttgattggcgggtgcagtcaaaggactggccccatgctggtcggcctgcccatgaacttaggtactcgatctacagggatttgtgggaacggggattttttctgtctgccgcaggcaagtttgggggtgattttctggtttaccccggagaccctctgcgtttccacgcccactacatcgcacagtgttgggccccagaggacacaattcccctacaggaccttgtggccgcaggacggctcggaaccagcgttagaaaaactcttcttctttgctcccctcaacctgatggtaaagttgtgtacacaagcctgcagtgggcgagcctgcaatag

SEQ ID NO: 60516 - DNA, 933 bp, Artificial Sequence
  Description of Artificial Sequence: Synthetic coding sequence
atgctggtcgtagaagtcgcgaacggaaggtcattagtgtggggagccgaggcggtccaggcactgagggagaggctcggtgtcggaggtagaaccgtcggtgctctgccccgtggtcctcggcagaatagccgcctgggcttgccacttttgctgatgccagaagaggccaggctgctggctgagattggcgctgtgaccttggtgtctgcaccccgacccgattcaaggcaccactctctggccttgacgtcctttaagaggcagcaagaggaatcttttcaggagcaaagtgctctggcagccgaagcacgcgagaccagacgccaagagctgttggaaaaaatcaccgagggtcaggccgctaagaagcagaagcttgagcaggcctcaggcgcaagtagcagccaagaagctgggagcagccaagccgctaaggaggacgaaacatctgatggacaggctagcggggaacaggaagaggcaggcccaagtagttctcaggctggaccctctaacggggtcgctccattacccagatccgctctgctagttcagctggcaaccgcaaggccgaggccagtgaaggctcggccactagattggcgtgtccaaagcaaggattggcctcacgctggaagaccagcacacgagcttcgctactctatttatagggatttgtgggaaagaggattcttcctgagcgccgctggaaagttcggaggggatttcctggtctatcccggagatcctctgagatttcacgctcactacatcgctcagtgctgggccccagaagacactattcctctgcaagacctggtcgcagctggcaggcttgggacttcggtcagaaaaaccctcctgctgtgttcaccacagcccgatgggaaggtggtttatacctcattgcagtgggcttctctgcagtag

SEQ ID NO: 60517 - DNA, 933 bp, Artificial Sequence
  Description of Artificial Sequence: Synthetic coding sequence
atgttggtagtggaagttgccaacggcaggagcctggtatggggagctgaagctgtgcaagcgttgcgggaaaggctaggtgttggcggtcggaccgtaggtgctttgcctcgtggtcccaggcagaattccagactggggctgcctcttctgctgatgccggaagaagcccgactccttgctgagattggagccgtaacccttgtctccgctcccagacccgattcacgacatcactccctcgccctgaccagctttaagagacagcaggaggagtccttccaggaacagagcgctttggccgctgaggccagagaaacacgtcgccaggagcttctggaaaaaattactgaaggccaagctgcaaaaaaacagaaactcgagcaagcttccggagccagctctagccaggaggccggtagcagccaggcggctaaagaagatgaaacttccgatggacaggctagcggggagcaggaagaggcaggcccaagtagtagccaggccggtccctccaacggcgtagctcccctgcccagaagtgctctgttggtgcaactggctacggctcggccacggcctgtgaaagcccgtcctctggactggcgtgtgcagtctaaggattggccacacgcaggccgacctgctcacgagttacgttatagcatttaccgggacctgtgggaaagaggttttttcttgtcggctgccggaaagtttgggggagattttctcgtgtatccaggcgaccccctccggttccacgcccactacatagcccagtgctgggctcccgaggacacgataccacttcaagacctcgttgccgctggcagactcgggactagcgtgcggaagacactcctgttatgtagccctcagcccgacggcaaggtagtatatacgtccctgcagtgggcctcactccagtag

SEQ ID NO: 60518 - DNA, 2199 bp, Artificial Sequence
  Description of Artificial Sequence: Synthetic coding sequence
atggatccttccgcggatacatgggatttattctccccgctcatctctctgtggattaaccggttttatatttatcttggctttgcggtgtcaatatctttatggatctgcgtgcagattgtgatcaagacccagggaaaaaatcttcaagaaaaatccgttcctaaggctgcccaggatctaatgactaatggctatgttagcttgcaagagaaagacattttcgtatctggtgttaaaattttctacggctctcaaactgggacagcaaaaggctttgcgacggtccttgccgaggctgtaacctcactggacctgcctgtcgccatcataaacctgaaagagtatgatcctgatgaccacctgatagaagaagtgacatcaaagaacgtctgtgtcttcctggtggctacatatacggacggtttgccgaccgaatcggccgagtggttctgtaagtggcttgaggaggccagcatagacttccggtttggcaagacgtatctcaaaggaatgcgatacgccgtgtttggacttgggaactcagcctatgcgtcacattttaataaagtaggtaaaaatgtggataaatggctgtggatgctgggtgctcaccgtgtgatgtcaagaggtgagggggattgtgacgttgttaagagtaagcatgggtccatcgaggccgatttccgagcatggaaaaccaaatttatcagtcagctccaagcactccagaagggcgagcggaaaaaaagttgtggcggtcactgtaaaaaaggaaaatgcgaatcacaccagcacggatctgaagagagagaagaaggctcacacgaacaggatgaacttcatcatagagacacggaggaggaggagccttttgagagcagcagcgaggaggagttcggtggagaggaccaccaatccctgaatagcattgtagatgtggaggacctaggaaaaattatggatcacgtgaagaaggagaagcgggagaaggaacaacaggaagaaaagtccgggctgtttagaaatatgggacggaatgaagatggtgagcggagagccatgattacacctgctctccgggaggcacttacaaagcagggctatcaactcatcggatctcattcaggggtcaaactctgtcggtggaccaagtctatgctaaggggaaggggaggttgctataagcacactttctatggcatagaaagccacaggtgcatggagactacgccctctttggcctgcgccaataaatgtgtcttttgctggcgtcatcatactaaccctgtcggcaccgagtggaggtggaagatggatcagcccgagatgatactgaaggaggctatcgaaaatcaccaaaatatgatcaaacagttcaagggggtgcctggcgtaaaggcagagcgctttgaggaagggatgaccgtgaagcactgcgctttatccctcgtaggcgagcccatcatgtaccctgaaatcaaccgctttctgaagcttcttcatcagtgcaaaatttcctccttccttgttaccaatgcacagttccctgctgagattcgcaacttggaacccgttacccagctgtacgtttctgtggacgctagcacgaaagattctctaaagaaaatcgaccgcccactgttcaaagatttctggcagaggtttttggacagcctgaaggccttggcagtgaaacagcagcgcaccgtgtatcgccttaccttggtcaaggcatggaatgtggatgaactgcaagcatacgcacagctggtgagcctaggtaaccccgactttatcgaggttaagggagtcacatattgtggggaatcatctgcgagctccctgacgatggctcacgtaccttggcacgaggaggtcgtgcagtttgtgcatgagctggtagaccttatcccggaatacgagattgcctgcgagcacgaacattccaattgccttttgatagcccaccgcaaattcaaaattgggggagagtggtggacctggattgattacaacaggtttcaagaactgatccaggaatatgaggactccggcggaagtaaaaccttctcagccaaggattacatggccaggacgccccattgggctcttttcggcgcaagtgagagagggtttgacccgaaggatacccggcatcagaggaagaacaagtctaaagctatttcagggtgttag

SEQ ID NO: 60519 - DNA, 1017 bp, Artificial Sequence
  Description of Artificial Sequence: Synthetic coding sequence
atggatccctctgccgacacatgggatctcttctcccccctaatatccctgtggataaacagattctacatttatttgggctttgctgtctctattagcctgtggatttgtgtgcaaatcgtgataaagactcagggtttcgccacggtcttagcagaggccgtgacatccttggatctgccggtcgcaatcatcaacctgaaagagtatgatcctgacgaccacttgatcgaggaagtaacaagcaaaaatgtctgcgttttcctggtggccacttatacagacgggctgcctaccgaaagtgctgagtggttctgcaagtggctggaagaagcctccatcgatttccggttcgggaagacctatctgaaagggatgagatacgcggtgtttggtctcggaaactcagcatatgcttctcatttcaataaggtgggaaagaacgttgacaagtggctttggatgctgggcgcacatcgggtgatgagtcgcggagagggggactgcgacgttgtgaaaagcaaacatggctcaatcgaggcggacttcagagcctggaagacgaagtttatttctcagctgcaagcacttcaaaaaggcgagaggaaaaaatcatgtggaggccactgcaaaaaaggaaagtgtgaatcacaccaacatggttcagaagagcgggaggaggggtcacacgaacaggatgaactccaccatagggacactgaggaagaggaaccttttgagtcaagtagcgaggaagaatttggcggtgaagaccaccagtcactgaattccatagtagatgtggaggacttagggaagatcatggaccacgtgaagaaggaaaaacgcgaaaaagagcaacaagaagagaaaagcggtctgttccggaatatgggcaggaacgaggatggcgaaagacgggcaatgatcacccctgcgctgcgggaagcccttacaaaacaagtgcacgcacccagggagcgaagactgctacagactcacatcctatggaattag

SEQ ID NO: 60520 - DNA, 531 bp, Artificial Sequence
  Description of Artificial Sequence: Synthetic coding sequence
atggacccatccgcggatacgtgggacctcttttcccctctcatttcattgtggatcaaccgtttctacatctatctgggcttcgctgtgagcatatccctctggatctgtgttcagattgtaattaagactcagggctttgccacagtgctcgcagaggctgtgaccagcttagatttgcctgttgccatcatcaacctgaaagaatacgatccagacgaccatctgatcgaagaggaggaagagccgttcgagtcctctagtgaggaagagtttggaggcgaagaccaccagtccctgaacagtattgtggacgtcgaagacctgggcaaaattatggaccacgtcaagaaggaaaagagggagaaggagcagcaggaggagaagagtgggctatttcgaaatatgggcagaaacgaagatggtgaaaggcgcgcaatgatcacaccagccctgcgggaggctctaacaaagcaggtgcacgccccacgcgaacggagattgctccaaacccacatcctgtggaattag

SEQ ID NO: 60521 - DNA, 780 bp, Artificial Sequence
  Description of Artificial Sequence: Synthetic coding sequence
atggataggagcgccgagttccgcaagtggaaagcacaatgtctgtctaaggccgacttgtcccgaaaagggagtgtcgacgaagacgtggtagagcttgtgcagttcctcaacatgcgggatcagttcttcacgacatccagttgcgccggtaggattctgttactggaccggggaataaatgggtttgaagttcagaaacagaattgttgctggctgctagttacacacaaactgtgcgtgaaggatgatgtgattgtggcacttaagaaagcaaacggagacgccactctgaaatttgagccttttgtcctgcatgtgcagtgtcgccaacttcaagatgctcagatcctgcattctatggcgatcgatagtggcttccgcaatagtggaattaccgtcggcaagcgcggaaagaccatgctagccgttagaagcacacacggcctagaggtccccctctcacacaagggcaagctcatggtgacggaagaatatattgactttctgctcaacgtggctaaccagaagatggaggagaataaaaagaggatcgagcgcttttacaactgtctacaacatgctctggagcgagagacaatgaccaatttgcatccgaagatcaaggagaaaaacaactcaagttacatacacaagaagaaacgcaatcctgagaagacccgcgcacaatgcatcactaaggagtcagatgaggaactggaaaacgatgacgacgatgacctcggcatcaatgtgactatctttcccgaggattattag

SEQ ID NO: 60522 - DNA, 528 bp, Artificial Sequence
  Description of Artificial Sequence: Synthetic coding sequence
atggacagaagcgctgagttcaggaagtggaaggctcagtgcctgtccaaagcggacctctcacgcaagggcagcgtggacgaagacgtggtggagcttgtacaattccttaacatgagagatcagttctttaccacatccagctgtgcaggcagaattctgctgttagacagagccgtgcgtagcacacatggcttagaggtgcctcttagtcacaaaggtaagctcatggtcaccgaagaatacattgactttttgctgaatgttgccaatcaaaaaatggaggaaaacaagaaaaggatcgaaagattttacaactgcctgcagcacgcgctggaaagggaaacaatgacaaacttacaccctaagattaaggagaaaaataacagcagctatatccacaagaaaaagaggaaccctgaaaagaccagggcccagtgtataacgaaggaatcggacgaggaactagagaacgatgacgacgacgatctgggcattaacgtgacaatcttcccggaggactactag

SEQ ID NO: 60523 - DNA, 681 bp, Artificial Sequence
  Description of Artificial Sequence: Synthetic coding sequence
atggatcgcagtgctgagttccgcaagtggaaggcgcagtgtctaagtaaagctgatctgtctaggaaaggctctgtcgatgaggatgtcgtggagttagtacaattcttgaatatgcgggaccaattctttacaactagctcatgtgctggcagaattcttctgctggatcggggaattaacggtttcgaggtgcaaaaacagaactgctgttggctcctcgtgacccacaagttgtgtgtgaaggacgacgtccactcaatggccatcgactccggcttccgaaattccgggattaccgtcggaaagcggggaaagaccatgctcgccgtgaggtcaactcacggcttagaagtgcccctctcccacaagggcaaactgatggtgacggaggagtacatcgattttctcctgaacgtggctaatcagaagatggaagagaacaaaaagcggattgagcgcttttataactgcttacagcatgccctggagagggaaacgatgactaaccttcacccaaaaattaaggaaaaaaacaactctagctacattcacaagaaaaagcgaaaccccgagaagacaagagcacaatgcatcacaaaggaaagcgatgaggaactcgaaaacgatgatgacgacgatttaggaattaatgttacaatttttcccgaagactactag

SEQ ID NO: 60524 - DNA, 948 bp, Artificial Sequence
  Description of Artificial Sequence: Synthetic coding sequence
atggcgggacagcacctgccagtgcctcgcttggagggcgtgtctcgggagcagttcatgcagcacttgtatccgcaaaggaaacctctagtactcgaaggaatagacctgggcccttgtaccagtaagtggaccgttgactacttatcccaagtaggagggaaaaaagaggtgaagatccatgtcgcggctgtcgctcagatggactttataagcaaaaacttcgtgtaccggacacttcctttcgaccagctagttcagcgcgcagctgaggagaagcataaggagtttttcgtttccgaagacgagaaatactatctacgatctctgggcgaggaccccagaaaggatgtggccgatattagaaaacagtttcccctgcttaagggagacatcaaatttccagaattttttaaagaggagcagttcttttcctccgtgtttagaatctctagtcccggtctccagctgtggacccactatgacgtgatggataatcttttgatccaggtcactggcaagaaaagggtggtgcttttctccccgagggacgcacagtacttatatcttaagggtactaagtccgaagtgctgaatattgacaatcccgatctcgccaaataccctttgttttctaaggccagaaggtacgagtgcagtctggaagccggagatgtactgtttatcccagcattgtggttccataatgtgatttcagaggaattcggggtcggagtaaacattttttggaagcatctgccatccgagtgctatgataagactgacacatatggaaataaagaccctaccgcggcttcccgcgcagcgcagattctggacagggctctgaaaacattggcggagctgccggaggagtatcgcgatttttatgctcggaggatggtattgcatatccaggataaggcgtactccaaaaactccgagtag

SEQ ID NO: 60525 - DNA, 825 bp, Artificial Sequence
  Description of Artificial Sequence: Synthetic coding sequence
atgcttaacctgctcctgctggcactgcctgtcctcgcctctagagcctatgccgctcccgctcctggacaggccttacagagggtcggcattgtgggtggccaggaggctccaagatctaagtggccttggcaggtgtcgcttagggtcagggatcgctactggatgcacttctgtggaggaagtctgattcacccccagtgggtgctgaccgccgcacactgtgtgggcccagacgtgaaagatttggccgcactgcgagtgcagcttcgggaacagcatctttattaccaggatcagctcctcccagtttcacggattattgtccacccacagttttacaccgctcagattggagccgacattgcattgctagagttagaggaacctgtgaacgtgtcatcccacgttcacaccgtcaccttaccccctgcatcagagacttttccgcctatgccttgttgggtgacaggttggggagacgtagataacgacgagaggctccctcctccctttccattgaagcaggtgaaagtaccaataatggagaaccacatttgcgacgctaaataccacctgggggcttatacaggcgatgatgtcagaatcgtcagagatgatatgctgtgtgcaggtaacactaggagagatagttgtcaaggcgatagtggcggtccgctggtctgcaaagtcaatggcacctggctgcaggctggcgtcgtgtcctggggtgaagggtgtgcgcagcccaaccgccctggcatctacacacgggtcacatattacctggattggatccaccactacgttcctaagaaaccgtag

SEQ ID NO: 60526 - DNA, 2271 bp, Artificial Sequence
  Description of Artificial Sequence: Synthetic coding sequence
atgtcaaagatgccggctaagaaaaaaagttgttttcagattacatcggtgactaccgcccaggttgcaacgtccatcactgaagacactgagtctctggacgacccagacgaatccagaaccgaagatgtatcatccgagattttcgacgtttcacgggctacagattacggcccagaggaggtgtgtgagcgatctagcagcgaggagacattaaacaatgttggggacgctgagacgccaggcacagtaagtcccaacctgctcctggacgggcagctggctgcggctgctgccgctcctgctaatgggggtggagtggtcagtgccagaagcgtgagcggcgcactagcgagtacactcgcagccgctgcaacgtcagccccagctcccggtgcccctgggggtccgcagctggccggtagtagcgccggtcccgtgaccgctgcacctagtcagccccctacaacttgttcttctcgttttagggtgatcaagctggaccacggatctggggagccttaccggcgtgggaggtggacatgtatggagtactatgaacgcgattccgattctagcgttttgacccggagcggtgactgtatccgccattcttccaccttcgatcagacagcagagcgggattccggcctgggcgcaacaggtggctccgtggtagtcgtagtggcgtccatgcagggagcccacggacccgaatcgggcactgactcctccctcacagccgtgagccagcttcctcccagcgaaaaaatgagccagcctacaccagcacagcctcagagcttcagcgtcgggcagccccaacctccccctccacccgtgggaggcgcagtggctcaatcctccgcgccattacctccattccctggtgccgctacggggccacagccgatgatggccgctgctcagccttctcaaccgcagggcgctggccctggcggacagacactgccccctactaatgtgacactagctcaacctgctatgtcactgccgcctcagccaggccctgctgtaggggctcccgctgcccagcaaccccaacaatttgcctacccccagccgcagatccccccagggcacctacttcctgtccaaccaagcggtcagtccgagtaccttcagcagcatgtggctggcctccagcctccctcacctgcccagccctccagcactggagccgctgcctctccagccaccgcagctacgctgccagttggcaccggacaaaacgccagctctgtgggtgcccaactcatgggagctagctcccagcctagcgaggccatggctcctagaactgggccagctcagggtggtcaggtcgcaccatgccagcctacaggcgtgcctccagctacagtgggcggagtggtgcagccatgtctcggtccggctggtgcagggcaaccacagtccgtgcccccaccacagatggggggatcaggtccactgagtgctgtgcccggagggcctcatgccgtcgtgcctggggtgcccaacgtgcctgctgcagttcccgcaccctccgtccctagcgtgtctacgacaagcgttactatgcctaatgtgcctgcaccactggctcaaagccagcagctgagcagtcataccccagtatcacggagttcaagtattatccaacacgtggggctgccattggccccaggcacacattcagcccctacctctcttccgcagtccgatctgagtcagttccagacccaaacccagcctctggtgggccaagtcgacgacactcgtcgaaaatccgagccactgccacagccacccctgagcctcattgctgaaaataagcctgtggtgaagccccctgtggccgattcactggcgaacccactccagttaaccccaatgaacagcttggcgacatctgtgtttagcattgctatcccagtggacggcgatgaggattcagctagtggcggaggggtcgtagccatcgataacaaaattgagcaggcaatggatctggtaaagagccacctcatgtatgccgtgcgagaggaggttgaggtcctcaaagaacaaattaaagaactcgtggaacgaaacagcctgctggaaagggagaatgcacttctaaaatcactgagtagcaacgatcagctgtctcagcttccaacccagcaagcaaatccgggttccacgtctcagcaacaggcagtgatcgcgcaacctcctcaaccgacccaaccgcctcagcagccaaatgtgtctagcgcatag

SEQ ID NO: 60527 - DNA, 2343 bp, Artificial Sequence
  Description of Artificial Sequence: Synthetic coding sequence
atgagcaagatgcccgctaagaagaaaagctgctttcagattacaagcgttactactgcccaggtggcaacctcaattactgaggatacagaaagcctggacgacccagatgagagtaggacagaagatgtctcttctgagatttttgacgtctcgcgggcaaccgactatggtcccgaggaagtatgtgaacggagttctagcgaggagaccctgaataacgtcggggacgctgagacgcccggaaccgtatctccaaacctgctgctcgatggacagttggcagcagcagctgccgcacccgcaaatgggggaggggtggtgagcgcaaggagtgtctctggtgctctcgccagcactctggctgccgcagccacatctgcccctgcccctggcgctcctggcggtcctcagctagccggatcctccgccggtcccgtcacggcggcacccagtcagcccccaacaacctgttcctctaggttcagggtcataaagctggatcatggctctggcgagccatacagacgaggccgttggacgtgcatggaatactacgagagggactccgactccagcgtcctgaccagaagcggagattgtatcaggcatagttctacatttgatcagaccgccgaaagagatagcggactaggcgcaaccgggggatccgttgtggtggtggttgcctccatgcaaggcgctcacggccctgagagcggtacagacagttctctaacagccgtaagtcagctgccgccttccgagaagatgagccagccaacaccggctcaaccgcagagttttagtgtcggccagccccagccacctcctccccctgtgggcggtgcagttgcgcaatcctccgcccctctgcccccttttcctggagccgcaaccggtccccagccaatgatggccgctgctcagccctcccagccccagggagccggacccggaggtcagacactgcctcccacaaatgtgaccctcgcacaacccgctatgtcccttcctccacaacccggaccagcagtgggagcccctgcggctcagcagccacaacagtttgcttacccacagcctcaaatacctcctggtcacctgctgcccgtacaaccatctggacagtccgaatacctgcagcagcatgtcgcgggtctccagccgcctagccctgcgcaaccaagcagtaccggggcagccgcttctcccgctacagctgctaccctgcccgtgggcaccggccagaacgcgagctcagtgggcgctcagcttatgggcgcatcgagccaaccctccgaggccatggctccgagaaccgggccagcacagggcggtcaggtcgcgccatgccagcccaccggggtaccccctgccacagtcggcggagtggtgcagccttgtctcggccctgccggagctggacagccgcagagtgttccaccccctcagatgggtggaagtggcccactgtccgccgtgccaggcggtccccacgccgtggtacccggagtccccaatgtccctgcggctgtcccagcaccaagcgtgccgagtgtaagtacgacatctgtaactatgccgaatgtgcccgctcctctcgcccagtcccagcagttatcatcccatactcctgtcagtcgatctagttcgatcatccagcatgtgggcctgcctttggccccagggacacacagtgcacctactagcctgccccagtctgatctttcacagttccagacgcagacacagcctctcgtgggccaagtggatgatactcggagaaagtccgagcccctgccacagccacccctgtcattgatcgccgagaataaacccgtagtcaagcctccagtggccgacagcctggcaaatccgttgcagctcacgcctatgaacagcctcgcgacgagtgtttttagcatcgcaatccccgtcgatggcgatgaagaccgcaatccatcaaccgctttttaccaggcctttcacttgaacactctgaaagagtcaaagtccctatgggacagcgctagcggcggaggcgtcgttgccattgacaataagatcgagcaggcgatggacctggtcaagtcccatctgatgtacgcggtgcgcgaggaggtcgaagttttgaaggaacaaattaaagaattggtcgagcgcaatagcctactagaacgggagaatgctctcctaaagagtctttctagtaacgaccagctgtcacagctgccgacacagcaggccaaccccggtagtacaagccagcagcaagctgtcatcgcccaaccgccacagcccacgcagcctccccagcagccaaacgtctctagcgcatag

SEQ ID NO: 60528 - DNA, 690 bp, Artificial Sequence
  Description of Artificial Sequence: Synthetic coding sequence
atgccaaacgttcccgctcctttagcccaaagtcaacagctttcgagccacacaccagttagtcggtctagctccatcattcaacacgtcggtctcccgctggctccaggcacacatagcgccccaacttctctgccacagagcgacttgagccagtttcaaacacagacgcagccgcttgttggacaagtagatgatacgagacgcaagagcgaacctctcccccagccaccgctttctttgatcgctgaaaataagcccgtcgtgaaacccccagtggctgattctttggcgaatcctctgcagctgacaccaatgaactccctggcaacaagcgttttctctatagcaatcccggtcgacggcgacgaggattctgcctctggagggggtgtggtggccatcgacaataaaattgaacaggcaatggacctggttaagagccacttaatgtacgcagtcagggaggaagttgaggttctgaaggagcagatcaaggaattggtggaaaggaactcgctcctagagcgtgagaatgcgctacttaagtccctgtcctcaaacgaccaattgtcacagctgcccacccaacaggccaaccccggttctacgtctcagcagcaggcagttatcgctcaaccaccacagcctacccagccgcctcagcagccgaatgtctcttcagcctag

SEQ ID NO: 60529 - DNA, 576 bp, Artificial Sequence
  Description of Artificial Sequence: Synthetic coding sequence
atggccggtgccgctgaagatgcacgggctttgtttagagctggcgtctgcgccgctctggaggcatggcccgcactccagatcgccgtggaaaatggattcgggggagtgcatagccaggaaaaggcaaagtggcttggaggggctgtggaggattattttatgcggaacgctgatctggagctcgacgaggtcgaagactttttgggcgaattgttaaccaatgaatttgacactgtagtggaggatggaagccttcctcaggtatctcagcagctccagaccatgttccaccactttcagaggggcgacggtgccgctctccgcgaaatggccagttgcatcacacagcggaagtgcaaagtcacagcaacagctctcaagacagcaagagagacagacgaagacgaagatgacgtcgattctgtggaggaaatggaagtcaccgctacgaatgatggggcagcaaccgatggcgtttgtccccagcctgagccctctgaccccgacgcacagacgatcaaggaagaggacattgtggaggacggctggacaattgtccggagaaaaaaatag

SEQ ID NO: 60530 - DNA, 801 bp, Artificial Sequence
  Description of Artificial Sequence: Synthetic coding sequence
atgatgaagaccctgtcatccgggaattgcacactgtcagttcccgctaagaactcctaccgcatggtcgtattgggggcaagcagggttggtaagtctagcattgtgagccggttcctaaacgggaggtttgaggatcagtacaccccaaccatcgaagatttccataggaaagtgtacaatatccgcggagacatgtaccagttagatattttggacacttcagggaatcaccctttccctgcgatgaggcgcctgtctatcctcacaggggatgtgtttattctagtcttcagcctggacaacagagagtcttttgacgaggtaaagaggctccagaaacaaatcttagaagtaaagtcctgccttaagaataagacaaaagaagcagccgagctgcctatggtaatttgcggaaataagaatgaccacggggaattatgtaggcaagtccccactacagaggctgaactgctcgtcagcggcgacgagaattgtgcatatttcgaagtgtctgcaaagaagaataccaatgtggacgagatgttctacgtgctcttctctatggccaaactgccccacgagatgtctcctgcgcttcataggaagatttccgtgcagtacggggatgcctttcaccctcgacccttttgcatgcgcagggtgaaagagatggatgcttatggaatggtgagtcccttcgctcggaggcctagcgtgaactcagacctgaagtacattaaagcgaaggtgctgcgggaaggccaagcccgtgagcgcgataagtgtactatccaatag

SEQ ID NO: 60531 - DNA, 636 bp, Artificial Sequence
  Description of Artificial Sequence: Synthetic coding sequence
atggaagctgagcgtgggcctgaacgtagacctgccgaacggtcatcaccgggacagacaccagaagagggagcccaggcacttgcagagttcgctgctctgcacggaccggctctgagagccagcggcgtgccagaaagatactgggggcgtttgctgcacaagcttgaacacgaggtgtttgatgccggtgaagtgtttgggatcatgcaagttgaggaggttgaagaggaagaggatgaggccgctcgtgaggtccgcaagcagcagccaaatcccggtaatgaactgtgctacaaagtaattgtaacgagagagtctggtctgcaggccgcacatcctaacagcatttttttgatcgatcacgcttggacctgtcgtgtcgaacacgcccgtcagcaattgcagcaagtccctgggctcctgcacaggatggcaaaccttatggggattgaatttcacggcgagctgccttctacagaagccgtggccttggtattggaagagatgtggaaattcaatcagacctaccgacatgtatgtagaagaccccatgcagaggtgggacaaaggccccgttggaaagccggtgatgccgcagcagatcctggcggtgaactccagcccaggctatag

SEQ ID NO: 60532 - DNA, 1380 bp, Artificial Sequence
  Description of Artificial Sequence: Synthetic coding sequence
atggaaccctccacttgcagaactatggaatcagaagaagattatgtcgaggaaaaggagtcggagaaatgcgtcaaggagggagtgactaatcctagtaattctagtcagcaagcattattaaaagccgactacaaagccctcaagaacggagttccatctccaatcatggccacaaagattcctaagaaggtgatcgcccctgtcgatactggggatctggaggccggtcggcgaaaaaggaggagaaaaagaaggagtcttgcgataaatttgaccaactgcaaatatgagagtgtcaggcgggcagcgcagatgtgcggactgaaggaagtgggagaagatgaagaatggactctatactggacggactgcgcagtcagcctggagagagtcatggacatgaaaaggtttcaaaagatcaaccatttcccaggcatgaccgaaatctgtaggaaagatcttctggctagaaacctgaatagaatgtataaactgtatccctcagaatataacatatttccgagaacatggtgtttgcccgcagactacggcgactttcagagctacggcagacagagaaaagctaggacttatatatgtaagcccgattccggttgtcagggaaggggcatatttattacccgtaacccaagggagattaaacccggagaacatatgatttgtcaacagtacataagcaagccactgctaatcgacgggtttaagtttgacatgagggtttatgtacttattacctcatgtgatccactgcgaattttcacatacgaggaaggtctggcacggtttgcaacaacaccatacatggagccaagtcacaacaacttggataatgtgtgcatgcatctgacaaattatgctattaacaagcacaatgagaatttcgtacgggacggggcagtgggtagtaaaaggaaacttagcactcttaatatttggttgcaggaacatagctacaacccaggtgagctgtggggagacattgaagatatcatcatcaagaccattatcagcgcacactctgtgctccgacataactatagaacttgcttccctcagtacctgaatggtggaacttgtgcgtgcttcgagattctgggctttgacattctgctggatcacaaattaaaaccctggcttctggaagtgaatcactcgccgagctttaccacagactcatgtcttgaccaggaggtcaaagacgctttgctgtgtgacgccatgactctagtaaatctgcgcggatgcgataagcggaaggtgatggaggaggacaaacgcagggtgaaggaacggctttttcaatgctatcgccaaccaagggagtcacggtgcgcccgatgcctggcgtgtgtgtag

SEQ ID NO: 60533 - DNA, 2448 bp, Artificial Sequence
  Description of Artificial Sequence: Synthetic coding sequence
atggaaccctcgacgtgcaggactatggagagcgaagaagattacgtggaagagaaggagagcgaaaaatgcgtgaaagaaggcgtcaccaatcctagcaactcttcacagcaagctctccttaaagccgattacaaagctttgaaaaatggggtgccatctccaatcatggccacaaagatcccaaaaaaagtgatagctcccgtggacacgggcgatctcgaagcgggtagacgcaagagacgacgcaagagaagaagtctcgctatcaacctaacaaattgcaagtacgaatccgtcagacgggctgcccaaatgtgtggactgaaagaggttggggaagatgaagagtggaccctgtactggacagattgcgcggtgtcgcttgagagggtcatggatatgaagagattccagaaaattaaccacttcccaggcatgaccgagatttgcagaaaggatctgttggcaaggaatctcaaccgaatgtacaagttatatccctcagaatacaacatttttcccagaacctggtgtctccccgctgactacggcgatttccaaagttacggccgtcaaaggaaggcgaggacctatatctgcaaacccgatagcggatgtcagggcaggggtatctttatcacaaggaaccccagagagattaaacctggggagcatatgatttgccaacagtacattagcaagccactgctgattgatggcttcaagttcgatatgagggtatacgtcctgattaccagctgtgatccactgcgtatttttacttatgaggagggtctggcgagatttgccacaaccccgtacatggagccatcccacaataatctggataatgtatgtatgcacctgacaaactatgcgatcaataaacataatgaaaacttcgtaagagacggggcagtaggatccaagcgaaagctgagcacactcaacatctggttgcaagaacatagctacaaccctggggagctatggggtgacatagaagatattattataaagactatcatcagcgctcactccgtcctgcgccataactacagaacttgtttccctcaataccttaatgggggtacatgcgcatgctttgagatactgggctttgatatcttactcgaccacaagctcaagccttggctgttagaagtcaaccatagtcccagttttacaactgacagttgcctcgatcaggaagttaaggacgcacttttatgcgacgccatgactttggttaacctgaggggctgcgacaagcgaaaagtgatggaggaagacaaaaggcgggtgaaagagcgcctttttcaatgctacagacagcccagggagagcagaaaagagaaaacagaatcttcccacgtggcgatgctcgatcaggagcgctacgaagattcccacctcgggaaatatcgccgaatctaccccggtcctgatactgaaaaatacgccaggttcttcaaacataatgggtcactgttccaggagaccgcggcttccaaagctcgcgaagagtgcgcaaggcagcaactagaggagatcagactcaagcaggagcaacaggaaacctctggaacgaagagacagaaggctagagatcagaaccagggcgaatcagctggagagaaaagtcggcctagggctggactgcagagcctgagtacccatctcgcgtacaggaatcgaaattgggagaaggagctactgccgggacaattggatactatgaggccgcaggaaattgtggaagaggaggaacttgaaagaatgaaggccttactccagcgcgaaaccttgataagatctctgggcatcgtagagcagctcacgcggctgcaacatcccggaccgcaaggccagaaaaaactgcacgagagccgggatagacttggctctcaggagctaaagtccatgagcttggttcttctggtgctgttgcggggtgccgcaacagagcaaggagccccacacttcctgcacccagtgctcccccacgagtctatccccaggatcttgggcgcactgcccagcatgaatgctgccatcccacacgtacctcgctatcatctccagccaaaaaattttaattggacaggcgagccagccgctattaacagttgctccctgtcaatgaaaaaggccggaaggtgctacttttcctccgccagaatccgccttacctcgcagggccaagcatctcgaaggttggaggccataaacagggtgctggccggtagtgttcccccaacactgacacctaagcaaggctacttccttcaacccgagcgggtcgccagcgattcctggaccgagtgtaccctgcctagcatggtgaactctgaacatagggccgctaaggtcccactctgccccgctagcgctcccatgctgcagagaagccgggctctcctcaacatcaatcagttccgttag

SEQ ID NO: 60534 - DNA, 1779 bp, Artificial Sequence
  Description of Artificial Sequence: Synthetic coding sequence
atgaggggaagagacctgtgttcctcgacccagtcgcaggcactcgggagtctccggacaacaacccccgctttcacactcaatataccatcggaggctaatcataccgaacaacctccagctggacttggcgctcgtttgcaagaggcgggtgtgtctattccccctaggcgaggcaggcccacaccaactctggaaaagaagaagaagccacacttgatggccgaggacgagcccagtggtgccctcctgaagcccctcgtgttcagagtggacgagaccaccccagcagttgtccagtccgtgctgctggagagagggtggaataaattcgataagcaggaacagaatgcagaggattggaatctgtactggaggacctccagtttcaggatgacagagcataattccgtgaagccatggcagcagctgaaccaccaccccggtacgaccaagttgacacgcaaggactgcctcgccaagcaccttaagcacatgcgcaggatgtatgggacatccttataccagttcatcccattgaccttcgtgatgccaaatgactacacaaaattcgtggccgaatattttcaggaacgccagatgctcggcaccaagcacagttattggatctgtaaaccagccgagctgagccggggacgcggaattctgatttttagtgatttcaaagactttatattcgacgatatgtacatcgtgcagaaatatatttctaatcccctgctgatcggacgctataagtgcgatctccggatctacgtgtgtgtcaccggctttaagcctctgacaatatacgtctatcaagagggactggtccggttcgccaccgagaagttcgatctttctaaccttcagaacaactatgcccatctgacaaatagttcaataaacaagtcaggggctagttatgaaaagataaaagaagtaattgggcacggctgcaaatggacattatcgcgattcttcagctacttacgctcctgggacgtggacgatctgctactgtggaaaaagatccacagaatggtgattctcacaatcctagcaatcgcgccaagcgtgccttttgctgctaattgtttcgaactatttggattcgatattttaatagatgacaatttaaaaccatggcttcttgaagtgaattactcaccagctttgacattagactgcagcacagacgtattagtcaagcggaagctggtgcacgatattattgaccttatctacctcaatggtttgcggaacgaggggagagaagcgtccaatgctacccacggcaactccaacatcgacgcggctaagagcgatcggggaggcctggacgccccagattgcctgccatatgactctctgagcttcaccagcagaatgtataacgaggacgatagtgttgtcgaaaaggctgttagtgtccgccctgaggccgcaccagccagccagctggaaggggaaatgagcggtcaggacttccatttgtcaacccgagagatgcctcagagcaagccaaaactgcgtagtcggcacactcctcataagacgcttatgccctatgccagcctgttccagagtcattcgtgtaaaaccaagactagcccctgtgtgctgtcggatcggggaaaagccccagaccctcaggctggaaacttcgtcttagtgttccccttcaatgaagccactctcggggcttccagaaatggtttaaacgtgaagcgcattatccaggagctacaaaagctcatgaacaagcagcacagctag

SEQ ID NO: 60535 - DNA, 1560 bp, Artificial Sequence
  Description of Artificial Sequence: Synthetic coding sequence
atggccgaggacgaacccagtggtgcgcttctgaaacctctcgtctttcgtgtggacgagacaactcctgcagtagtgcagagcgttctgctggagaggggttggaacaagttcgataagcaggaacagaatgcagaggattggaacctctactggcgaacctcatctttccgcatgactgagcataacagcgtaaagccttggcaacaactaaatcaccatcccggtaccaccaaattgacaagaaaggattgcttagcaaaacacctaaagcacatgcgtcggatgtacggtactagtctgtaccagtttatccccctaacatttgtgatgccaaatgattacacgaagttcgtcgccgaatacttccaagagagacagatgttaggcaccaagcattcttattggatttgcaagcccgcagaactgagccggggacgcggtatcctcatcttctctgattttaaggattttatttttgacgatatgtacatcgttcaaaaatacatttccaatcccctgctaattgggcgatacaaatgtgacctgcggatttacgtgtgcgtcacaggattcaagccattaactatttatgtgtatcaagagggcttggtgcggttcgccactgaaaaattcgatctcagcaacctgcagaataactacgcccacttgacaaattccagcatcaataaatccggggcatcctatgaaaagatcaaagaagtcatcggtcacggatgtaagtggacgttgagccggttttttagctacctgcggagttgggacgtcgatgacctgctcctttggaagaagatccacaggatggtgattctgaccattctggcaatcgccccttcggtgccattcgccgcaaattgttttgagctgttcggctttgacattttaatagatgacaatctgaaaccatggctgctagaagtgaattatagccccgctctgaccctggactgctcaactgacgtactggtgaaacgaaaacttgtccacgatatcatcgacctcatatatttgaacggcctgcgaaatgagggacgggaagctagcaatgcaactcatggaaactcaaacatagacgccgctaagtcagatcggggaggcctggatgcgcctgattgtctgccatatgattccttaagctttacatctcgtatgtacaacgaggatgactctgtggtcgagaaagcggtctctgtacgcccagaggccgcaccagcctcacagctggagggcgagatgagtggccaggattttcacttaagcactagggagatgccccaaagtaagccaaagctccgctccagacacactccccataagacactgatgccctacgcaagccttttccagtcacacagctgcaaaaccaagacctccccctgtgtacttagcgaccgaggaaaagcaccggaccctcaggctggaaatttcgtgctcgtattcccgtttaacgaggcaacattgggagccagcaggaatggcctgaacgtgaagcggataatccaggaattacagaagctgatgaacaagcagcacagttag

SEQ ID NO: 60536 - DNA, 2013 bp, Artificial Sequence
  Description of Artificial Sequence: Synthetic coding sequence
atgccctccctgccgcaggagggagtcattcagggtccatctcccctcgatttaaacaccgaactgccataccagagtactatgaagcggaaagtcagaaagaagaagaagaaggggaccatcactgctaacgttgcgggaactaagttcgaaatcgtcagattggtgatcgatgaaatgggcttcatgaagacaccggacgaggacgaaactagcaacttgatctggtgcgactccgcggtgcagcaggagaaaatcagcgagctgcagaactatcagcgtatcaatcatttccccggaatgggagagatctgtcggaaggattttctcgctcgcaatatgaccaaaatgatcaaaagcaggcctctcgactataccttcgtaccaaggacatggatttttcctgcagaatacacccagttccagaattatgttaaggagcttaaaaagaaacgaaagcagaaaacctttattgtcaagccagccaatggtgccatgggccacggcatctctctgatccgtaacggggataaactgcctagccaggaccatttgatagtgcaggagtacattgaaaaaccctttctgatggaggggtacaaatttgacctgcgcatttacatcctggttacatcttgtgatcccctgaagatattcctgtaccacgatgggttggttcgcatgggcaccgagaagtacatcccccctaatgaaagtaatttaacgcagctctatatgcatcttaccaattattccgtgaacaagcacaacgagcatttcgagcgggatgagaccgagaataaaggttccaaaaggtcgatcaaatggtttactgagtttctccaggctaaccagcacgatgtagctaagttttggtcagatatcagcgagttggtcgttaagacactgattgtggccgaaccacatgtgctccatgcatacaggatgtgtagacccggtcagccgcctgggagtgaatctgtatgctttgaggtgctgggattcgatattctcctggatcggaagttgaagccgtggctactggaaattaatcgtgccccaagttttggcaccgaccaaaagattgactatgatgttaaacgcggagtgcttctcaatgctctgaaactgctcaatattcgcacctcagacaagagacgcaacctcgctaagcagaaggctgaggcgcagcgcaggctgtacggccaaaatagcatcaaacgccttctgcctggtagctccgactgggagcagcagagacaccagctggaacggaggaaagaggaactgaaggagcgactggcccaggtacggaaacagattagcagagaagaacacgaaaatcgccatatggggaactatcggcgtatttatccccctgaggataaagctctccttgagaaatacgaaaatctgctggcagttgcttttcagaccttcttgtctggcagagcggcatccttccagcgcgaactgaataaccccctgaagaggatgaaagaggaggatatactggatctgctggagcaatgcgagatcgatgacgaaaaactgatgggaaagactacaaaaactcggggaccaaaacccctgtgttcgatgcccgagtccaccgagattatgaagcgaccaaaatactgcagctcagatagtagttacgactcttcgtcatcaagttccgagtccgatgagaacgagaaggaggagtaccagaataagaaacgggaaaaacaggtcacatacaatctcaagcctagcaaccattataaactgatacaacagccctcttcaatcagacgcagtgtcagttgcccacgtagtatttcggctcaatccccttcaagcggcgataccaggccttttagcgcccagcagatgattagcgtctctaggccaacgtctgcctccagaagtcactcacttaatcgcgcttcctcttatatgcgtcacctcccccactccaatgacgcctgttccactaactcccaggtggtggccataattagacagtag

SEQ ID NO: 60537 - DNA, 1710 bp, Artificial Sequence
  Description of Artificial Sequence: Synthetic coding sequence
ctgggtcaacggcagctgttccaggccctccgcgttgaacacagaagtccagagccttggttgccccgtgcagttggcggtcggagacgggcacccgaccatcaatgtcgcctgccatctaggggcggacggcctaggggtagctgtgaggcaagagagcaccttggcgatagactccagcgaggaagggaggatcctggttgggcctttctgacccgcgaactggtggtaaaaaccttgattgttgccgagccacacgtgctccacgcctaccgaatgtgtaggccagggcagcctcccggtagtgagtccgtttgcttcgaagtgttgggcttcgatatactgttggacaggaaacttaaaccttggctgctggagatcaatcgtgcccctagtttcggtactgatcagaaaatcgactatgacgtgaaacgcggagtgctgctcaacgctctgaagcttcttaatatccggacatctgacaagcggagaaacctggcgaagcagaaagctgaagcacagcgcaggctgtacggacagaactcaattaagcggcttctgcccggtagttctgattgggagcagcagagacaccagctggagcgcagaaaagaggaactgaaggagaggctggcccaggtgcgcaagcagatcagtagggaggagcacgagaaccggcatatgggtaattacagacggatttaccctcccgaggacaaggccttactggagaagtacgaaaatttgctagcggtggcatttcagacatttttgtctggtcgcgctgcctcattccagagagagctgaataacccactgaagaggatgaaagaggaagacattcttgacctactggagcagtgtgaaattgacgacgagaagctgatgggaaagaccactaagacacgtggcccaaaaccactctgttccatgcccgagtctaccgagatcatgaagaggcccaagtactgttcaagtgacagtagctacgacagcagttcgtcctccagcgagagcgacgagaacgagaaggaagagtaccagaacaaaaaaagggagaaacaagtgacgtataacctcaaaccatctaaccactacaagctcatccagcagcctagctctatacggaggagtgtgagctgtcctcgctccattagcgctcaaagcccttctagcggcgatactagaccgttcagcgctcagcagatgattagtgtctccaggcccacctcagcaagccggagtcactctttgaatagggccagctcttacatgcgtcaccttccccactctaatgatgcttgttctactaacagtcaggtgagcgagtctttgcgacaactcaagaccaaggagcaggaggacgacctgacgagtcaaacactatttgttctcaaggatatgaagatccggttcccagggaaatctgacgcagaatctgaattgttgatcgaggacatcatcgacaactggaaataccataagaccaaggtggcatcctactggcttataaagctcgatagtgtgaaacaacgcaaggtgctggacatcgttaaaaccagcatcaggacagtgttgcccaggatttggaaggtgcccgacgtggaagaagtcaacctttaccgcatatttaatagagttttcaaccgcttactatggtcccggggtcaggggctttggaattgtttttgcgattccggatacctgtag

SEQ ID NO: 60538 - DNA, 1101 bp, Artificial Sequence
  Description of Artificial Sequence: Synthetic coding sequence
atgtcctggaatattagccaccctcagctatctgacaagctattcgggaagaatggtgtgctggaggagcaaaaatcccccggtttcaaaaagagagagacggaggtctatgttggcaatttaccactggacatcagtaaagaggagatcctgtatctgctcaaggactttaatcctctggacgtccacaaaattcagaatggatgcaagtgttttgcattcgtcgacctgggcagcatgcaaaaagtaacgcttgccattcaggaactcaacggcaaattgtttcataagcggaagctgttcgtcaatactagcaaaagacctccgaagcggacaccggacatgatccagcagccgagagcgcctctggtccttgaaaaggcctccggcgagggtttcggtaaaacagccgcaatcattcagttggcacctaaagcacccgtagatctttgtgagaccgagaagctgagagcagcctttttcgccgtccccctggaaatgcgaggctcattcttggtcctccttctgagggagtgcttccgggatctgagttggttggcgctgattcattctgtccgcggagaggccggattgctggtgacaagtatcgtgcctaagacgcccttcttttgggccatgcacgtgaccgaggcacttcaccaaaacatgcaagcgctgttctcaacgctggctcaggctgaagaacagcagccttatcttgaaggctctacggtgatgaggggaactcggtgtctcgcagaataccatttaggcgattatggtcatgcctggaatcgatgctgggtattggatcgtgtggatacgtgggcagtggtgatgtttattgactttgggcagctggcaaccatccccgtccaatcactgagatccctagatagcgatgatttttggacaataccccctctgacgcagccctttatgctggaaaaggatattttgtcatcctatgaagttgtgcaccggattttgaaaggtaaaattactggggctttgaattcagcggtgaccgcaccggcatctaacctcgccgtagtcccccctctgttacctctgggttgtttgcagcaagctgctgcctag

SEQ ID NO: 60539 - DNA, 1056 bp, Artificial Sequence
  Description of Artificial Sequence: Synthetic coding sequence
atgtcgtggaacatttcccatccacagctcagcgataaacttttcggcaaaaatggcgtccttgaggagcagaagagtccgggatttaagaagcgggagacagaagtatacgtcggcaacctgccactggacatatccaaggaggagatcctctacctactgaaagacttcaatccactggatgtgcacaaaattcagaacgggtgcaaatgcttcgctttcgttgaccttggtagcatgcagaaggtgacacttgcgatacaagaactcaacggaaagctgtttcacaagaggaagctgtttgtcaacacatccaaacgccctcccaagaggacaccagatatgatccagcaaccccgagctccgctggtactcgaaaaggcttcaggcgaaggttttggcaaaaccgccgcaatcatccaattggcaccaaaggcacccgtcgacctctgtgagaccgagaagcttcgggctgcattcttcgccgtgccgctggagatgagaggcagttttctggttctgctgttgcgagaatgctttcgtgacttaagctggcttgcgctgattcattcagtcaggggggaagctggcttgctagtgaccagcatagtgccgaagacccctttcttttgggctatgcatgtaacagaagccctccaccagaatatgcaggctctgttctcaaccctggcacaagccgaggaacagcaaccatacttagagggaagtactgtcatgaggggcacacgctgcctcgccgaataccacctgggagattacggacacgcctggaaccgctgctgggttctcgatagggtcgatacttgggcagtggtgatgttcattgattttggtcagctagctacgattccagtacagtcactgcgaagcctagattccgacgacttctggacaattccacccctgactcagccatttatgttggagaaggacattctgtcaagctacgaggtcgtgcatcgcattctgaagggaaagatcacgggcgcactcaactccgctctgcacatcctgaagtttgaagagtccaaatag

SEQ ID NO: 60540 - DNA, 1188 bp, Artificial Sequence
  Description of Artificial Sequence: Synthetic coding sequence
atgctgcagttgcttgtgctcaagattgaagatcccggttgtttttgggtgattatcaaagggtgttcaccattcctcgaccatgacgtagactatcaaaagcttaattcggccatgaacgatttctacaactccacctgccaggacatcgagatcaaacctcttacactcgaggaggggcaggtgtgtgtcgtgtattgcgaggagttgaagtgctggtgtagagcaattgtaaagtctattacatcttcggctgatcagtatctagcggagtgcttcttggtcgacttcgctaagaacatcccagtgaagtccaaaaatattagggttgttgtagagagtttcatgcagctgccctacagggctaaaaaattctctctttactgtacaaagcccgtaactctgcacatcgacttttgcagggacagtaccgatattgtgcccgctaaaaaatgggacaatgccgctatacagtattttcagaaccttctgaaggccacaacacaagtggaggccaggctatgcgcagttgaggaggatacgttcgaagtgtatctctacgttacaattaaggacgagaaagtgtgtgtgaatgacgacctcgttgccaaaaactatgcgtgctacatgagccctacaaagaacaagaatttggactatctggaaaaaccgaggttaaacattaaatccgcccctagtttcaataagttaaacccggctctaacactgtggccaatgtttctccagggtaaagacgtgcagggaatggaggattcccacggtgtgaattttcctgcccagagtttacagcacacttggtgcaaaggaatcgttggggatttgcgcccaactgctacggcacaggacaaggccgtgaaatgcaatatggacagcctgcgggactctcccaaggacaaatcagagaagaagcatcattgcatctcactgaaggatactaacaaaagggtggaaagttccgtctactggccggcaaaaaggggcatcacaatctatgctgatcctgatgttccagaggcgtccgccttgtcccagaaatccaacgaaaaacctctgcggcttacagagaagaaagaatacgacgagaaaaactcttgtgtgaaactgctgcaattcctgaatcctgatcctctgagggcagatggcattagtgatttgcagcagacctag

SEQ ID NO: 60541 - DNA, 3534 bp, Artificial Sequence
  Description of Artificial Sequence: Synthetic coding sequence
atgctccagctgctggtactgaagatcgaagatcctggctgcttttgggtaattatcaaggggtgctctcctttcctcgaccacgatgtagactatcaaaagctgaatagcgccatgaatgatttttataactctacgtgccaagacattgagatcaagccactcacgcttgaggaggggcaggtgtgcgtggtgtactgtgaggaacttaaatgttggtgtcgagcaatcgtcaaatcaataacatcttccgcggatcagtacctggccgagtgtttcctagttgactttgcgaaaaacatccccgtgaaatccaagaacattcgagtggtggtggagtcctttatgcagctcccctacagagctaagaaatttagtttgtactgcacaaaacccgtgaccctgcacatcgatttttgccgagatagcactgatatcgtgcctgcaaaaaagtgggacaacgccgctatccagtattttcaaaatctgttgaaggcaactacccaagtggaagcccgactgtgcgcggtcgaagaggacacattcgaggtctacctgtatgtcaccattaaggatgaaaaagtgtgcgtgaatgacgacttggtggcaaaaaactatgcttgctacatgagcccaacgaaaaataaaaacctagactatctggagaaaccaagacttaacataaagtctgcgccttcctttaataaactcaatcctgcactgacgctctggcccatgtttctccagggtaaagacgttcaaggcatggaggatagtcatggcgtgaactttcctgcccagtcgttacagcatacctggtgcaaagggatcgtcggcgatctgcggcctacagccactgcccaggacaaggcagtgaaatgcaacatggactccctccgagactctcccaaggacaagagcgaaaagaaacatcattgcatctccttgaaggacactaacaagcgggtcgagtcttccgtgtactggccagctaaaagggggatcactatttatgctgacccggatgtcccagaagcttctgcgctctcacaaaaatctaacgagaagccgctcaggctgactgaaaaaaaggagtacgatgaaaaaaattcctgcgtgaagctcctacagtttctgaacccagatccacttcgcgctgatggaatttccgacctgcagcagttacaaaagctgaaaggcttgcaacctccagttgttgtgctgagaaataagataaagccatgtctgactatcgatagttcaccactgtccgcagacctaaaaaaagctctgcaacgaaataaatttccaggcccttcacacacagagtcatacagctggcctcccatagcacgcggatgcgatgtggtcgtgatttctcattgtgagagcaatcccctgctttatctactgcccgtcctcaccgtgctgcagactggcgcatgctacaaatcacttccctcgaggaacggtcctctcgccgtaatcgtgtgtcccggatggaagaaagcccaattcatctttgaactcctgggagaatactccatgtcctcaaggccactgcaccccgtgcttctgactattggcctccacaaggaggaggcaaagaacactaaattacctcggggatgcgacgttatagtgacaaccccttactctctgttaaggctcctggcgtgccaatcgctgcttttcctgagactgtgccacttaatactggatgaggtggaggtcttgtttctcgaggcgaacgaacagatgtttgccatactggacaattttaaaaaaaacatcgaggtagaggagcgggagtcggctccgcaccagatagttgcggtcggagtccactggaataaacacatcgaacacttgataaaagagtttatgaatgatccctacatcgtcatcacagccatggaagaagcagccctctacggaaatgtgcagcaggtggtgcatctgtgtctcgaatgtgagaagacctcctctctgctgcaagctttggatttcattccatcccaggcccagaaaacgcttatttttacttgctctgtggccgagactgaaatcgtgtgcaaggttgtggaatcaagttcgatattctgtcttaaaatgcacaaggaaatgatcttcaacttgcagaatgtactggagcagtggaagaaaaagctcagcagtggatcccagatcatcctggctctaacagacgattgtgtacccttactggccatcaccgatgctacatgcgttattcatttcagttttcccgcatccccaaaggtgtttggaggcagactatattgtatgtctgaccactttcatgctgaacagggatcaccagcagagcagggggacaaaaaagccaagtctgtgttactccttaccgagaaggatgcttctcatgcagtcggggtgctgagatatctggagcgggcagacgcgaaggtgccggctgagctgtacgaattcactgctggggtcctggaagctaaggaagacaaaaaagcgggtagaccactctgtccatacttaaaagccttcggcttttgcaaggacaagcgcatttgcccagacagacaccgcattaatccagaaacagacctgcctcgcaagcttagcagccaggctctaccctcttttgggtacatcaagattatccctttctatatactgaatgcaacaaactactttggcaggattgtagacaagcacatggacctgtatgctacgctaaacgcagaaatgaatgagtatttcaaggattccaataagaccactgttgagaaagtggagaagttcggcctctatggcttggccgagaagacactgttccaccgagtacaggtcctagaggttaaccaaaaagaggacgcttgggccctagatgatatcctcgtcgaatttattgacgaaggaaggaccggactggtcactagggatcagctcctccaccttcctgaacactttcacaccctccccccacaggcggtcgagttcatcgtctgccgagtgaagcccgctgacaacgagattgaatggaaccccaaggtcacgaggtatatccaccacaaaatcgtgggaaagcttcatgacgccaaggtcatactggcactcggcaacaccgtttggattgatcccatggtccacatcacgaatctgtcctcgctgaagacctccgtgattgactataacgttagggcagaaatcctcagcatgggcatggggattgacaatcctgaacacatcgagcagctgaagaaactgcgagaggacgcgaaaatacccgcttgtgaggagtcccttagtcaaacacccccacgggtgactggcaccagtcctgcccaagatcaggatcaccccagcgaagaacagggcggacagggaacaccacctgccgaagacgctgcatgcctccagtctccccagcctgaggatactggcgctgaaggcggagctgagtccaagaccagtagtgagaaccaaaaacctggcggatatctcgtattcaaacggtggctgtcttctaatcgatag

SEQ ID NO: 60542 - DNA, 561 bp, Artificial Sequence
  Description of Artificial Sequence: Synthetic coding sequence
atggacacgttcagtacaaagagcctggccctgcaggcgcagaagaagctcctgtccaagatggctagcaaggccgtggtggccgtgctggttgacgacaccagttcagaggttttagatgaactgtaccgcgctactcgtgagtttacccggtctagaaaagaggctcaaaagatgctcaagaacctagtgaaagtcgctctgaagctcggcctacttctgcgaggggaccagttgggaggtgaggaactagccttgttacgacgcttccgacaccgagcccgttgtctcgcgatgacagctgtgtccttccatcaagtggacttcacctttgatcggagagtcctggcagcaggtcttcttgagtgccgggacttgcttcatcaggcagttgggcctcatctgactgccaaatctcacggcaggatcaatcacgtgtttggacatcttgccgattgcgactttctggctgccttatatggtcccgcagaaccctacaggtcacacttgcggcgtatctgtgagggtttgggcagaatgctggatgagggatctctatag

SEQ ID NO: 60543 - DNA, 561 bp, Artificial Sequence
  Description of Artificial Sequence: Synthetic coding sequence
atggacaccttttccactaagtctcttgctttgcaggcccagaaaaagctgctgtctaagatggcctcaaaggccgtggtggcagtgctagttgatgatactagttcagaggtgctggatgagttgtatagagcaacacgtgaattcaccaggagtcgcaaggaagcccagaaaatgcttaaaaatctggtgaaggttgccctgaagctgggtttactcctgcgtggggatcaactgggaggcgaagagctggcactcctccgcaggtttcgccaccgcgcaaggtgtctcgcaatgaccgccgtcagtttccaccaggtggattttacttttgaccgtcgagtgttggccgctggcttactcgagtgtagagatctgttacaccaggcagtgggccctcacctcacggctaagagtcacggacgcatcaaccacgtctttgggcacttggcagactgtgatttcctggccgctctttacggccctgccgagccgtaccgaagccacctgcgcaggatttgcgagggtctcgggcgaatgttggatgagggatctctttag

SEQ ID NO: 60544 - DNA, 879 bp, Artificial Sequence
  Description of Artificial Sequence: Synthetic coding sequence
atggggaagccacgccagaacccctctacgctggtgtccaccttatgcgaggccgagcctaagggcaagctatgggtgaatggctacgctgggacccaaggtacgagggatgctactctgcaaacacgactgattcccctctcgtttcatctgcagaggggcaaaggcctggccgcaccactctcagccttatctgctcctcgcctaccagaacgcccagcagatggccgtgttgcagtagacgcccagcctgctgcccgatctatggatagcgattccggagagcagagtgagggtgaacctgttaccgctgccggtccagatgtttttagcagtaagagcctggccctacaagcccagaagaagattctgtccaagatcgcaagcaagaccgtagccaatatgctgattgatgacacatcctccgagatcttcgacgagctgtacaaggtgacaaaggaacacactcataataagaaagaggcccataaaattatgaaagatctgataaaggttgctatcaagattggaattctgtatcggaacaaccaatttagccaagaggagctcgtgatcgtggagaaatttaggaagaagctgaatcaaacagccatgacgatcgtcagtttctatgaagttgaatatactttcgatcggaatgtcctgtctaacctgctgcacgagtgcaaagacctggtgcatgaacttgtccagagacacctcacaccacggacacacggcagaatcaaccatgttttcaatcatttcgccgacgtggagttcctgtccactctgtactctttggatggcgattgtcggcctaacttgaaaagaatatgcgagggcatcaataagcttctggatgaaaaggtcctgtag

SEQ ID NO: 60545 - DNA, 411 bp, Artificial Sequence
  Description of Artificial Sequence: Synthetic coding sequence
atgcctcacgccaggaccgaaacgtcagtagggacctacgagtcgcacagtaccagtgagcttgaggacttaaccgagccggagcagcgcgaactcaaaaccaagctgactaagctggaggctgagattgtgaccctgcggcacgtgctcgccgctaaggagaggcggtgcggggagctcaagaggaagcttgggcttactgctcttgtcggactgcgtcagaacctgagcaagagctggctggacgtgcaggttagcaacacttatgtaaagcaaaaaacctccgcagccctcagtacaatgggaaccctgatttgccgaaagttaggaggtgtgaaaaagtcagcaacattcaggtcattcgaaggattgatcttcaataaatatactctgaaccaggggaggaattag

SEQ ID NO: 60546 - DNA, 423 bp, Artificial Sequence
  Description of Artificial Sequence: Synthetic coding sequence
atgccccacgctagaaccgaaacgtcagtggggacttatgaatctcactctaccagcgaactggaggatctcactgaacctgagcagcgcgagctgaagaccaagttgactaaactcgaggctgagattgtgactcttcgccacgtgttggccgctaaagagcggaggtgcggggaactgaaacgcaagttgggactgactgcactggtcggcctgcgacagaacctgagtaaaagctggctggatgtccaggtgtcaaatacatatgtgaaacagaaaacctctgcggcactcagtacaatgggtaccttgatttgccggaagctcggcggtgtgaagaaatctgccaccttccggtctttcgagggtctgatggggaccataaagtccaaagtatcgggtggcaaacgtgcctggccctag

SEQ ID NO: 60547 - DNA, 399 bp, Artificial Sequence
  Description of Artificial Sequence: Synthetic coding sequence
atgccacacgctagaacagaaacttccgtgggcacttatgaaagtcattccacatccgagcttgaggatcttaccgagcctgaacagcgagagcttaagacaaaactgactaaactggaggccgaaatagtgacgctgcgccacgtgctagccgctaaggagaggagatgcggcgaacttaagagaaagttgggactgactgctctcgtgggactccggcagaacttgtcgaaaagctggttggatgttcaggtgagtaatacatatgttaaacagaagacgtccgccgctctcagcaccatgggcacgctgatttgccgtaaactcggcggagtgaagaaatctgccacatttcgatcattcgaaggaaaccctaagggcgaaggcagccggatctag

SEQ ID NO: 60548 - DNA, 999 bp, Artificial Sequence
  Description of Artificial Sequence: Synthetic coding sequence
atgttagcagtgcacttcgataagcctggcggtccagagaatctatatgtgaaggaagtggccaagccctctccaggggaaggtgaagttctgctcaaagtcgctgcaagtgccctgaatcgggctgacctgatgcagaggcagggacagtacgacccccctcctggggcttcgaacattctagggctcgaagcctcaggacatgtggccgaactgggtccaggatgccagggtcactggaagattggggacacagccatggccctcctccccggaggcggtcaggcacagtacgtgacggttcctgaaggcctcttgatgccaatccccgagggactaaccctgactcaggccgctgccatcccagaggcctggctcacagcctttcagctcctgcacttagtgggcaacgtgcaggccggtgattacgtattgatccatgcgggtctctccggtgtaggaacagcagctatacagttaacacgcatggcaggggcaatcccactcgttacagccggatctcagaagaagctgcagatggccgaaaagttgggggctgccgctggctttaattataagaaagaggattttagcgaggcaactttgaagttcaccaaaggtgctggcgtgaacctgatcctggactgtatcggagggagttactgggagaagaacgtgaactgtctggcattagacggacgctgggtgctctacgggcttatgggcggtggggatatcaacgggccattgttcagtaagcttctgtttaagaggggcagtctgataacgagcctcttgaggtcacgtgacaataaatacaagcagatgcttgtcaatgcttttactgagcaaattctgccacacttcagtaccgaaggcccacaacgtctcctcccagtgctcgaccggatctaccccgttaccgaaattcaggaggcacataagtatatggaggctaacaaaaacattggcaagatagtactggaacttccccaatag

SEQ ID NO: 60549 - DNA, 747 bp, Artificial Sequence
  Description of Artificial Sequence: Synthetic coding sequence
atgctggctgtgcatttcgacaagccaggaggccctgagaatctgtacgtcaaggaagtggcaaagccctcgcccggagagggcgaagtactcctcaaggtggccgcttctgccttaaatcgcgcagacctgatgcagagacaggggcagtatgatcctccgcctggggcatctaatatcctcggtctggaagcctccgggcatgttgcagaactgggtcccggatgccaggggcactggaagatcggtgacacagcaatggctttgctgcccggaggcggtcaagctcagtacgtcacggtccctgaaggcctcctgatgcccattccggagggactgaccctgacccaggctgccgcaatcccagaggcatggcttactgccttccagctgctgcatctagtgggtaatgtgcaagcgggagattacgtgctgatccatgcaggactgtccggcgtgggaaccgccgcaatacagctgacacggatggccggtgcaattccactcgttaccgctggctcccagaaaaaattgcagatggcagaaaaactaggtgcagctgctgggttcaattacaagaaggaggatttctctgaggccaccctgaagtttacgaaagtgcaggcaaatgctggggagtgtttccacggggcaaacagcgcaagccttctccacggaggaccccctacgtctgcagctggctcaggccagaatctcccctctgatagaaatccagggggtccttag

SEQ ID NO: 60550 - DNA, 999 bp, Artificial Sequence
  Description of Artificial Sequence: Synthetic coding sequence
atgttagccgtccactttgataagcctggcggtcccgaaaatctgtacgttaaagaagtggccaagcccagcccaggtgaaggtgaggttcttctgaaagtggctgccagtgcccttaaccgcgcagatctgatgcagcgccagggccagtacgatccacctccaggggctagcaatattttggggctcgaggccagcggccacgttgctgagctgggtccgggttgccagggtcactggaagattggcgacactgccatggcattactgcctggtggaggccaagctcagtatgtaacggttccggaaggattgctaatgcccattcctgagggtctgacactgacacaagccgctgctatcccagaagcatggctgacggcttttcagttactgcatcttgtcggcaatgtgcaggctggggactatgttcttatccacgccggtttgagcggtgttggcaccgcagctatccagcttacccgaatggcaggtgcgatccccctggttaccgcaggttctcagaagaagttacagatggccgagaagctcggggctgctgccggattcaattacaagaaagaggacttcagcgaagcgaccttaaagttcactaaaggagcgggtgtgaatttgatcctggactgcattggcggatcctactgggagaaaaacgtgaactgtctggctctggacggccgttgggtgctatatgggctcatgggaggcggagatattaatggccctttattctcaaagctcctattcaagcgcggaagtctgattaccagtctgctgcgaagccgggacaacaaatataagcagatgcttgtcaatgcctttactgaacagatcctgccccatttcagcaccgaaggccctcagaggctgctaccggtgctggacaggatatacccagtgactgagatacaggaagcccacaaatacatggaggctaacaagaatattggtaaaatagttcttgagctaccccaatag

SEQ ID NO: 60551 - DNA, 651 bp, Artificial Sequence
  Description of Artificial Sequence: Synthetic coding sequence
ttcgacaagcctggaggacccgaaaacctgtatgttaaggaagtcgcgaagccgtcacccggtgagggcgaggtgctgctgaaggtcgcggcatctgccctgaatcgagcagacctgatgcagcgccaggggcagtacgaccctcctccaggggcaagcaatatcttgggactcgaggcctctggccacgtcgcagagctaggtcccggttgtcagggacactggaagatcggggacacagccatggccctcctccctggcggaggccaagcacagtacgtcactgtgcccgaaggactgctgatgcccatccccgaaggcctgaccctcacacaggctgccgctatacctgaagcctggctaacggcattccagctcctacacctcgtgggtaacgtgcaggccggtgattatgtgctcatccacgccggactctccggggtgggaacagcggctatccagctgactcgaatggccggtgccatccctctcgtgaccgcaggatcacaaaagaaactgcagatggccgagaagctgggggctgcggcagggtttaattacaagaaagaagacttcagtgaagcaacgctcaagttcaccaaggggaaacagctgctgctgcagttctcacgcaatctaagggacgattag

SEQ ID NO: 60552 - DNA, 261 bp, Artificial Sequence
  Description of Artificial Sequence: Synthetic coding sequence
atggggtcttcttctgaggcctccttcagatcagctcaggctagttgttcaggcgctcggaggcaggggttaggccgtggggatcaaaatctgagcgtgatgccacctaacgggagagcccagacccacacgccaggctgggtgtcagatccattggtcctgggagcgcaggttcacggtggctgtcggggaattgaagctctttctgtgtcctccggctcttggagcagcgccactgtatggatcctcaccgtgcagtag

SEQ ID NO: 60553 - DNA, 363 bp, Artificial Sequence
  Description of Artificial Sequence: Synthetic coding sequence
atggggagtagcagcgaggcgagcttccgctccgcacaggcctcttgttccggcgctaggcgccaaggtctcgggagaggggaccagaatctgtctgttatgcctccgaatggacgtgctcaaacccataccccaggttgggtctctgatccattggttttaggggctcaagttcacggtgggtgccggggaattgaggccctttctgtgtcttccggatcctggtcctccgctaccgtatggatactcacaggcctgtctcggccttttcttcccggtgctactgttctgcgcgaccggcctcttggctcagcatttgagctgagctatgaccagaagaaggcacccctgcggctgcagtag

SEQ ID NO: 60554 - DNA, 837 bp, Artificial Sequence
  Description of Artificial Sequence: Synthetic coding sequence
  Description of Combined DNA/RNA Molecule: Synthetic coding sequence
atgctgcggtcccttctgctgcatagcttgaggctttgtgcacagactgcatcgtgtcttgttctgtttcccagatttctggggactgcctttatgttatggctactggacttcctgtgcattaggaagcattttctaggcaggaggcgccgagggcaaccagagcctgaagtggagctcaactccgaaggagaggaagtgccccctgacgatcctcccatttgcgtgagcgacgacaaccggctgtgtacactcgcaagtctaaaggcagtttggcacggacaaaaactggactttttcaagcaagcacacgaaggaggtcccgcacccaactcagaggtagtgcttccggacggatttcagtctcagcatatcctggattacgcacagggcaatcgcccactagttctgaattttgggtcctgtaccugacctcccttcatggctcgcatgtcggcctttcagaggctggtcacaaagtaccagagggacgtggactttcttataatctacattgaggaggctcatccgtccgacggatgggtgactacagactctccttacataatcccacagcatagatccctggaggaccgggtttcagccgcaagagtgctccagcagggggctcccggatgtgctctggtcctcgatacgatggccaacagctcctcctctgcctatggagcctacttcgagcgtctgtatgtgatacagagtgggacaatcatgtaccagggaggccgtggcccagatggctatcaggtctccgaattacggacgtggctggagcggtacgatgagcagctgcacggggctcgacctcggagagtctag

SEQ ID NO: 60555 - DNA, 4209 bp, Artificial Sequence
  Description of Artificial Sequence: Synthetic coding sequence
atgcatcagacactctgtctgaatcccgagtccctgaagatgtctgcatgttccgattttgtcgagcatatttggaagcccggttcatgtaagaattgtttctgtctgcgttctgatcatcaacttgtagcaggacccccacagccccgtgccggaagcctgcccccacctcccagactgccgccaaggcccgaaaattgtcgcttagaggatgagggagtcaactcttctccttactcaaagccaactatcgcggtcaaaccaacaatgatgagctcagaagctagcgatgtgtggacggaggctaatctgtctgctgaggtctcccaggttatctggcggcgtgccccaggcaagttaccacttccaaaacaggaagatgccccagtggtgtacctgggatcctttcggggagtgcagaagcctgccggacctagcacttctccggatggtaattctagatgtccgccagcttacacgatggtgggcctgcataacctcgagcccagaggagagaggaatatcgcttttcaccctgtaagcttccccgaggaaaaagctgttcataaggaaaagcccagcttcccctaccaggaccgcccatcaacacaggagtccttccggcaaaaattagcggcatttgctggaactaccagcggctgccaccagggtccgggtcccctgagagaaagcttaccatcagaggacgatagcgatcagcgatgctctccttcaggcgactccgaaggaggcgagtactgttcgatcctggattgctgtcccggatcccctgtggctaaagctgcttctcagaccgccggtagtcgtggtcgacacggaggcagggactgcagcccgacatgctgggaacagggcaagtgtagcggtcccgctgagcaggagaaacgcggaccctcttttcctaaggaatgctgctcccaagggccaaccgcacacccgtcctgtctggggcctaaaaagctgagcctgacttcagaagcagcaatctctagcgacgggctgtcatgcggatccggcagcggcagcggggctagttcaccatttgtgccccatctggagtctgactattgttcactaatgaaggaaccagcacccgagaaacagcaggatcccggatgtcctggcgtgacaccttcccggtgcttggggcttacaggagagccacagcctcccgctcacccccgagaggctactcaaccggaacctatctacgccgaaagtactaagaggaagaaagctgcaccagtgccctccaagtcccaggccaaaattgaacacgctgctgcagcacaagggcagggacaggtctgcacaggtaatgcctgggcccagaaagcagctagcggctggggcagggatagtcctgacccgaccccacaggtgagtgccactattaccgtcatggctgcccatcctgaagaggaccaccgcactatctacctgagtagtcccgatagtgcagtgggagtgcagtggccacggggacctgtgtctcagaattcggaggtcggagaggaagagacatcagcaggacaaggtttatctagccgcgagagccatgcacatagcgcgagcgagtctaaacctaaggagaggcctgcgatccccccaaagctgagtaaatcatctcccgtcggctcccccgtttcaccctcggccggagggcctcctgttagtcccttagccgacctgtcagacgggtcttcaggtgggtccagtataggccctcaaccaccgtcccagggaccagctgatccagctccatcatgtagaaccaatggcgtggctatctcagacccatcccggtgcccgcaacctgccgcttcttctgctagcgaacagcgcaggcccagatttcaggccggtacttggagtcgtcaatgtcggattgaagaagaggaggaagtcgagcaggaattactgagccatagttggggcagagagactaagaacgggcctacagatcactcgaattctactacgtggcacagactccatcccacagatggaagcagcggacaaaacagcaaggtcggaacggggatgagcaaaagtgcctcctttgctttcgaattcccaaaggatcgctcaggaatcgagacttttagcccccctccccctccacccaaaagccggcatctcttgaaaatgaataagtccagttctgacttagagaaggtgtcgcagggttctgccgagagcctcagccctagtttcagaggcgttcatgtcagcttcaccaccggctctactgattccttggctagcgattcgcgcacttgctcagacggaggaccgtcctctgaattggcacacagtccaaccaactctggcaagaagctgttcgcacccgttccttttccgagtgggtctaccgaggacgtgtccccctctggcccacagcagccccctccactcccacagaaaaaaattgttagtagagctgcatcctctccagatggttttttctggacgcaggggagtcctaagcccggtacagccagccctaagctgaaccttagccattctgagactaatgttcacgacgagtcacatttctcttactcactgtctcccggaaaccggcaccacccagttttcagctccagcgatcccctagagaaggccttcaaggggagcggacactggctacccgctgccggactagctgggaatagagggggttgtggtagccccggattgcaatgtaagggagccccatcggcctcatcaagccaactgagtgtttcatcccaggcatcaaccggaagcacacaactccagttacacggtttgctttcaaatatctccagtaaggaaggcacgtatgctaaactcggcggactatatacacagtcattggctaggttagtagcaaagtgcgaggatctgttcatggggggacagaaaaaggagttgcactttaacgagaataattggtctctatttaagctgacctgtaacaaaccttgctgcgacagcggtgatgccatttactattgtgctacatgtagtgaagaccccggatcaacatacgcggtcaagatttgcaaagcgcctgaacccaaaacggtgagttactgctctccatccgtccccgtgcatttcaatatccagcaagattgtggccattttgtagccagtgtaccgtcctctatgctctcctcaccagacgctccaaaagaccctgtcccagccctcccgacccaccctcctgcccaggaacaggactgtgtcgtcgttatcacgagggaggtcccccaccaaactgcaagcgactttgtcagggactcagccgcatctcaccaggctgagcccgaagcttatgagagaagggtttgttttttattgcttcaactgtgcaatggcctggagcacttgaaggaacatggcataatccatcgagacctgtgcctagagaacctactcctagtccattgtaccctacaggccggacccggacccgctcccgcaccagcgcctgctccagctgcagctgcgccaccatgttcatctgctgccccacccgctggagggaccctgagccctgccgcaggtcccgctagcccagagggaccccgagagaagcagctgcccagattaattatatctaatttcttaaaggccaagcaaaagccgggtggaacccctaatctccagcaaaagaagagccaggcgagactggcccctgaaatcgtgtctgcttcgcaataccgcaaatttgatgagtttcagacgggaatactcatctacgaattgcttcaccagccaaatcctttcgaagtccgcgcacagctcagggagcgggattatagacaggaagatctgcctccattgccggcactgtccctgtattccccagggctgcaacagctggcacatttgttgttagaggcagacccaattaagaggattcgcatcggagaggccaaaagagtactgcagtgcctgctgtgggggccacgaagggagctcgttcagcagcctggaacatccgaagaggccctatgcggtaccctgcacaattggatcgacatgaaaagagccctgatgatgatgaagttcgccgagaaagccgtggaccgacgcaggggggtggagcttgaggattggctctgctgtcagtatctcgcatctgctgagcctggcgcacttctccagagtctgaaactcctccagttgctctag

SEQ ID NO: 60556 - DNA, 4209 bp, Artificial Sequence
  Description of Artificial Sequence: Synthetic coding sequence
atgcatcagacactctgcctgaatcccgagagccttaaaatgtccgcttgtagcgactttgtagagcacatttggaagccaggaagctgcaaaaattgtttttgcttgcgctcagaccaccaactggtggctgggccaccccagccaagggccggatcccttccacccccacccagacttccaccaaggcccgagaactgtcggctggaggatgaaggtgtaaactcatccccttattcgaaaccaacaattgctgtaaagcccacaatgatgtcgtctgaggcttctgacgtgtggacagaggccaacttatcagctgaggtctctcaggtgatatggcggagggccccagggaaacttcctttgcccaaacaggaggatgcacctgtagtctacttggggagtttccggggagtgcagaagccagccggtccttcaacatctccagacgggaacagccggtgcccacctgcctatactatggtaggcctccacaacctagagcctcgtggagaaagaaatattgccttccacccagtcagtttccctgaggaaaaggccgtacataaggagaagccctcgtttccttatcaagaccgtccatccactcaagagtcgtttcggcagaagctagctgcattcgccggaactacaagcggatgtcatcaggggccaggaccactgagggaatccctaccttctgaagatgatagtgatcaaagatgtagcccctcaggggacagcgagggaggagagtactgttccatactggattgctgccccggtagccccgttgcaaaagctgcatcccaaaccgccggttcacgcggtcgacatggtgggagggactgcagcccaacctgctgggaacagggcaagtgctcagggccagctgaacaggagaaaaggggcccatcttttcccaaggagtgttgcagccagggacccacagcccacccctcctgcctgggcccaaagaagctgtccctgacttcagaggcagcaatttcctccgatggcctgtcttgcggttccggatccggctcaggcgcatcatctcccttcgttccccacctcgagagtgactattgttccctgatgaaagagcctgcccctgagaaacaacaggatcccggatgccccggagtaacaccctctcgttgcctgggtctgacgggagagccccagccccctgcacatcctcgcgaggcgacccagcctgaacccatttatgcagagtcaactaagcgcaagaaggctgccccagtcccttccaagtcacaggccaagatagagcatgcggcagcggcacagggacaaggacaagtttgtacagggaacgcctgggctcagaaagccgcaagtggctggggcagagactcacccgatccaaccccacaggtgagtgccacaatcaccgtgatggctgctcacccggaagaagaccacagaaccatctaccttagttctccagactctgcggtgggcgtgcagtggcctcgcggacctgtaagtcagaatagcgaagtgggagaggaagaaacgtcagccggacaaggcctgagcagtcgagaaagccacgcacacagcgcctctgagagcaaaccgaaagaacggcctgctatcccgccaaaactgagcaaatcttcacctgtgggatctcccgtatctccctctgcgggtgggcctcctgtgagtccactggcagatctgagcgatggtagcagcgggggatcctcgattggaccccaaccaccttcacagggcccagctgatccagctccatcgtgccgtactaacggagtggctatttccgaccccagccggtgcccccaacctgccgcttcttctgccagtgagcagcggcgacctcggttccaggccggtacatggagcaggcagtgtaggatagaggaagaagaagaggtcgaacaagagctcctcagccactcttggggcagggagaccaagaatgggcctaccgaccactcaaactccaccacatggcaccggctccaccccactgatggaagcagcggccagaacagcaaggtagggacaggtatgtcaaaaagtgcatctttcgccttcgaattcccgaaggacaggagcgggattgagactttcagcccccctccacctccaccaaagagcaggcatctgttgaaaatgaacaagagctcgtccgatctagagaaagttagccagggctccgcagagagccttagtccctcctttcggggtgtgcatgtgtcttttactactggctctacagattctctggcttccgactcgagaacatgttcggacggagggccatcctctgaattggcacactccccaactaactccgggaagaaattgttcgccccagtgccattcccttcgggttccactgaagacgtcagccctagcgggccacagcagccaccacctcttccacagaagaaaatagtgtccagagccgcaagttccccagatggtttcttttggactcagggtagccccaagcctggcacggcttcccctaagctcaacctgtcgcactccgagacaaatgttcatgacgaatcccacttcagttattccctgagcccgggaaatagacatcacccggtattttcctcatcagaccctctggaaaaagcgttcaaggggagtgggcactggctgcctgccgcagggctcgcaggtaacagaggcggttgtgggagccctggactgcagtgcaagggtgctccgagcgccagctctagtcaactttctgtgagctcgcaagctagcaccggctccactcagctccagttgcatggtttgctgtcaaacatctcttcaaaggaaggaacctatgccaaactgggaggactttatacccagtcccttgcccgtctagtggcaaagtgtgaagatttgttcatgggaggacagaaaaaggaactgcacttcaatgaaaataactggtcattattcaagctgacttgtaataaaccctgttgcgactccggcgacgctatatactactgcgccacgtgcagtgaggatccaggttccacctacgcggtcaaaatttgcaaggcaccagagcccaaaaccgtatcctattgctccccttcggtgcccgtgcatttcaacattcagcaggattgtggccacttcgtcgcctctgtaccatcatcgatgcttagctctcccgatgctccaaaagatccagttcctgcgcttccaactcacccgcctgctcaggagcaggactgtgtggtcgtgatcactagggaggtgcctcatcagacagccagcgacttcgtgcgggactccgctgcctctcatcaggctgaacccgaagcatatgagagacgagtgtgtttcctgctcctgcaactgtgcaacggcctggagcatctcaaggagcacggcattatccacagggacctgtgtctcgaaaacctgctccttgtgcattgcacactccaagccggaccaggccctgccccagccccagccccagcaccggctgccgctgcccctccttgcagtagtgctgctccccctgctggaggcaccttaagtccagctgctggaccagcgtctcctgaaggaccgagagaaaagcagctgcctaggttaatcatctccaatttcttgaaagctaagcaaaagcccggtggcacccctaatctgcagcaaaaaaaaagccaggctcgattggccccagagatcgtgagcgcaagtcagtatcggaaatttgacgaattccagaccgggatcctgatttatgaactcctgcaccaaccgaacccattcgaagtgagggcccagctgcgtgagagggattaccgacaggaggaccttcctcccctgcctgcgctttccctctactctccaggcctgcagcagctggcccacctactcctggaggctgacccaatcaagcgaatcaggatcggagaagctaagcgcgtactacaatgccttctgtggggcccacggagagagctcgtacagcagcccggaacaagtgaggaagctttgtgtggcactctccataattggatagacatgaagcgagcactgatgatgatgaaatttgccgagaaagctgttgatcgccgtcgtggcgtcgagctggaggattggttgtgctgtcaatatctggcctctgcagaaccaggagcgcttctgcagagtctgaaactacttcagctcctgtag

SEQ ID NO: 60557 - DNA, 1416 bp, Artificial Sequence
  Description of Artificial Sequence: Synthetic coding sequence
atgtctgacttcgacgaatttgagcgccagctcaatgaaaataaacaagagagagacaaggagaacagacataggaaacgttcccactcaaggagtcggtctagagatcgaaagaggagatcacgctctagggaccggagaaacagggatcagcggagcgcctcacgcgaccgcagacgccgatcaaaaccactgactagaggagcaaaggaggagcacggcggattgattcgttctccacgccatgagaaaaagaaaaaggtccgcaaatattgggatgtgcctccccctggatttgagcacatcactcccatgcaatacaaagcgatgcaagcagcaggacagattccagctaccgcactcctgcccaccatgaccccagatggcctcgctgtcactccaactcctgtccctgttgtggggagccagatgacccggcaggcgagaagattatacgttggcaacatcccattcggtatcactgaggaggccatgatggacttttttaacgcccaaatgaggctaggtggcctgactcaagcccctggcaacccggtgctggcggtgcaaattaatcaggataagaacttcgctttcctggagtttcgctccgtggatgaaaccactcaggccatggcttttgacggcataatctttcaaggtcaatccctcaagatcagacgtccgcacgactatcagccgctccccggtatgagtgagaaccccagtgtctacgtgcctggggtagttagcaccgtcgttcccgattctgcacacaaactcttcattggcggactgcctaattacttgaacgacgaccaggtgaaagagctgctgacctccttcggacccctgaaggcatttaacctagttaaggatagtgcaacagggctgtcaaaaggctatgccttctgcgagtacgtcgatataaatgtcacggaccaggccattgcaggcctcaatggcatgcagctcggcgataagaagttacttgtccagcgggcatctgtgggcgctaaaaacgctacactgtccaccattaaccagacaccagtgacacttcaggtgcctggtttgatgagttcccaagttcagatgggcggacaccctactgaggtgctctgtctcatgaatatggtcctgcctgaagagctgctagatgacgaagaatatgaggaaatagtcgaagatgtacgcgacgaatgctccaagtatgggttggtaaagagtattgagatcccaaggccggtggatggcgtggaagttcccggttgtggaaagatctttgtggaattcacctccgtgttcgattgccagaaagctatgcaagggttgacggggcgtaaatttgccaacagggtagtcgtgactaagtactgcgacccagattcatatcacaggcgagatttctggtag

SEQ ID NO: 60558 - DNA, 783 bp, Artificial Sequence
  Description of Artificial Sequence: Synthetic coding sequence
atgtggcacgctatctcccgcaccagtcgtatgagtcagtctggctgtccttctgggctgctcgctgataaaaacatcagttcctcggcgacacgcgtaatagtgaagaccgccggaaaccagaaagacttcatggtggctgatgacatctctgtgaggcagtttaaggagatgctcttggcccacttccaatgccagatggaccagctagtgctggtgttcatgggctgcctcctcaaagatcacgacacgctctcacagcgtggcatcatggacggtcacaccatttacctggtgattaagtcgaaacaggggtctcgctctctggcccatagctttcgcgatttgcctaccaatgacccctgtcatcgagacagaaacacaaaggcaaatgataccctcaacaaggtcaaccacacctccaaagctaataccgccatgattagcactaagggccagagccatatttgcgcaacccggcagccagcctggattccagctctgcctagtatcgagctgacccagcagttacaggaagaatacaaagacgccacagttagcctcagcagcagccggcagacactgaaaggcgaccttcaattaagcgatgaacaatcaagctcacagataaccggaggaatgatgcagctcctgatgaataatccctacttggctgctcagattatgctcttcacatccatgccccagctttccgagcaatggcgccagcagttaccaacttttcttcaacagacccagatatccgatctgctgtcggcatag

SEQ ID NO: 60559 - DNA, 1428 bp, Artificial Sequence
  Description of Artificial Sequence: Synthetic coding sequence
atgtggcacgccatctccaggacctcccgaatgtcgcagtccgggtgcccgagtggcttgctcgccgataaaaacataagcagttccgcgactagggtgattgtgaagaccgccggaaaccaaaaggatttcatggtggctgatgatatttcggtgagacaattcaaggagatgctcctcgcccatttccagtgtcagatggaccagctcgtgctggtgttcatgggctgcctgttgaaggaccatgacaccttgtctcagcgcggaatcatggacgggcatactatttatctcgtgatcaagagcaaacaggggagtcggagtcttgcgcattcttttcgcgacctacccaccaacgacccatgtcaccgcgaccgcaatacgaaaggcaactcttctagagtgcaccaacccaccggcatgaatcaggcaccggtggagctcgcccacttcgtcggaagcgacgctcccaaggtgcatacacagaacttggaagtgtctcaccctgaatgcaaggctcagatgctcgaaaaccctagtatccagcgactactgtccaatatggagtttatgtggcaatttatcagcgagcatttggatactcagcagcttatgcagcagaatcctgaggtctctagactgcttctcgataatagcgaaatccttctgcagacactcgagctggctcgcaatttagccatgatccaggagatcatgcagattcagcagcccagccagaatctagagtatcccctcaatcctcagccttacctggggctcgagactatgcctggaggaaataacgcccttggacagaattatgctgatatcaatgatcagatgctcaactccatgcaagatcctttcggaggtaacccattcactgcccttctcgcagggcaagtgttggaacaggtccagagctccccgccacctccacctccttcacaggaacagcaagaccagctcacgcaacacccggctacccgtgtcatttacaattctagcggaggattctcatctaacacatctgccaacgatactctcaacaaggtaaaccatacatctaaagctaacacggccatgattagcacgaaaggccagagccatatctgcgcaaccagacaaccggcatggataccggcattaccgagcattgagcttacgcaacagctacaggaagaatacaaggatgcaacagtgagcctctccagcagcagacaaactcttaagggcgacctgcagctgtctgatgagcagtcctcaagccagatcacaggtggcatgatgcagctgctcatgaacaacccataccttgctgcacagatcatgctctttacatccatgccccagttaagcgagcagtggagacaacaacttccgacgtttctgcaacaaactcagatctcagatcttctgtctgcctag

SEQ ID NO: 60560 - DNA, 1146 bp, Artificial Sequence
  Description of Artificial Sequence: Synthetic coding sequence
atgaacgcactggacggcgttccatttaagctaccgaaaggatttgtgattgggactgagcccctacccggtcctgaactctccgtccccgcttgtggcgaggtactcctcggatccatgcacgacttctccctcgagcgcacggccctgttctgggttgaggctgccggtcagggtcctagcccataccagtgtggggaccctggcaccgcctccgctccccctgcctggctgcttctggtgagtcctgagcatggcctggcaccggcacctaccaccattagggatccagaggccggacatcaggaaaggcctgaggaggagggcgaggatgaggcagaagcgagttccggctcggaagaagagccagcccctagtagtctccaaccaggatctccagcctccccaggaccgggtaggcggctctgtagtctggatgtcctcaggggcgtacggctagaattagcaggcgctagacggcgtctctcagaggggaagctcgtgtctaggcctcgggctctcctacacggcctaagaggccatcgggcactatccctctgcccttcaccggcacaatcccctcgaagtgcgtcccccccaggtcccgctcctcagcatcctgctgcaccagcgtccccccctcgtccatcgacggcgggagcgatccccccactgcgcagtcacaaacctaccgtggcaagtctatcgccctatacttgcctgcccccactcggcggagcccctcagcctttgaaccctcacaagagccacccggatacagctgccgatctgctcagcgccctatcgcaggaggagcaggacctcatcggacccgtggtagcacttggatatcccctccgccgagccataatagctctgcagaaaactggcaggcagtcgctgtcacagtttctaagctatctgtccgcatgtgatagactgctgagacagggctatgaggaaggcttggtcgacgaggctatggagatgttccagttcagcgaaagtcaggctggcgaattcctcaggctttgggagcagttctcggacatgggatttcagcaggaccggatcaaggaagtgttgctggtgcatgggaataggcgggaacaagcgctggaggagttggttgcgtgcgcccagtag

SEQ ID NO: 60561 - DNA, 1146 bp, Artificial Sequence
  Description of Artificial Sequence: Synthetic coding sequence
atgaacgctctggacggggtcccctttaagctccctaagggatttgtgattgggaccgagcctcttccgggaccagagctctctgtccccgcatgcggagaggtactgttgggttccatgcacgatttcagcctggaacgcactgcactgttctgggtggaggccgctggccagggccctagtccataccaatgcggggaccccggaacagcgtccgccccaccagcttggttgctgttagtgagcccagaacacggcctagctccagctcctactaccattcgggacccagaagcgggacatcaagagagacccgaagaggaaggggaagatgaagctgaagcgtcctctgggtcggaggaggagcctgctccatcttctttgcaaccaggttcacctgcatcccccggacctggcagaaggctgtgctccttagatgtgctaagaggggttcggctggaacttgccggagccagaagacgtctgagcgaaggcaaactggtgtccagaccacgtgctctcctccacggcctgagggggcacagagctctgagcttgtgcccttcccccgctcagagcccacgtagtgcttcccctccaggcccagctcctcagcatccagccgcacccgcaagtccaccacgacccagcacagccggagctatcccccctttacgctcccataagccgaccgtcgcaagtctgagcccttatacatgcctgccccctctgggaggagctccacagccattaaatccccacaaatcccaccctgacaccgccgcagacctgctctccgctttgagccaagaggagcaggacctgattggccctgtggtggctctcggatatccactgagacgggcaatcattgctctgcaaaagactggtcggcagagcctgagtcagttcttatcctacttgtcggcatgtgatcgactgttgaggcaaggatacgaggaagggctcgtggatgaagctatggagatgttccaattctcagagtcgcaggcaggggaatttttgcggttgtgggagcagtttagcgatatggggttccagcaggataggatcaaggaagttctgttggtccatggcaaccgtagggagcaggccttggaagaacttgtcgcctgtgctcagtag

SEQ ID NO: 60562 - DNA, 1746 bp, Artificial Sequence
  Description of Artificial Sequence: Synthetic coding sequence
atgatgaccagcgttagctcggaccattgtaggggcgctcgagagaagccccagatctcagcggctcagagtacacagccgcagaagcaggtggtccaggcaacagcagagcagatgcggctggcccaggtaattttcgataagaacgacagcgatttcgaggcaaaagttaagcaactgatggaggtgacgggcaaaaatcaagacgagtgtatcgttgccctgcacgattgcaatggcgatgtgaataaggccatcaacattctcctggaaggcaacagcgacactacatcctgggaaacagtgggatgcaaaaagaagaattttgccaaggaaaactcagaaaataaagagaacagagagaagaagaaacacacgggcgacttgactagcagtccattgagccaactgtcgagctcactttcatcccaccaatcttcgctctccgcccatgcagccctatcaagctccacatcacacacacacgctagcgtagagagtgctagttctcaccagtcatccgccaccttttccaccgccgctacctccgtctcctctagcgcctcatcaggggcaagtttatcttccagcatgaataccgcaaacagcttgtgcttgggagggacacccgcttcggcaagttcctccagctctagagcagctcctctagttacctctggaaaggcccctccaaacctgcctcagggcgtcccaccgcttctgcacaatcagtacctagtaggtccaggtgggctccttcctgcctaccccatatatggctatgacgaactgcagatgcttcagtccagactgcctgtggattactatggcattccgtttgccgctccaactgcgctggcctctcgggacggcagtttggcgaataatccttacccaggcgacgttactaagttcggacggggtgactcagcctctcctgctccagccacaacctctagtgctactgccgagccgattaccgacccaccccatagcccagccgcactgagagagagctgcacggccacctggtcttatacaggcctaccctactacactggcatgcctagtgcattccaatacggaccaacaatgtttgtgcccccagcctccgctaagcaacatggagtgaacctgtccacccctactcccccttttcagcaggcctccggctatgggcaacacggctactccactggctacgacgatttaactcagggaacagctgcgggtgactatagcaaagggggttacgcaggctctagtcaagccccaaacaaaagtgctggcagcggtccagggaagggcgtgagtgtgtccagcagcacaacagggctgccagatatgaccggttccgtgtataacaaaactcagacttttgacaagcagggctttcacgctggcaccccaccacccttttccctcccttccgttcttggaagtaccggcccactcgccagcggggctgccccaggatacgcaccccctccattcctgcacatccttcctgcccaccagcagccacactcacagctgctccatcaccaccttccccaagatgcccagagcggtagcggccagcggtctccggctccctgcagtccctccttaaagcccccaaacctgcctactctgtccatcctggacaaattgaacccagaggaaagggggggactggggcagggcctcagctgggctggagaaaacactcgtgcgagaatttgggagcccagcgcgctgagttag

SEQ ID NO: 60563 - DNA, 3360 bp, Artificial Sequence
  Description of Artificial Sequence: Synthetic coding sequence
atgatgacatcggtaagcagtgatcactgtcgcggagccagagagaaaccccagatttccgctgctcagtcaacccaacctcagaaacaggtggtgcaagccacagcagagcagatgcggttggcgcaagtcattttcgataagaatgacagcgatttcgaggcaaaggtaaaacaactgatggaggtgacaggaaagaatcaagatgagtgtatcgtcgccctgcatgactgcaatggcgacgtgaataaagccataaacattctgctggagggaaactcggatactaccagctgggaaactgtgggctgcaagaagaagaattttgcaaaggagaattctgagaataaagaaaatcgggagaagaagagcgaaaaagagagctctcggggtcgtggaaacaataaccgcaagggtagaggaggcaatcgcggtagggagttccggggtgaggagaacggaatcgactgcaatcaggttgataagccaagcgatcggggtaagcgggctagaggtagagggttcggtcggggtcgaggccgaggagcaggccgattctctacccaggggatgggcacgttcaatcctgccgactatagtgacagcacaagtacagacgtgtgtggcaccaagctggtcgtgtgggaagcggcacagaatggtgccgacgaggggaccgagctcgcaagcaacactcacaatatcgctcaagatttgtccaacaaatcttcttatggtcttaaaggcgcttggaaaaatagtgttgaggaatggacaacggaagactggaccgaggatctgtccgaaacgaaggtgttcacagcttctagtgcacccgctgagaatcatatcctcccaggtcagagcatagacttagttgcactgctgcagaagcctgtaccacactctcaggcttctgaagcgaactcattcgagacctcccagcagcaagggtttggtcaggcgctcgtgttcactaacagccagcataataaccaaatggctcccggaaccggctcttcaacggccgttaacagctgtagcccccagtccctcagctcagtcctgggaagcggattcggagagctggctcctccaaaaatggctaacatcacttcatcccaaatcctggaccagctgaaggctccatccctcgggcagttcaccaccacacccagcacgcagcagaacagtacaagtcatcctacaactacaacaagctgggatttaaagccacctacctcacagagctccgttttatcccaccttgactttaaaagccagcccgaaccttcccctgtgctgtcacagctgtcacagcgtcagcagcaccaatcacaggccgtaacagtgccacccccagggctcgagagtttccccagccaagcaaaactgagggagagtactcctggcgacagccccagcactgtgaataaactgctccaactgccctctacaacaatagagaatatctcagtctccgttcaccagccacagcccaagcacatcaagctggccaaacgtcgtatacccccagcctcaaagatcccagccagtgccgtggagatgcctgggtcggcagacgtgaccggcttgaacgtgcaattcggtgctcttgaattcggcagcgagcccagccttagcgaattcgggtccgcgccttctagcgaaaacagcaaccagataccaatcagcctgtatagcaagtctctgtccgaacctctcaataccagcctcagcatgactagcgctgtccagaactcaacatacaccacttctgtcattacttcgtgctccctgaccagttcgtcactgaactcggcatcccccgtcgctatgagttcatcatatgaccagagctccgtccataatcggatcccctatcaaagcccggtttcgagcagtgaaagtgcgcctggaactattatgaacggccatggcggaggccgttctcaacagacattagatacacccaaaactaccggtcccccttccgcactgccgtcggtcagctcactgcctagtaccaccagctgcaccgccttgctgccatctacgtcccaacatacaggcgacctgacttcaagtcctctgtcacagttgtcctcctccctatccagccatcagtcttcattgtctgcacatgcagccctcagctcatccacctctcacacacatgcctcagtagagagcgcttcctcacatcagtcctccgctaccttctcaacagctgccacatccgtctcctcgagcgcgtcctccggggcttctttgtctagctctatgaatacggctaattccctgtgcttgggcggtacccccgcttcggcctctagctccagctcaagagcggctcctctcgtgacctctggtaaagcccctccaaatttaccacagggagtcccccctctgttgcacaatcaatatctcgtcgggcctggaggcctgctcccagcttacccaatttatgggtacgacgaactgcagatgttgcagagcaggctgcctgttgactactatgggatccccttcgccgctcccaccgctctggcctctcgggacggcagcctggctaacaatccctacccaggggacgttaccaaattcggccgaggagattctgcctcccctgccccagccaccactcccgcacagcctcagcaaagtcagagccagacgcaccacaccgcacagcaaccattcgtgaacccagcactgccacctggctactcgtacaccggtttaccgtactataccgggatgccttctgccttccagtatggccctacaatgttcgtgccacccgcttctgctaagcaacatggcgtgaatcttagcaccccaacacctccattccagcaggcctcagggtacgggcagcatggatacagcactggctatgacgatctcactcagggcaccgcggcaggcgactactctaaggggggatatgccggttccagtcaggcccctaacaagtctgccggtagcgggcctggcaagggcgttagcgtatcttcctcaacgacgggcctgcccgatatgacaggcagcgtctacaacaaaacgcagacttttgacaagcaaggcttccacgcaggcacccctccacccttttctctgcctagcgtactgggctctacgggcccactagcctcaggcgcagctccgggttatgctcctcccccatttctacacatcctacccgcacaccagcaacctcactcacaacttcttcaccaccacctgccccaggacgcacagagtggatccgggcagagaagccagccttcaagcctccaacctaagagccaggcatcgaaacccgcatacggaaacagtccttactggaccaactag

SEQ ID NO: 60564 - DNA, 978 bp, Artificial Sequence
  Description of Artificial Sequence: Synthetic coding sequence
atggcgaacatcacatcctcacagattttggaccagctcaaagcaccttcgttagggcaattcactactacgccttccacacagcagaacagtactagtcatccaactacaacaacatcctgggatctcaaaccacctactagtcagagttccgtcctgtcacacctggacttcaagtcccagccagagccctctcctgtcctgagtcagttgagccagaggcagcagcatcagtctcaggcagtgacagtgccccctccgggtttggagtctttcccttcccaggctaagttgagggagtcaacgccaggcgacagtccctcaaccgtgaataaactcctccagttaccatccacgacaatcgaaaacatatcagttagcgttcaccagccccagcccaaacatatcaagctggccaagcgtagaattcccccagctagcaaaatacccgcatccgctgtcgaaatgccaggtagcgccgacgtaacaggtctaaatgtccaattcggtgccctggagttcggatcggaaccttcactctctgaatttggctcagctccttcatccgaaaatagtaaccagatccccatctccctgtactctaagtccctgagcgagccgttgaataccagtctgtctatgacatctgccgtgcagaactccacttacaccacttccgtgatcacctcatgctctctgacaagttcaagcctgaacagtgcctccccagtcgccatgagcagctcttatgaccagtccagtgtacacaatcgtatcccgtaccaaagcccagtttctagcagtgaatctgcgccaggcactattatgaacggccacggcggagggagaagccagcagaccctggattccaaatacagttctaaattgttgctgtcctggttagtgcccacaaaacagcgaaagagaatcgcccatgtcatgtggaagacccctgtcggtcagtggctgattcggtag

SEQ ID NO: 60565 - DNA, 1077 bp, Artificial Sequence
  Description of Artificial Sequence: Synthetic coding sequence
atgaataccgctaactctctgtgcctgggcggaaccccggctagcgccagcagcagcagctctagggccgcaccacttgtcacgagcgggaaagctccgccaaatctgccccagggcgttccgccactcctccacaatcagtacctggtgggtcccggaggcctcctgccggcataccctatatatggatacgatgaactccagatgctgcagagtcgcctcccagtcgattattacggcataccatttgccgctccgacggctttggcttcccgggacggctctctggccaataatccatacccaggtgacgtgaccaaattcggcagaggcgacagcgccagtccagcaccagcaacgacccctgctcagccacagcagtcccagagccagacccaccacaccgcgcagcagccatttgtgaacccggctctgccccctggctatagctacaccggtctgccctactatacaggaatgccctcagctttccagtacgggccaaccatgttcgttccgccagccagcgcgaaacagcacggggtcaacttaagcaccccgacaccaccctttcagcaggcttcagggtatggtcagcatggatattctaccggatatgacgaccttacgcaagggacggctgctggtgactattctaagggaggatatgccggatcctcacaggctcccaacaagagcgcgggtagtggccctggcaaaggtgtcagtgtttcctcaagcaccacaggattgcccgatatgacaggtagcgtctataataaaacacagacatttgataaacaggggtttcacgcaggtacgccccctcccttctctctgccttcagtgctgggaagcaccggcccactcgcttccggggcagctcccggttatgcccctcccccatttttgcacattctgcccgcacaccagcaacctcactctcagctcctacaccaccatttaccccaggacgcccagtctggctccggacagaggagccaacctagttctcttcagcccaagtcacaggcctccaagcctgcttatggaaattctccctattggacaaattag

SEQ ID NO: 60566 - DNA, 3360 bp, Artificial Sequence
  Description of Artificial Sequence: Synthetic coding sequence
atgatgacaagcgtgtcctctgaccactgccgcggagccagagaaaagccccagatttccgcagcccagagcacccaaccacagaaacaagtggtgcaggccactgccgaacagatgagactcgcccaggtgattttcgacaaaaacgattctgacttcgaggcaaaggtgaagcagctcatggaggtgaccggcaaaaaccaagacgagtgtattgtcgctctgcacgattgcaacggggacgtcaataaggccatcaatatacttctcgaggggaactcggacactacctcatgggagaccgtgggctgtaaaaaaaagaacttcgctaaggaaaattcagagaacaaagagaaccgggaaaaaaagtctgagaaagagtcctccagaggaagaggcaacaataaccgaaaaggcagagggggaaatcggggtcgtgagtttaggggcgaggagaacggcatagattgtaaccaggtcgacaagcccagtgaccgtggcaaacgggcacgcggacgcggatttggcaggggcagaggacggggtgccggaagattctctacccaggggatgggcaccttcaacccagcagattacagcgatagcacatctactgatgtgtgtgggaccaagttagttgtgtgggaggcggctcagaacggggctgacgaaggcacagaactagctagcaacactcacaatatcgcccaagatctgagtaacaaatcctcatatgggctgaagggcgcttggaagaactctgttgaggagtggaccaccgaggattggacggaggatctaagcgagaccaaggtttttaccgcaagttctgcccctgccgaaaatcacatcctgcctggccagagtatcgacctagtcgctctgctgcagaagccagttccccactctcaggctagcgaagccaattcctttgagacctcacagcagcaaggctttggccaggccctggtttttaccaactcgcagcacaacaatcaaatggcaccagggacagggtcctccacagccgttaatagctgtagtcctcagtcactgagcagtgtcctgggctccggatttggagaactcgccccacccaaaatggctaacatcacctcttcccagattctagaccagttgaaagcaccctccctgggacaatttaccacgacacctagcacacagcaaaatagcacgtcgcatccgacaaccactacatcatgggacctgaagcctcctaccagccagagctctgtgctgagccatcttgatttcaagagccagccggaaccatctcccgttttatcacagctgagccagagacagcagcatcagtcccaggctgtgactgtgcctccacccggactggagtcctttccctcccaggctaagctgcgggagagcactccgggtgattccccctccactgtgaataaactgctgcaattaccatcgacgacaattgagaacatctctgtatccgtgcaccaaccacagcccaaacacatcaagttggccaaacgccgtataccccctgcttctaagattcccgcatccgctgtggaaatgcctggaagcgccgacgtcactggcctgaatgtgcaatttggggctcttgaattcggtagcgaacccagcctgagtgaattcggatcagcaccgtcaagcgagaacagtaaccagatcccaatctctctatattcaaagtcactttccgaaccacttaatacaagcttaagtatgacgagtgccgtgcagaatagcacgtataccacgtccgtgattacttcctgcagtctgacctcctcgtccctgaacagcgccagtccagtcgccatgtcttctagttacgaccagtcttcggtgcataacagaattccttaccaatcacccgttagctcgagtgagtccgccccagggactataatgaatggtcacgggggaggccgtagccagcagactctcgataccccaaaaaccactggccctccctctgctctaccctctgtgtcctccttgccctcgactaccagttgtaccgccttgctcccgtcaaccagtcagcatacgggggaccttacgtccagcccgctgagccagttgtccagctcgctgagcagccaccagtcctcactgagcgctcacgcagcactgtcgtcatccacctctcacacacacgccagcgtagaaagtgcaagctcacaccaatcatcagccaccttctcaacagccgcaacatctgtgtcctcctctgcttcttctggcgcttcactctctagtagtatgaatactgcaaactccctctgcctcggaggcacaccagcctccgcctccagttcctcttcaagagcagcacctctggtcacctcgggaaaggccccacccaacctgcctcagggggttcccccactcttgcataaccagtatctcgtcggccctggcggacttctgcccgcatacccaatttacgggtacgatgaacttcaaatgctccagtctcggctaccggtcgactactacggcataccattcgccgctccaaccgccttggcaagccgggacgggtctctggccaataatccatatccaggcgacgttactaagtttggacggggagatagcgcttcgccggctccagccacgacgcccgctcagccccaacagagccaatctcagacccaccacaccgcacagcaaccctttgtcaacccagcgctgcctcccggatacagctatacgggcttaccctattatacagggatgccttccgcattccagtatggacccacaatgttcgtcccacccgctagtgccaaacagcacggagtcaacctgtcgacccccacacctccattccaacaggccagcggttacggccagcatgggtattctacaggatatgatgacctgacccagggcactgctgccggagactactcaaagggaggctatgctggctcctctcaagcccctaataagtctgccggaagtggccctgggaagggggtgagtgtgagttcgagtaccactggcctacccgacatgaccggatctgtgtataataaaacccagacctttgataaacagggatttcacgctggcacacctcctcccttcagtcttccttcagtcctgggcagtaccggtccattagcttccggcgctgcccctggctacgcccctccaccgttcctgcacatcctgccagcgcaccaacagcctcatagccagcttctacaccaccatctgccccaggacgcacagagtggatcaggccaacgctcccaacccagcagcctccagccgaagagtcaggcgtcgaaacctgcctacgggaacagtccttactggactaattag

SEQ ID NO: 60567 - DNA, 2559 bp, Artificial Sequence
  Description of Artificial Sequence: Synthetic coding sequence
atggacagcaagggtttaggacgaatactgtggaagtctggtcagcaaaaaacaggactgaagataatcgacctcgtagcactcttgcaaaaaccggtcccccactctcaggcctctgaagctaattcatttgaaacttctcagcagcagggcttcggacaggcactcgtctttacaaatagccagcataacaatcagatggctccaggcacaggatcgtctacagcggtaaacagctgcagccctcagtccttatcaagcgttttaggatccggtttcggcgagcttgctcccccaaaaatggccaacataacatctagccagatcttggatcagctgaaggcacctagtctaggccagttcaccacgactcccagtacacagcaaaacagtactagccatcccacaaccaccacctcttgggacctaaaaccccctaccagccagagtagcgtattgtctcatctcgatttcaagagtcaacctgaaccatccccagtgctgagccagctaagtcagaggcaacagcatcaaagtcaggccgttacagtacccccacccggactcgagtcatttccgtcccaggccaagttgcgtgaatcaacacccggtgactctcccagtacagtcaacaagttgctgcagctcccctctaccacgatcgagaatatctctgtcagtgtgcaccagccacaacctaagcacatcaagcttgcaaagcggaggattcctccagcctcaaagatccctgcctccgccgttgaaatgcccggatcagctgatgttactggactaaacgtccagttcggcgctctcgagtttggctctgagcctagcctcagcgagttcggtagcgctcccagttccgagaattcaaaccaaattcctatttccttgtatagtaagtccctgagtgaacctctgaacacttccctttctatgacatccgccgttcaaaatagtacgtacactacgtccgttattacatcgtgcagcctgacatccagttcactgaacagcgcaagcccggtcgccatgagttctagctatgaccagagctcagtccataaccgcatcccttaccagagccccgtgagctcaagcgaaagcgctcctggaactataatgaacggccacggcggaggccgatctcaacaaaccctcgataccccaaaaacaaccgggcctcccagtgctctcccaagcgtgtcttccttacctagcactacatcgtgtacagccctcttgccaagtactagccagcacacaggtgatctcaccagctctcccttaagccaactctccagcagcctgagttcgcatcagtccagtctgtctgctcacgccgctctctcatctagtacaagtcacacacacgcttccgttgagtccgcgtctagtcaccagtcttcagcgactttctcgaccgcggctacttctgtgtcttctagcgccagctcgggtgcttctctgtccagctcgatgaatactgctaacagtttatgccttggcggtacccccgcatcagccagtagctcctcaagtagagcggcacccttagtgactagcggtaaggccccacctaacctcccacagggtgtgcctccgctgctgcataaccaatacttggtgggcccagggggactcctgcccgcttatcctatctacggctatgacgaacttcaaatgttgcaatccagattgcctgtggattactacggtattccatttgctgccccaaccgctctggcctcacgcgatggctccctggctaataacccctaccctggcgatgtaacaaaattcgggcgtggagactccgctagccctgcccctgctactacgccggcacagccacagcagtcacaaagccaaacccaccacactgctcaacagcctttcgtgaatcctgctctcccgcctggctactcttatactggcctcccgtattatactgggatgccatctgccttccaatatgggcctaccatgttcgtgccccctgctagcgctaaacagcatggagtgaatcttagcacgccaacccccccattccagcaggcctccggttacggacagcatgggtactcgaccggatacgacgatctgacacagggaacagctgccggagattactccaaggggggatatgcgggtagcagccaagccccaaataagtccgctgggtcgggccctgggaagggcgtgagcgtgagctccagtacgactggccttcctgatatgactggcagcgtatataataaaactcagaccttcgacaaacaggggttccacgctggaactcccccaccattttcgctacccagtgtcctgggttctactggccctctcgcaagtggcgcagcgccagggtacgctcccccaccatttctacatattctccccgctcaccaacagccacactcacaactactccaccatcacctccctcaagatgcccagtctggaagtggtcagagatctcagccttcatctctccagccgaaatctcaagccagtaagcctgcctacggcaactcgccatactggaccaattag

SEQ ID NO: 60568 - DNA, 1023 bp, Artificial Sequence
  Description of Artificial Sequence: Synthetic coding sequence
atggaagtgacaggtaagaatcaggacgagtgtattgtagccctgcacgattgcaatggcgacgtcaataaggccataaacatcctgctcgagggtaattctgacacaaccagctgggaaaccgtcggttgcaagaaaaagaattttgctaaagagaatagtgagaacaaagagaacagagaaaagaagagcgagaaagagagtagccgtgggagaggcaacaacaatcggaaaggcaggggcggtaaccggggtcgcgagttcaggggcgaagaaaatggcattgactgcaatcaagtcgataaaccaagtgatcggggaaagcgggcacgtggaagaggcttcggcagaggcagaggtcgcggagccggacgcttctccactcagggcatgggcacatttaaccccgcagattactctgactcaacttccactgacgtgtgcggaaccaagctcgttgtctgggaggccgctcagaacggggcagacgaaggaaccggggcatggaagaatagcgtggaagagtggaccaccgaggactggactgaggatctgagcgaaacaaaagtctttaccgcttccagcgctcctgccgaaaaccatatcctacctggccagagtattgacctggtcgctttgctacaaaagcctgtaccccactcgcaggcctctgaagccaacagctttgagaccagtcaacagcagggctttggccaggctctggtctttaccaatagccagcacaataatcagatggcacccggaacaggctcaagcactgctgttaacagttgttcaccccagagtctgagttccgtcttaggatcaggctttggggagcttgctcctcccaaaatggcgaatataactagttcccagattctggatcagctgaaggctccctcgctgggacaattcactaccaccccaagtacacaacagaactccaccagccatccaacaaccacaacaagttgggatctcaagccccctactagtcaaagctccgtccttagccattag

SEQ ID NO: 60569 - DNA, 1239 bp, Artificial Sequence
  Description of Artificial Sequence: Synthetic coding sequence
atgatgacatcagtcagttccgatcactgcagaggagcccgtgaaaaaccccagatcagtgctgcccagtcaactcaaccccaaaagcaggtcgttcaggccactgcggaacaaatgaggctggcacaagtgattttcgacaagaacgatagcgacttcgaggccaaggttaaacagcttatggaggtgacaggaaagaaccaggatgagtgcatagtggccctccacgattgcaatggagacgtgaataaggcaattaacatcctgctcgaggggaatagtgatactacttcgtgggagaccgtgggctgcaagaagaagaacttcgctaaagagaatagtgagaataaagagaacagagagaagaagtctgaaaaagagtcctctcgtggacgcggtaacaataacagaaaaggacgagggggtaacagaggccgagaattcaggggagaagaaaacggcattgactgcaatcaggtggataaaccttctgacagaggtaaaagggccaggggtcgcgaactcgcctcaaatactcacaacatcgcccaagatctaagtaataagtcatcctacgggctcaaaggcgcttggaagaatagcgtcgaggagtggactactgaagattggaccgaggatctcagcgaaactaaggtctttactgcctcaagtgcccctgcggaaaatcacatactcccaggacagtctattgacctcgtcgctttgttgcagaagcctgttccacatagccaggcttccgaggccaactcatttgaaacctcccagcagcaagggttcgggcaggcactcgtgtttacgaacagtcagcataacaatcaaatggcccctggtactggaagcagtaccgccgttaactcgtgttcgcctcagagccttagcagcgtgctgggatctgggtttggagagttagccccaccaaaaatggccaatatcacttccagccagatcctggatcagctgaaggctcccagcctcggacaatttactacaacgcccagcacacagcagaactctaccagccatcccaccacaaccactagttgggatttaaaacctcccacttctcaaagctccgtcctttcccatctggattttaagagtcagcctgagccaagtccagtgctctcccagctttctcaaagacagcagcatcagtcacaggctgttacagtgcccccacccggtctcgaaagctttccctcacaagctaagctgtag

SEQ ID NO: 60570 - DNA, 2061 bp, Artificial Sequence
  Description of Artificial Sequence: Synthetic coding sequence
atgatgacatctgtatcttctgaccattgccgcggagccagagaaaaaccacagatctcagctgcacagtctactcagccgcaaaaacaggtcgttcaggccacagcagaacagatgcgcctggcccaagtcattttcgacaaaaacgattccgacttcgaggccaaggtgaagcagctgatggaagtgaccggcaagaaccaggacgagtgcatcgtggccttgcatgactgcaatggagatgtcaacaaggcaatcaacattctgttggagggcaatagcgacaccacttcttgggagactgtaggttgcaagaagaagaactttgcaaaagagaatagcgagaataaggaaaatagggaaaagaagagtgagaaggagtcttctagaggacgtgggaacaacaaccgcaaggggaggggcggaaacagagggcgtgagttccggggagaggagaacggtatcgattgcaatcaagtggataagccttccgatagaggtaaacgcgcaaggggcagggaactcgcgagcaatactcacaacatcgcgcaagacctgtccaacaaaagctcctacgggcttaagggcgcatggaagaacagtgtcgaagaatggactactgaagattggacggaagacttgtcggagacaaaagtattcactgcctcaagcgctcctgcagagaaccatattttgcccggacagagcattgacctggtagcactcctccagaagccagtacctcattcacaagcctctgaggccaactccttcgagacgagccagcagcagggatttggccaggcgttggtattcactaacagtcaacacaataaccaaatggcccctggaacgggctcgagcacagcagttaacagctgttcacctcagtccctcagttctgttctgggctcaggatttggggaacttgctccccctaaaatggcaaatatcaccagcagccagattcttgatcagctcaaagcgccatcgcttggccagttcacaactacaccatcaacccagcaaaattcaactagccaccctactacaacgaccagctgggacctgaagcccccaacaagtcagagctctgtactctctcacctcgatttcaaatcccagccagagcccagccctgtgctctctcagctttctcagcgacaacagcaccagtctcaagcagtcacggttcctccgccaggcctggagtctttccccagccaagcgaagctgcgggaaagtacacctggggactctccctctacagtcaataaactactccagctgccatctacgacaattgagaatatttccgttagcgtacaccagccacagcccaaacacattaagttggctaagcggaggatccctcctgcctccaaaattcctgcctcggccgtcgaaatgcctggaagcgcagatgtgacaggcttaaatgtgcagttcggagcgttggagttcggaagtgagccaagcttgtcagagtttgggagcgctcccagttccgagaacagtaaccagattccaatttcgctttactccaagtccctgtccgagccgctcaatacaagtcttagcatgacaagcgccgtgcaaaactcgacttataccaccagcgtgattacaagttgcagcctaacaagctcttcacttaactctgccagccccgttgcgatgagttcctcgtacgaccaatccagcgtccataataggatcccgtatcagtcaccagtgagctctagcgaatcggcacctgggacaatcatgaatgggcatggcggaggcaggtcccagcaaactctggataccccaaagacgacaggtcccccaagcgcgctgccctcagtaagtagcctgcctagtaccacctcctgtaccgctttgctgccctccacttctcagcacacgggggatctgacaagctcacctctgtcacaactgtcttccatgccagtgtggagagcaccacttcccaccagtccacagccaccgagcccaagacagaggcccccttcacaggtcccccatccacaggccccagcatgcccggttgcatag

SEQ ID NO: 60571 - DNA, 831 bp, Artificial Sequence
  Description of Artificial Sequence: Synthetic coding sequence
gagaaggagtcctcacgaggcaggggcaacaataatcggaaaggcaggggtggaaaccggggtcgggaattccggggagaggagaatggcattgactgtaaccaggtcgataagcccagcgatcgcggaaagagagctcgcggtcgtggcttcggcagggggagaggcagaggagccggacggttcagcactcagggaatggggacatttaatcctgccgactattccgactcaacctccacagatgtgtgcggtactaagctcgttgtctgggaagccgctcaaaatggcgctgatgagggcaccggcgcttggaagaattccgtcgaggagtggaccacggaagattggacggaagacctaagcgagacaaaggtgtttaccgcgagctccgcccctgcagagaatcatattctgcctgggcagagcattgacctcgtggccctactgcaaaagccagtgccccactcacaggcttccgaggctaattctttcgagaccagccagcagcagggcttcgggcaggcccttgtttttaccaattcacagcataacaaccaaatggctcctggtacaggctcaagcactgccgtaaatagctgttcgccacagtctctctcaagcgttctgggatctggattcggagagctggccccacccaagatggccaatatcacttccagccagatcctggatcagctgaaagcgcctagtctgggtcagtttacaactaccccctccacccaacagaacagcacctcccaccccacaacaacaacctcctgggacctcaaacctccaacctcacagtcaagcgtcctgagccactag

SEQ ID NO: 60572 - DNA, 3087 bp, Artificial Sequence
  Description of Artificial Sequence: Synthetic coding sequence
atgcgtctggcccaagtgattttcgacaaaaatgacagtgatttcgaagctaaagtcaagcagctcatggaggttaccggaaaaaaccaggatgaatgtattgtcgcccttcatgactgtaatggcgacgttaataaagctataaacatcctgctggagggaaattccgataccacgtcatgggaaactgtgggctgcaagaaaaaaaatttcgcaaaggagaattctgagaataaggaaaaccgggaaaagaaatctgagaaggaatcttcgagaggtcggggaaacaacaaccggaaggggcgaggaggcaatcgcggtagggagtttaggggagaggagaacggaatcgactgcaatcaagtagacaaaccatctgacaggggaaagagagcacgcggtagagagttggcctccaatactcacaatatagcacaggacctgtctaacaagtcatcatacggactcaaaggtgcctggaaaaactctgtggaagagtggacaaccgaggattggacagaggatttgagtgagactaaagtcttcacagcttcctctgcgcctgctgaaaaccatattctaccagggcagagcatcgatctggtggcactgcttcaaaaacctgtcccccactcacaggcatcagaggcaaactcctttgaaacctcacaacagcaaggttttggacaggccctggtcttcactaatagtcagcataataatcagatggcaccagggacaggctccagtaccgccgtgaactcgtgctcaccccagagcctgtccagtgtgctcggctccgggtttggggagctcgctcccccaaagatggccaatattacctccagtcagatacttgatcagttgaaagccccaagcctcgggcagtttacaacaacgccgagcactcaacagaatagcacttcccaccccaccaccactacctcctgggatctcaagcccccaacaagccagtcctccgttttaagccatttagattttaagtcgcagcccgaaccctcacccgtcctctcccagctgtcccagaggcagcaacaccagtctcaagcggttacggtcccgcctcccggattggaaagttttccctctcaggcaaaactgagggagtccactccaggagatagcccaagcacagtgaacaagctgctacaactgccaagtaccacaattgagaatattagcgtgtccgtccaccagccgcaaccaaaacatattaagttagccaagcgtaggattccccctgcttctaagatccctgccagtgccgtggagatgcccggatcagctgacgttactggcctaaacgtccagttcggcgctctggagtttggtagtgagccttccctaagcgaatttggaagcgctcctagctcggaaaattctaaccagatccctatcagcctctactctaagtctctcagcgagcctcttaatacctccttatcaatgacaagcgctgtacaaaactccacctacaccacctctgtaataacgtcatgctctttaacttcttcatcgttgaactctgctagtccggttgccatgtcttccagttatgatcagtcgagtgttcacaatagaatcccataccaatcgcctgtttcatcctccgagtctgccccaggcaccattatgaacggacacggtggcggaaggagccagcagaccctggacacccccaaaacgacaggccctcctagtgctctgccgtcagtgtcatctctgccgagcactactagctgcactgctctgttgccaagcacctctcagcacactggggaccttaccagtagcccactaagtcagttatcttccagcctgagctcccaccagagttcgctgagtgcccacgccgcactgagtagcagcacctcacatacgcacgcttccgtagaatctgccagttctcaccagtcttcagctactttcagcaccgcggctacaagtgtgtcttcttctgcctcaagtggtgcatcactttccagctccatgaacacagctaactcactgtgccttgggggaacacctgcatctgcgtcttcgtcctctagtcgcgcagctcccctggtcacatcgggaaaagccccaccaaacctgccacaaggggtacctcctcttcttcataatcagtacctcgtcggccctggtggcctcctcccagcttaccctatttacgggtacgacgaactgcagatgctccaatcacgactccccgtagattactatggcatcccctttgccgcaccaacagccctcgccagccgggatggctcactggcaaacaacccctatccaggggacgttacgaaattcgggcgtggggattccgccagcccagcaccggcaaccacacctgcacaacctcaacagtcacagagccaaacacatcacaccgctcagcaaccctttgtgaatcctgccttaccacctgggtactcttataccggtctgccatattacaccggtatgccctcggctttccagtatggcccaaccatgttcgtgccacccgcttctgccaagcagcatggagtcaacctgtcaactcccacacccccttttcaacaggcatccgggtatgggcaacatggctatagcaccggctacgatgacctgacacaggggacggctgctggggattatagcaaggggggttacgccggatcttctcaagcccctaacaaatctgccggatctggaccaggtaagggcgtcagtgtctcttcatctacaaccggcctacctgatatgacaggttccgtatataataagacgcagacctttgataaacagggatttcacgctggtaccccccctcctttctcactgccctccgtgttgggctcgaccggccctttggcgtctggggctgccccaggctacgcacctcctccatttcttcatatcctgccggcacaccaacagccacacagccagctgctgcaccaccatctgccccaggacgcacagagtgggagtggtcaacggagtcagccatcgagtctccagccgaaatcccaggcatccaagcctgcttacggcaactcaccctattggacgaattag

SEQ ID NO: 60573 - DNA, 3360 bp, Artificial Sequence
  Description of Artificial Sequence: Synthetic coding sequence
atgatgaccagcgtgagctccgaccactgccgcggtgctagggagaagccacagatttctgcagctcaatccacgcagccacagaagcaggtggtgcaagcgaccgccgagcagatgagactggctcaggtcatctttgataaaaatgattccgattttgaggccaaagtgaaacaactgatggaagtcacaggtaaaaaccaggatgagtgtatcgtggccctgcatgattgtaatggtgacgtaaataaggctatcaacatcttactggaaggcaacagcgatacaacctcgtgggaaaccgtcggctgcaaaaagaaaaattttgccaaggagaatagtgagaacaaagaaaatcgcgagaagaagtctgagaaggaatcatctcggggtcggggtaacaacaaccggaaggggagaggcggaaatagaggtcgtgaattccgaggagaagaaaatggcattgattgtaatcaggtggataagccatctgaccgtggcaagcgcgctcgaggcagagggtttggccgtggcaggggacgaggggcagggcgtttctctacccagggtatgggaacattcaacccagccgactattctgattcaacctctacagatgtctgtggcacaaaattagtggtttgggaggcagcccagaatggcgcagatgaaggcacagaactcgcaagcaacacacacaatatcgcccaggatctgagtaacaaatctagctacggccttaagggcgcatggaagaactcggttgaggagtggacaacggaggattggacagaagacttaagcgaaacgaaggtatttactgcttcctcagcacctgccgagaatcacattttgcctggacagtccattgacctcgtagcgcttctccaaaagcctgtcccgcattcccaagcaagtgaggctaacagctttgaaacttcgcagcagcagggctttggccaggccttagtctttaccaacagccaacataacaaccagatggccccaggaacgggtagctccactgccgttaattcatgcagccctcagtcattgagttccgtactgggatcaggctttggagagcttgctccccctaagatggccaacattacaagtagccagattctggaccagttgaaggccccatccttgggtcagttcaccacaactcctagtacccaacaaaacagtacatctcatcccacaaccacaacctcttgggatctgaagcccccaactagccagtccagcgtgttgtcacatttagattttaagagtcagcccgaaccatcaccagtgctcagtcagctgtctcagagacaacaacaccaatcacaggccgttaccgtgcccccaccgggacttgagtctttcccttcccaggccaagctgagggagtccacaccaggcgattcccccagcactgtgaataagctccttcaactccccagtacaacaatcgagaatattagcgtcagcgtgcatcagccacagcctaagcacatcaaactagcaaaacgcagaatccctccagcctccaagatccctgcgtctgccgtagagatgccaggtagtgctgacgtgactggcttgaatgtccaatttggagctctggagttcggatccgaaccctctctctccgagtttggtagcgcaccctcttccgaaaactccaaccaaatacctattagcttgtacagtaagagcctcagcgaacccctcaacacatctttgtctatgacatccgctgtccagaatagcacctataccacttccgtgatcaccagctgcagccttacctctagctctctcaactctgctagccccgtggcaatgtctagtagctacgaccagtcaagtgttcataacaggatcccctaccagagtccagtctctagctccgaatctgctcctggaaccatcatgaacggccacggaggaggtagatctcagcagaccttggatactccgaaaactactggtcccccttctgcccttccaagcgtgagctctctcccttcgacaacttcctgtacggctctgttgccgagcactagtcagcatactggggacctcacctcatcccccttatcacagctatctagttctctgagctcacaccaaagtagtttgagcgcccacgccgctctgagcagctccacctcccacacacacgcctcagtggaatctgcctcatctcatcaatccagtgccactttcagcaccgccgcaacctcagtgagtagctctgcgtcctccggcgcaagcctgtcctcctccatgaatacagctaatagtctgtgtctaggcggaacgcctgcctcagcctcttcaagcagctccagggctgcaccccttgtcactagcgggaaggcgccacctaatcttccacagggggttccccctctcttgcataatcagtacctcgtggggcctggcggattacttcccgcataccctatttacggctacgacgagcttcagatgttacagtcccgactgcccgtcgactactacgggattcccttcgctgccccaacagcacttgcttcccgcgacggaagtttggccaacaacccctatcctggcgacgtgacaaaatttgggaggggtgattccgcatcgcccgcacctgccaccactcccgcacagcctcagcagagccagtcacagacacatcatacagcccagcaaccctttgtgaatcctgccctcccccctgggtactcttacacagggctgccttattataccggcatgccatcagcttttcagtatggcccaacaatgttcgttccccctgcctccgccaagcagcacggagtcaacctgagtacacctactccacccttccagcaagcgagcggatatggccagcatggctattccactggctacgatgacttgacacaggggacggctgccggtgactatagcaaaggaggttacgccggaagctcccaggcacctaacaagagcgccggttccgggccagggaagggagtgtcagtgtcatccagcaccactggcctgcccgatatgacagggtccgtatataataaaactcagacgtttgacaaacagggcttccacgccggaacacccccaccgttctctctgccatcagtgctggggagcacagggccactcgcctccggagctgctccaggctatgcccctcctccgtttctgcatattcttcccgcacatcagcagccccattcccagttgctgcaccatcatttgccccaggatgcccagagcggttctgggcagaggtcccagccatcatccttgcagcccaagtcacaagcaagtaaacctgcatatgggaacagcccctactggaccaattag

SEQ ID NO: 60574 - DNA, 2625 bp, Artificial Sequence
  Description of Artificial Sequence: Synthetic coding sequence
atgaggcttgcgcaggtgatttttgataaaaatgacagcgacttcgaggccaaggtgaaacagcttagcgagaccaaggtgttcaccgcaagctctgcccctgctgaaaaccatatcttgcctggacagagtatcgatctcgtagcactcctgcagaagccggtaccacatagccaagcctctgaagccaactccttcgagacaagccagcagcagggcttcggccaagcactggtatttactaatagccagcataacaatcagatggcccctggaacaggcagttccacggccgtgaatagttgttcccctcaaagcttatcttccgtcctcggatcaggcttcggagagcttgcaccaccaaaaatggcaaacattacaagcagccaaatcctggaccagttaaaggctccatctttagggcagtttactaccaccccctctacccagcaaaattcgacaagccacccgactacgacaaccagttgggatctgaaaccgcctacatcgcagtcatccgtattatcccacttggattttaaaagccagccggaaccaagtcccgttctctcccagttgagccagagacagcagcaccagagccaggcagtcacagtgccgccacccggactcgagagctttccctcgcaggctaagttgagagagtccacgccaggggacagcccaagtaccgtgaataagctgttgcaactacctagcaccaccatcgagaatatcagcgtttctgtccatcagccgcaacctaaacatattaagttggccaaacgtagaatcccccctgcctctaaaatccctgccagcgcagttgaaatgcctggttccgcagacgtcaccgggctaaatgtgcaatttggggctctggagtttggaagtgaaccgtccctcagtgaatttgggtccgccccaagttctgaaaacagcaaccagatcccaataagcttgtactcgaagtccttgtctgagccattaaacacttcgttatctatgacctctgccgtccagaattctacctacacgacaagtgtcattaccagctgctctctgacaagttcctcactcaattctgcctcgcccgtggccatgtcctcttcctatgaccagtcttcagtgcacaatcgcatcccgtatcaaagcccagtctccagctctgagtctgccccaggaactattatgaatggtcatggcggaggtcgcagccaacaaactctggataccccaaagacaaccggccctcccagcgcgttgcctagtgtgtcctctctgccatcaacaacttcctgcacagctctgttaccttcgaccagtcagcataccggcgatcttacaagctctccgctctctcagttgagcagcagcctgagctcccaccagtctagcctgagtgcgcacgccgctctctcgagcagcacctcccatactcatgccagcgttgagagtgccagtagccaccagtccagtgccacattcagcaccgctgcaacttccgtttcatcctcagccagttcgggcgctagtctctctagtagtatgaacactgctaactccctgtgcttgggtgggaccccggcttccgcctcgtcgtcatcttcacgcgcagctccgctggtgacctctggcaaggccccacccaatctcccgcagggcgtgccacccctactgcacaaccagtatctcgttggccctgggggtctgctgcccgcatatcccatttacggctatgatgagctgcagatgttgcagtcccgcctgccagtcgattactacggcataccatttgccgctccaactgctctggccagtcgagacggcagcctcgctaataatccctacccaggtgatgttaccaagtttggaagaggcgatagtgcctcccccgcacccgctactactcctgcacaaccacagcagtcccaatcgcagactcaccatacggctcagcagccattcgtgaaccctgcacttccacctggctatagctataccggactaccctactataccggaatgccaagcgctttccagtatggccctaccatgtttgtcccacccgcttcagctaaacagcacggagtgaacctgagcaccccaaccccacccttccagcaggcctcgggttacggtcagcacggctacagtactggatacgacgacctcactcagggtacggccgcaggagattacagcaagggtggctatgccggaagctcgcaggcacccaacaagtctgcgggtagtggtcccggtaagggggtctccgtgagctcaagtacgacaggcctgccagatatgacaggcagtgtgtacaacaagacacagacttttgacaagcaagggtttcacgcaggcacacccccaccctttagtctgccaagcgtcctggggagcacggggcctctcgctagcggtgcggcacctggctacgcccctccacccttcctgcacattctcccggctcaccagcagccccacagccagcttcttcatcaccatctccctcaggacgcccagtcggggagcggtcagcggagtcagccgtcttcactgcaacctaagagtcaggctagcaagccagcctacggtaattctccgtattggacgaactag

SEQ ID NO: 60575 - DNA, 1593 bp, Artificial Sequence
  Description of Artificial Sequence: Synthetic coding sequence
atggaggatgactccctctatctgggaggggagtggcagtttaatcacttctcaaagctgacttcgagtcgccctgacgctgcctttgccgagattcagcggaccagcctgcccgaaaaaagcccgctctcttgtgaaacgcgtgtcgatctctgcgacgatctggcccctgtagccaggcagcttgctccaagagaaaagctgccactgtcaagcaggcgaccagctgccgtgggggcagggctccaaaacatgggcaatacttgctatgttaatgcctctctgcagtgtttgacgtatacacccccactagctaactacatgttgtcaagagagcactcacagacttgccatagacacaagggatgtatgctttgtactatgcaggcccacattactcgggcattgcacaatccaggacacgttattcaaccttcacaagccttagctgccggttttcaccggggtaagcaagaggacgcccatgagttcttgatgttcaccgtcgacgccatgaagaaggcctgtttgcccggtcacaaacaggtggatcacccgagtaaggataccactttgattcaccaaatttttggcggatactggagatcccagataaaatgtctgcattgtcacggcatttccgacactttcgatccctacctggacatcgcattggacatacaggcagctcagagcgttcagcaggcactcgagcaattggtcaaaccagaggaactgaacggagagaatgcgtaccattgtggggtttgcctacaacgcgcacctgcttccaagacactgacgctgcacacttcggcaaaggttctcatactggtactgaagagattttccgacgtcactggaaataagattgcgaagaatgttcagtaccccgagtgtctggacatgcagccctacatgtctcagcagaacaccggcccactcgtttacgtcctatatgcggtgctggtgcatgccggttggtcgtgccacaacggtcactatttttcttacgtgaaagcccaggagggccaatggtacaagatggatgatgctgaggttacagcggcatccatcaccagtgtcctgtctcagcaagcgtacgtgctgttctatattcagaaaagcgagtgggagcgccacagcgaatcagtcagtagaggcagggaacctcgcgcattaggggcagaggatactgataggagagccacccagggcgagctgaagagggaccacccctgcttgcaggcaccggagctcgacgaacatctagtggagagagcaacgcaggagtcaacattagaccgttggaaattcctgcaagaacagaacaagacaaagcctgaatttaatgttaggaaagtcgaaggaactctaccacccgacgtcctggtaatccaccaatctaaatacaagtgcggaatgaagaaccaccacccagagcagcaaagctctttactgaacctctcatctagcacccccacgcaccaggagtcaatgaatactggaactttggcgagcctgagagggcgtgccaggaggtcaaaagggaaaaacaaacactcaaagcgcgctttgctggtgtgccagtag

SEQ ID NO: 60576 - DNA, 684 bp, Artificial Sequence
  Description of Artificial Sequence: Synthetic coding sequence
atggggaactgcgtggggagacagagaagggagcggcctgccgcaccaggtcatcccaggaagagggccggaagaaatgaacccctgaagaaggagcgtctcaagtggaagtctgattatcccatgacggacggccagcttagatcgaaaagggacgaattttgggacaccgctcctgcgtttgagggaaggaaggagatctgggacgccctaaaggctgctgcctatgctgctgaagcgaatgaccacgagctcgctcaggccatactggatggtgcctctatcaccctccctcatggaacgctttgcgaatgttacgacgagcttggtaatcgttaccagctcccaatttactgcttgagccctcccgtgaacttgctgctcgagcatacagaggaagagtcgcttgagccgccagagccaccaccttcggttcgccgagaatttcctctgaaggttaggcttagtacagggaaggacgtcagactgagcgcgtctctgcccgatacggttggacagcttaaaagacagcttcatgcccaggaggggatcgagccttcctggcagcgatggttcttttccggtaagttgctgacagaccgaactaggctgcaggaaaccaagattcagaaagatttcgtgattcaagtcatcattaaccagccccctccccctcaggactag

SEQ ID NO: 60577 - DNA, 3261 bp, Artificial Sequence
  Description of Artificial Sequence: Synthetic coding sequence
atggcaaccgtgggagagtggtcgtgcgtgcgatgcacttttctgaaccccgcaggacagaggcagtgctctatatgcgaggctccacgccataagcctgatttaaatcatatcctcaggctgtccgtcgaggagcagaagtggccctgcgctcgctgcactttccggaattttcttggcaaagaggcatgtgaagtgtgcggcttcacacccgagcctgctcctggggcagccttcctgccggtgctcaatggcgtcttgcctaagccccctgctattctaggagagccaaaaggatcatgccaggaggaagctggacccgttcggactgccggactggtggccaccgagcccgcaagaggccaatgcgaggataaggacgaggaggagaaagaggagcaggaagaagaagaaggggctgccgaaccacggggaggttgggcatgccctcgatgcacactacataatacacccgtcgcatccagctgcagtgtgtgcggtgggccacggagactctcactcccaagaatcccaccagaggccctggtcgtccctgaggttgtagctccagcaggctttcatgtggttcccgctgccccaccgcctggactccccggtgagggggctgaagcaaatccccctgctacaagccagggtcctgcagctgagcctgagcctccccgtgtaccaccattctctccattttcgagcaccctccagaacaatccggtgccaaggtccaggcgggaggtgccgcctcagctgcagcctcccgtacctgaagctgcacagccgagcccatcagctggatgtcgaggtgctcctcagggatccggttgggccggagcctcaagactcgcggagctgctgtccggcaaacgtctgtctgtgctcgaggaggaggcaaccgagggcggaacaagcagggtcgaggccggttctagcacttccggcagtgatataatcgatctggctggagacactgtcagatacactcctgccagtccctcatcccctgacttcactacctggtcttgcgccaagtgcacactgcgaaacccaacggtggcacccaggtgcagtgcttgtgggtgttcaaagctccatgggtttcaagaacatggtgaacctcccacccactgtccagattgtggagccgataaacctagcccgtgtggaaggagttgcggtagagtgagcagcgcccagaaagcagccagggtgcttcctgagagaccaggccagtgggcctgccccgcatgcactctgttaaacgcactgcgcgcaaaacattgcgccgcttgtcatacacctcaactcctcgtcgcccagcgaagaggagctgcacctctgcgccgtagggaatcaatgcatgtcgagcaacggaggcagacagacgagggggaggccaaggccttgtgggaaaatatcgtagctttctgcagggaaaacaatgtatcatttgtggacgactctttcccccctgggccagagtcagtaggattccccgcaggggacagtgtgcagcaaagagtgcgccaatggctgagacctcaggaaatcaattgctctgtattccgcgaccaccgcgctacctggtccgtttttcacacactacggcctagtgacattctccaaggtctgctgggcaattgctggtttttatccgccctggccgtgctggcggagaggcctgatcttgtagagagggtgatggtcacccgcagcctgtgtgctgagggtgcttaccaggttaggttgtgcaaagatggtacttggactactgtgctggttgacgatatgctcccatgtgatgaggccggatgtctgctcttcagtcaggcgcaaagaaaacagttgtgggtcgcactgatcgaaaaagccctcgccaagctccatgggtcatacttcgctttgcaggcgggtcgcgcaatcgaaggcctcgctacgctgactggcgcaccctgcgaaagcctggctctccagctctcctcgaccaacccaagagaggaaccagtggataccgatctaatctgggccaagatgctgtcatctaaagaagccggatttttgatgggcgcttcctgtgggggtggaaacatgaaggtggacgattcagcgtacgagagcctgggcctcaggccgaggcacgcttattctattctggatgtgcgggacgtccagggcacaaggcttctgcgactgcgcaatccatggggtcgtttctcatggaatggtagctggtccgacgaatggccgcactggccgggtcacctgcggggtgagttaatgccgcacggctccagcgaaggtgtgttttggatggaatatggagatttcgtgcgctactttgactccgttgatatttgcaaagttcatagcgactggcaggaggctagagtccagggatgcttcccatccagtgctagcgcacccgtgggggttactgctctgactgtccttgagcgggcatccctcgagttcgccctgtttcaggagggctccagacggtcagatgccgtcgattcccacctcctggatctctgcatacttgtgttcagggccacctttggctccggcggtcacttgtcgctgggacgactgctcgcacatagtaaacgcgctgtgaagaagtttgtgagctgcgacgtcatgttagaaccgggtgagtacgcagttgtgtgctgtgcctttaatcactggggcccaccactgcccggtactcccgctcctcaggcgtcgagtccatctgccggtgtacctcgagcgtcccccgagcccccaggccacgtactggcggtgtattctagtagacttgtgatggtcgaaccggtggaggcacagcccacgaccctcgcggacgctatcatcctgctaaccgaaagccgtggggaacggcacgaaggcagggagggaatgacgtgctattaccttacccatggctgggcaggacttatcgttgtcgtggagaataggcatcctaaggcatatctccatgtacagtgcgactgtaccgactccttcaacgtggtcagcacccggggatcgcttaggacccaggattcagtcccccctctacaccgccaagtgttggtgatactgagccagctggagggaaacgccggattttcaatcactcacagacttgcacaccgtaaagcggcacaggctttcctgtccgactggaccgcaagcaagggcacccatagtccaccgttgacaccagaagttgctggattgcatgggcctcggccactgtag

SEQ ID NO: 60578 - DNA, 930 bp, Artificial Sequence
  Description of Artificial Sequence: Synthetic coding sequence
atggctgccgctggggcacctgatgggatggaggagcctggaatggacactgaagctgaaacagtagcaactgaagctcccgctaggcccgtgaactgtctcgaagctgaagcagcagccggtgctgcagcggaggactctggagcagccagaggaagtcttcagcccgctccagcgcaaccacctggcgatccggctgcacaagcttctgtgagtaacggcgaggatgcaggaggcggtgctggacgcgagctcgtcgacctgaaaataatatggaacaaaacaaaacatgacgtgaaattccccctagattccaccggttccgaactgaagcagaagattcactccattaccggattgccacctgctatgcagaaggtaatgtacaagggccttgtaccagaggataaaaccttgcgagagattaaggttacctccggagccaagattatggtggtgggatcaaccatcaacgacgttcttgccgtaaacacccctaaagacgctgcgcaacaagacgcaaaagccgaagaaaataaaaaggagccgttgtgccgccaaaaacagcaccgcaaggtgctagataagggcaagcctgaagatgtcatgccaagcgtcaagggagctcaggagcggctccctacggtccccctcagtggaatgtacaacaaatccggcggaaaggtcagactgaccttcaagttggagcaggatcagttgtggattggaacaaaggagcggactgaaaagctccccatgggatccataaagaatgtcgtgtctgagcccattgaaggtcacgaggactaccacatgatggccttccagctcgggcctactgaggctagttattactgggtctactgggtgccaacgcaatatgtggacgccattaaagataccgtgcttggcaaatggcaatatttttag

SEQ ID NO: 60579 - DNA, 561 bp, Artificial Sequence
  Description of Artificial Sequence: Synthetic coding sequence
atgcagaaggtgatgtacaaagggttggtgcctgaggacaaaacattgcgcgagattaaagttacctccggcgctaaaataatggtcgtgggatcgacaatcaacgatgttctcgccgttaacacccctaaggatgcggctcaacaggatgcaaaagccgaggaaaataagaaggagcctctgtgccgccaaaagcagcaccggaaggttctggataaggggaaacccgaggatgtgatgcctagtgtaaaaggagcccaggagcgcctgccgacagtccctctatctgggatgtataacaagtcaggcggaaaggttcgactgaccttcaagttggaacaggaccaactgtggatcgggaccaaggaacgaacagaaaagctacccatgggtagcataaagaacgtggtttctgagcctattgaaggacatgaggattaccacatgatggccttccagcttggcccaacggaggcaagttactactgggtctactgggtccctacacaatatgtggacgcaatcaaggacaccgtcttggggaaatggcagtacttctag

SEQ ID NO: 60580 - DNA, 2127 bp, Artificial Sequence
  Description of Artificial Sequence: Synthetic coding sequence
atgttcactctgtcccaaacatccagagcctggtttatagaccgcgctagacaggccagagaggaacgtctggtccagaaggagagagagagagctgctgtcgtgatccaggcacacgtgagaagcttcctttgtcggtcccgacttcagcgagatataagacgggaaattgacgacttctttaaggctgatgatcccgagtccacgaagcgctcggcactctgcattttcaagatcgccaggaaactattgttcctgttccggattaaagaggataatgaacgctttgagaaattgtgcagatctatcctgtctagcatggacgcagaaaacgagcctaaggtgtggtatgtttctctcgcgtgtagcaaagatctaacattactgtggatccaacagattaaaaacatactctggtactgttgtgatttcttaaagcaattaaaaccagaaattctgcaggatagtaggctcattaccctctatctgaccatgcttgttaccttcacagatacttctacttggaagattctgagaggcaagggggaatcactgaggcctgccatgaaccacatctgcgctaatataatggggcacctcaatcaacatgggttctattccgtcctgcagatcctgttgacacgcggtctggccagaccacgtccatgcctgtctaaaggaacgctgaccgccgcattttcgctggccttaagacccgtcattgctgcccagttctccgacaacctcatccggccatttcttattcacataatgtcagttcctgctctcgtaacgcatctttctaccgtgacacccgaacggttaaccgtcttggagtctcatgacatgttgaggaaattcatcatttttttaagagatcaggataggtgccgagacgtctgtgagtcgctggaggggtgtcataccctatgcctcatgggcaatctgttacacttgggtagcctgagtcctagagtacttgaggaggaaaccgacggtttcgtgagtcttctcactcaaactctctgttactgtaggaaatacgttagccagaagaagtccaacctgacacactggcacccggttctcgggtggttcagtcagtccgtagattatggactgaacgaatctatgcacctaattacgaagcaactgcagttcttatggggagtgcctctgatcaggattttcttctgcgacatcctcagtaaaaagcttctcgagagtcaggagcccgcacatgcacagccggcttcccctcagaacgtattgcctgtgaagtccttgctgaagcgggctttccaaaagagcgcatccgtgcgcaatatcctgagacccgtcgggggaaagagagtggatagcgctgaggtccaaaaagtttgtaacatttgtgtgctctatcagacttcacttaccactctgactcagattcgcttgcagatcctcactggcctcacatatctggatgacctgttgccaaaactttgggcgtttatctgcgaattgggtcctcacggtggcctgaaattgtttttggagtgtctaaataacgataccgaagaaagtaaacagctgctggccatgctgatgctcttttgtgactgcagcagacacctcattacgatcctggatgatattgaggtatacgaagaacaaattagcttcaagctcgaagagctggtaaccatttcttcgtttcttaacagcttcgttttcaaaatgatctgggacggaatcgtcgagaatgctaaaggagaaactttagaactgttccagtctgttcatggctggttgatggtgctctatgaaagagactgtcgtcggagattcactccggaggatcactggctgaggaaggacctgaaaccgagtgttctctttcaagagcttgaccgcgatagaaagcgagcccaactgatactgcagtatatccctcatgtaattccacacaaaaatagagtgctcctgttccgtactatggtaaccaaggagaaggagaaactggggcttgtggagacgagttcagcgagcccccacgttacacatattactatccggcgatcccggatgctcgaatccctttttgagtgcccctggcctctcgtaattaacgccgaaagctgttag

SEQ ID NO: 60581 - DNA, 735 bp, Artificial Sequence
  Description of Artificial Sequence: Synthetic coding sequence
atgttcacactaagccagaccagtcgcgcatggttcatcgatagggctcgccaggcacgagaggagcggctggtgcagaaggagagggagcgggcagcagtcgtgatccaagcccatgtaagatcgtttctatgcagaagcagactgcagcgggacatcagacgggaaatcgatgactttttcaaagcagatgaccccgagtctactaaaaggagtgctttgtgcatcttcaagatcgcacgaaagctgctgtttttgtttcggattaaagaagacaacgagcgattcgagaagttgtgtagatcaattttgtcatccatggacgccgagaatgagcctaaagtgtggtatgtgtctctggcatgtagtaaggatctgacactcctctggattcagcagattaaaaacatcctgtggtattgctgtgacttcctgaaacagctcaagccggagatactgcaagactcccgcctgataacattatacctgactatgctagtgaccttcacagataccagtacgtggaagatcctgaggggtaagggagagtctctccgacccgcaatgaaccacatctgtgccaatattatgggtcacctgaaccagcatggattctacagcgtgttgcagtgttgtgatggtctgttccccgacttggtgagctacgcccctcataacaaccctgtccggtggtctgtaggccgatcgtggtacgattggcagctcagtcggtag

SEQ ID NO: 60582 - DNA, 3207 bp, Artificial Sequence
  Description of Artificial Sequence: Synthetic coding sequence
atgttcactctgagccagactagcagggcctggtttattgatagggctagacaagcccgagaagaaagactcgtgcagaaagaacgcgagcgtgctgccgtcgttatccaggcgcacgtgaggagtttcctctgtcgctcacggctgcagagggatattagacgtgagatcgatgatttttttaaagcggatgaccctgagagtaccaaaagatcagcactgtgtatcttcaaaatcgctaggaagctgctgttcctttttcgcattaaagaagataacgaacgtttcgagaaactttgtaggagcatcctgagctccatggacgctgagaacgagcccaaagtgtggtacgtcagtttggcgtgttccaaagacctgactctgctgtggatacagcagatcaagaacatcctgtggtactgctgtgacttcctgaaacagttaaaacctgaaatacttcaggactccaggctgattacactatatcttactatgttggtgactttcaccgacacatcaacctggaaaatactgcgcggtaaaggcgaatcactaagacctgcaatgaaccacatttgcgcgaacatcatgggacaccttaaccagcacggcttctactcggtactgcaaattttacttactcggggactggctagaccacggccatgtctgtctaaaggtacactgacggctgcctttagcttggcactgcggcctgtgattgctgctcagttttcggacaacctcattaggccctttttgattcacatcatgtccgtgccagccttggtcacgcatcttagcactgtcactcccgagagattgaccgttcttgagagccacgatatgctaaggaaattcattatctttctgcgcgaccaggacagatgtcgggacgtctgcgaatccctggaaggctgccacaccctttgcttgatgggcaatttactccacttaggctccctgagccctagagtgctcgaagaggagactgatggctttgtatcactgctcacgcagaccttgtgctattgtcgcaaatatgtgtcccaaaagaagtcaaatctcacacactggcaccctgtgctcggatggttttcccagtctgttgattatggcttaaacgagagcatgcatctgatcaccaagcagttgcagtttttgtggggggttcccctaattaggatcttcttttgtgatattttgagtaaaaagctgctcgaatcccaggaacccgctcacgcacaaccagctagccctcagaatgtgctgccggtcaaatcactattgaagagggccttccagaaatcggcctccgttcgcaacatacttcgcccagtggggggaaaacgtgtcgattccgccgaagttcaaaaggtttgcaacatttgcgtcctgtatcagacttccctcaccactctcacccagattcgactacaaattctgaccggactgacatacctggatgatctcctacccaaattatgggccttcatatgcgaactgggcccacatggcggtttgaaactttttttagaatgcctgaataacgacaccgaggaaagcaaacagctgctggctatgctaatgctcttctgcgattgttcgcggcacttaattacaatcttagatgatattgaggtgtacgaggagcaaattagtttcaagctggaagaacttgtgactattagtagcttcttaaactcctttgtgtttaagatgatctgggacgggatcgtggaaaatgctaaaggtgagacactggaactctttcagagcgtccacggctggctgatggtgctttacgagagagactgtaggaggcgtttcacacctgaggatcactggttaagaaaggatcttaagccatctgttctgtttcaggagctggaccgcgaccgtaagagagcacagctcatcctgcaatatatcccccatgtgattccccacaaaaaccgcgtgctccttttccgcactatggtgacgaaggagaaggagaagctgggtcttgtagagacaagctccgcatcacctcacgttactcacattactatccgacgaagtagaatgcttgaggatggctacgaacaactcagacaactttcacagcacgccatgaaaggtgtgataagggtcaaattcgtgaatgacttgggggtagacgaggccggaattgaccaagatggagtctttaaggaatttctggaagagatcatcaagcgcgttttcgatccggcacttaacctgttcaagacaacatccggcgacgagcgactttacccaagccctactagctatatacatgaaaattacctgcagctcttcgagtttgtgggcaagatgctaggcaaagccgtgtatgaaggtatcgtggtggacgtaccctttgcttcatttttcctgagtcagctgctcggccaccatcatagcgtcttttattcaagtgttgatgagctcccctcgttggacagtgagttctataagaatctcacaagcatcaagcgctatgacggggacatcactgacctagggctgacattatcatatgatgaggacgtaatggggcagctggtctgccacgagctcatccccggtggaaagaccatacctgtgacaaacgagaataaaattagctacatacatctcatggcgcactttcgtatgcacactcagatcaaaaatcagaccgctgcgctgatatccgggttcagatctatcatcaaaccagagtggattaggatgtttagcacccccgagctgcagcggctcatcagtggtgataacgcagaaatcgacctcgaggatctgaagaagcacaccgtttactatggaggctttcatggttcccacagggtgatcatctggctttgggatattctggcttctgatttcacgcctgatgaaagagccatgttccttaagtttgtcacctcttgtagcaggccccctttgcttggattcgcttacctgaaacccccttttagcatccgatgtgttgaggtgtccgacgaccaggacaccggcgacactctgggttctgtcctgcgcggatttttcaccatccggaagcgggagcccggtgggaggctccccaccagcagcacctgcttcaacctactgaagttacccaactactctaaaaagtctgtcctgagagaaaaacttcggtacgccatctctatgaacactgggttcgaactgagctag

SEQ ID NO: 60583 - DNA, 3207 bp, Artificial Sequence
  Description of Artificial Sequence: Synthetic coding sequence
atgtttactctaagtcagacttctcgggcatggtttatagatagagcacggcaggctagggaggagcgcctcgtacaaaaggagagggagcgggctgccgttgttattcaagcacatgtgcgctcctttctctgtcgtagccgactacaacgggacattcgcagggaaattgatgactttttcaaagcagatgacccagagtcaactaagcgctcagcactctgtatctttaagatcgcaaggaaactgttgttcctcttcagaataaaagaggacaatgagcgatttgagaaactgtgtcgcagcatcctctcgtccatggacgctgaaaatgagccaaaggtgtggtacgtctcccttgcctgctctaaggacctgacactcctatggatccaacaaataaagaatatcttgtggtattgctgcgatttcttaaaacaactcaagcctgagatccttcaggatagtagactcattaccctgtatctaacgatgctcgtgaccttcacagatactagtacctggaagattctgcgaggcaagggggagagtctgcgtccggctatgaaccatatctgcgcaaacataatgggacatcttaaccagcacggcttttatagtgtgttgcagattctgctgacacggggactggcccgacctcgcccatgcctttccaaagggactctcacagccgcttttagccttgctctgcgccctgtcatagctgcccagtttagcgataatctcattcgcccattcttaatccacatcatgtctgtgcccgcactggtgacacacctctctacggtgacccccgaacgtttaaccgtgcttgaaagtcacgacatgctgcgcaagttcattatatttctgagggatcaggacaggtgccgggacgtatgtgaatctctcgagggctgccacacactctgcttgatgggcaatctgctccacctgggttcattatccccacgagtgcttgaggaggagaccgacggctttgtcagtctcctgacccagacactgtgttactgcaggaaatacgtgtctcagaagaaaagtaatctgacacactggcatcccgtgcttggatggttttcacagagcgtggactatggactcaacgaatcgatgcaccttattaccaaacagctgcagttcttatggggcgtgcccctgattagaattttcttttgcgacatcctaagcaagaagctgctcgaatcccaggagcccgcacacgcccaacccgctagcccacagaacgtgctacccgtgaagagtctccttaagcgggcatttcaaaagagcgcctcggtgcggaacatcttgcgacccgttgggggtaaacgggtagactccgcagaggttcagaaggtgtgtaacatctgcgtcctgtaccagacctctctgaccaccctgacacaaattaggctgcagatcctgactggactgacttacctggatgacctgctccccaaattgtgggcattcatctgtgaactgggaccgcatgggggacttaaactgttcctggagtgcctgaataacgacaccgaggaaagcaaacagttgctggccatgctgatgttgttctgtgactgcagcagacacctgatcaccatcttggacgacattgaagtctacgaagaacagattagttttaaactggaggagctcgtaacaataagcagtttccttaattcgtttgtatttaagatgatttgggacggcatcgtcgagaacgctaaaggggaaaccttggagctgtttcagagtgttcatggttggttgatggtgctctatgagagggattgtaggcgcagattcacccctgaggaccactggctgcggaaggacctgaaaccatcagtgttgtttcaggaactggatcgtgatagaaagagagcccagcttatcctacagtatataccccacgtgattcctcacaagaacagagtgctcctgttccggacaatggtcacaaaagagaaagagaaactgggcctagtggagacgtcgtctgcaagtcctcacgtcacgcacataacgattagacgttccaggatgttggaggatggctacgagcagctgcggcagctgagccagcacgctatgaagggagtgatacgcgtgaagttcgtgaatgatttgggtgtagacgaggcaggcattgaccaagacggagttttcaaagagtttctggaggagatcattaagagggttttcgatcccgcactgaacctgttcaagacgactagcggtgatgaacgcctgtacccatcccccacctcttatatccacgaaaattatctgcaactgttcgaatttgtcggaaaaatgctcggaaaagctgtgtatgagggcatcgtcgtggacgtgcctttcgcatctttcttcctgtcccagctgttaggacatcaccacagtgtcttctattcttcagttgacgagctgccatccttagacagtgaattttacaagaacctgacttccatcaaaagatacgatggcgacatcactgaccttgggttaacgctgtcctatgatgaggacgtgatggggcagttggtttgccacgagttaatccccggtgggaagactataccagtcaccaacgaaaataagatatcttacattcacctaatggctcatttccggatgcatacccagatcaaaaatcaaacagccgcactgattagcgggtttcgctcaattatcaaacccgaatggattagaatgttttccacccccgaactccaacgacttatatctggagataatgccgaaattgatcttgaggatctaaagaaacacacggtgtattatggtggatttcacggttcacaccgcgttattatctggctgtgggacatcctcgccagcgacttcacacccgacgaaagagccatgttcctgaaattcgtgacgtcttgctcccgaccgcctctgctgggctttgcctaccttaagccacccttctccattcgctgcgttgaagtctccgacgatcaagatacaggagatacactcggtagtgtactccgcggattttttaccatcagaaagcgggaacctggtggcagactgcccacttctagcacgtgctttaatctgctgaagctgcctaactacagcaagaaatctgttcttagagagaaactgcgatatgccatcagcatgaatactggctttgaactatcatag

SEQ ID NO: 60584 - DNA, 456 bp, Artificial Sequence
  Description of Artificial Sequence: Synthetic coding sequence
atgttttcaacacctgagctgcagcgtctgatctctggagataacgctgagattgacctggaagacctgaagaaacatacagtctactacggcggattccacggtagccatagagtgataatatggctttgggacattctagcgagcgacttcacccccgacgaaagggctatgtttctgaaatttgtgaccagctgtagccggccaccacttttgggattcgcctatttgaagccgccattctcaatcaggtgtgttgaagtgagcgacgatcaacaaggaaggcagctcgatccttcagaaccatccgaggagggtccgacagttctgactgctggcgagcccgcttcgcctagggagaccgcacacggcttgtcccccctcagtgcagcgccttttagcttcctcccacaggggagggtgccaggcgtgggggtcggtacttgttgcttctag

SEQ ID NO: 60585 - DNA, 735 bp, Artificial Sequence
  Description of Artificial Sequence: Synthetic coding sequence
atgttcactttgagccaaacctctagagcctggtttatcgatagggctcgccaggcccgagaggagcggctggtccagaaggagcgtgagcgagcagctgttgtcatccaggctcacgttaggtctttcctgtgcaggagcaggctccaacgtgatattcgacgggagatcgatgactttttcaaagctgacgacccggagtccacgaaaagaagtgcactctgtatctttaaaattgccagaaaacttctgttcctttttaggattaaggaagataacgagcggtttgagaagctgtgccgaagtattctgagcagcatggacgccgagaatgaacccaaagtctggtacgtgtctctcgcctgtagtaaagatctgactctcctctggattcaacaaatcaagaacattctctggtactgttgcgatttcctgaagcagctgaaacctgagattttgcaggactccaggctgatcacgctgtatttgaccatgctcgtgaccttcaccgacacctccacatggaagatcctccggggtaaaggcgagtctttacggcctgccatgaaccacatttgcgccaatatcatgggacacctcaatcagcacggcttctattctgtgcttcagtgttgcgacggcttgttccctgacctggtgagctatgcccctcacaacaaccctgtgagatggagtgtgggcagaagttggtacgactggcaattgtcccgctag

SEQ ID NO: 60586 - DNA, 1017 bp, Artificial Sequence
  Description of Artificial Sequence: Synthetic coding sequence
atgaaaggagtcattcgcgtgaagtttgttaacgatctgggggtcgacgaagccggaattgaccaggacggggttttcaaagagtttctggaggagattattaaaagggtgtttgatccagctctcaatctcttcaagaccaccagcggcgacgagaggctttacccaagcccaacgtcttacattcacgagaactatttgcagttattcgagtttgtgggcaagatgttggggaaggccgtgtatgagggaatagttgtggacgtgcctttcgctagtttctttttgtcccaacttctggggcaccaccattccgtattctactccagcgtggacgagctgccttccttggattccgagttttataaaaacctgacatcaattaagcgttacgatggggacatcactgaccttggattgacactgagttacgacgaggacgtaatgggacagctggtctgccatgaactcatccctggcggtaagactatccctgtgactaacgagaacaaaattagctacatccatcttatggcccactttagaatgcacacccagattaagaatcagaccgccgctttaattagcggatttcgctctatcatcaaacccgagtggattagaatgttcagcacgcccgaattgcagagactgattagcggagataatgctgagattgatttggaagatctgaaaaagcacacggtctattatgggggattccacggaagccaccgcgtgatcatctggctctgggacatcctggccagtgatttcacacccgacgagcgggctatgttcctgaagttcgtgacaagctgctccagaccgccattattggggttcgcgtacctaaaaccccctttcagtattcgatgtgtagaggttagtgacgatcaggctgttcatgttcaggctcggtgcttcatctcctcactggccaagggcgaggggaagcctagcggattacggagtagcgtatgcctgaagcctggcccactgtgggtgctgaagtag

SEQ ID NO: 60587 - DNA, 2619 bp, Artificial Sequence
  Description of Artificial Sequence: Synthetic coding sequence
atgtttacacttagccagaccagccgggcttggtttattgatcgtgctcgacaggccagggaggaaaggctcgtgcagaaagaaagagaacgcgcagctgttgtgatccaggctcatgtgaggtcttttttatgccgctccagattacagagggatatacggagagagattgatgacttttttaaagccgatgatccggagagtactaagcgctcagcgctgtgtatttttaagattgccagaaagctgctcttcctgttccgcattaaagaagataatgagagatttgaaaaactctgccgcagcattctttccagtatggacgcagaaaacgagccaaaagtgtggtatgtctccctggcctgcagcaaagatctgacactgctgtggatccaacaaattaagaatatcctgtggtactgttgtgattttctgaaacagctgaagcccgaaattctccaggactctcgtcttatcacgctgtaccttactatgctggtgacctttacggatacttcgacgtggaaaatactgcggggaaaaggagagtctctgcgccctgctatgaaccacatctgcgcaaatattatggggcatttaaatcagcacggattctactccgtgctgcagatcctgctgacgaggggactagctagaccacgaccatgtttaagtaaggggaccctcactgccgcattctccctggcgctgaggcccgtgattgcagctcagttttctgataacctgattcggccatttctgattcacatcatgtccgtgcctgctctggtgacgcacttgagcaccgtgacacccgaacgactcacggtcctggagtcacatgatatgctacgcaaatttatcattttcttacgcgaccaggacaggtgcagagacgtttgcgaatccctcgaagggtgtcacacactgtgtctcatgggcaatcttttacaccttggaagtctctcgcctcgggtgctggaagaggagaccgacggattcgtctctctgttgacccagacactctgttattgtaggaaatatgttagtcagaaaaagtctaatttgacccattggcacccagtgctggggtggttttctcaaagcgtggactatggactgaacgaaagcatgcacctcatcacaaaacagctgcagtttctgtggggggttccactgatacgcattttcttctgtgacatcctgagcaaaaagctcctagagagccaagagcctgcgcatgcacagcctgcaagcccacagaacgtactgccagtcaaatctctgctgaagagggcctttcagaaaagtgcttctgtgcgcaacatcctaaggccagtggggggtaagagagtggacagtgcagaggtccagaaagtgtgtaatatatgcgtgctgtatcaaacatcgcttaccacgctgacccagatccgccttcaaatcttgaccgggttaacctacctagatgacctgctgcccaaactgtgggcatttatttgcgaactcgggcctcatgggggtctgaaactgtttctggaatgtctgaacaatgacactgaggaatcgaagcagctgctggccatgctgatgctgttttgtgattgctctcggcatctcatcacaatcctggatgacatcgaagtttacgaggagcagatttcatttaaactagaggagctcgtaacaatcagctccttcctgaacagctttgtgtttaagatgatttgggatggtatagtagaaaacgcaaaaggcgaaactctcgagctgttccaatcagtgcatggatggctgatggtcctgtatgagagggactgcagacgacgatttacacctgaggaccactggttacgcaaagatctcaagcccagtgtgctcttccaggaactggatcgtgatcggaaaagagcacagcttatcttgcaatacatcccacatgtgatcccacataagaatcgcgtgttactgttccgaacgatggtcacaaaggaaaaggagaaactggggctagtggagacaagctctgcttcccctcacgtgacccacatcacaatcagacgcagcagaatgctcgaagatggatacgagcagctgcggcagctgtctcagcacgctatgaagggcgtgattcgagtgaaatttgtcaacgacctgggcgtggatgaagccggtatagaccaggacggggtcttcaaggagttcttagaggaaataattaagcgcgttttcgacccggcactcaatctgttcaaaacaacttcaggagatgaaaggctatatccttcgcctacgtcctacatccatgagaactacctgcaactgtttgagttcgtgggtaaaatgctcggaaaggctgtttatgaggggattgtagtcgacgtgccgttcgccagtttctttctgtcccagctgcttgggcaccaccacagtgttttctatagctctgtcgatgagttaccctcactcgatagcgagttctacaagaacctgaccagtatcaagagatacgatggagatattaccgacttgggcttaaccctgtcttacgatgaggacgtgatgggacagcttgtgtgtcacgaactgattcccggagggaaaacgattccagtcacatag

SEQ ID NO: 60588 - DNA, 735 bp, Artificial Sequence
  Description of Artificial Sequence: Synthetic coding sequence
atgttcacactaagccagacctcacgagcctggtttatcgacagggcccgacaggctcgcgaggaacgattggtgcagaaagagagagagcgagcggcagtagtgatacaagcacacgtccggtctttcttgtgccggagtcgactgcagcgggacattcggagggagatcgacgatttcttcaaagctgacgatcctgagtctacgaagcgttccgccctttgcatctttaagattgccaggaaattacttttcctttttaggatcaaagaagataacgaacgctttgagaaactctgtcggtccatcctttccagtatggacgcagagaatgagccgaaggtctggtatgtgagcctcgcttgctctaaggatctgaccctgctgtggattcagcagatcaagaacatcctctggtactgctgtgattttctgaaacaacttaaacccgagatcctgcaggatagtcgcttgatcaccctctacctgactatgttggtgacgtttacggacacctcaacgtggaaaattttgcgcggaaagggggaatcactgcggccagccatgaatcacatatgcgccaatatcatgggtcatttgaaccaacacgggttctattcagtcctccaatgctgcgacggtctcttccccgacttagtctcctatgcgccacataacaacccagtacgttggtccgtaggtcggtcctggtacgactggcaactgtccaggtag

SEQ ID NO: 60589 - DNA, 2946 bp, Artificial Sequence
  Description of Artificial Sequence: Synthetic coding sequence
atggcggagggaggtgccgctgacctggacacacagcgctcagatattgccacattactgaaaacttcacttaggaagggcgacacctggtacttagtggacagtcggtggtttaagcaatggaaaaagtatgttggattcgatagttgggacaagtaccaaatgggagaccagaatgtgtatccaggacctatcgataatagcggactactgaaggacggagatgctcagtctctgaaggaacatctcatcgacgagttagattatattttactgcccaccgaagggtggaacaagctggtttcctggtataccctcatggaaggacaagagcctattgccaggaaagtggtcgaacagggaatgtttgtgaagcattgcaaggtagaggtatacctcactgaattgaagttatgcgagaacggcaacatgaataacgttgtgactcggagattctccaaagcagataccatcgatacaattgaaaaggaaatcagaaagatcttctccattccagacgaaaaagaaacacgcttgtggaacaagtacatgtcaaatacattcgaaccactgaataaacccgatagcaccatccaggacgccggactataccagggtcaagttctggtaattgaacagaagaacgaggacggaacgtggcctcgaggcccatcaaccccgaagtcccctggagccagtaacttctcaaccctgccaaagatcagtcccagctctctgagcaataattataacaatatgaataatagaaatgtgaagaactctaattattgcctgccttcttataccgcttacaaaaactacgactacagcgaacccggacgaaacaatgagcagcctggcctctgtgggcttagcaatctcggaaatacgtgctttatgaattcagctatacagtgcctgtctaatactcctcctcttaccgaatacttcctgaatgacaaatatcaggaggagctgaatttcgacaaccccctcgggatgagaggggaaatcgccaagagctatgccgaactgattaagcaaatgtggtctggcaagttcagctatgtgacaccaagagcctttaaaacccaagtcgggaggttcgctccacagttctcgggctatcagcagcaagactgtcaggagctgctggcattcctgcttgacggtctacacgaggatttgaaccggatccgcaagaagccatacattcagctgaaggacgcggacggccgtcctgataaggtggtggctgaagaggcatgggaaaatcatctgaagcggaatgattccatcatcgtcgacattttccacggcctgttcaagagcaccctcgtgtgtcctgaatgcgccaaaatcagcgtgactttcgaccccttctgctacctaaccctgccattgcccatgaagaaggaacgcaccttggaagtttatttagtgagaatggaccccctgactaagccaatgcagtacaaagtggttgtgccgaagattggcaacattttggatctctgtacagccttgtcagccttgtccggcataccagccgacaaaatgatcgtaacagacatttataatcataggttccacaggatttttgcaatggacgagaaccttagtagcattatggaacgagatgacatttatgtctttgagattaacatcaaccgcaccgaagacaccgagcacgtgataatccccgtctgtctgagagagaagtttagacactcttcttatactcaccatacagggagttctctgtttggacagcccttcctaatggctgtgcctagaaataacactgaagacaaattgtataatcttctactgctgaggatgtgtcggtatgtcaaaatatctacagaaactgaggagacagaaggaagcttgcactgttgcaaggaccagaacattaacgggaacgggcctaatgggatccacgaggaggggtctccctctgaaatggagacagatgagccagacgacgagagttcccaggatcaggaattgccttcagagaacgagaactcccagtccgaggactccgttggcggagataacgacagcgagaacggcttatgcacggaagatacttgtaaagggcaactgacaggacacaagaagcgactgttcacgttccaatttaataacctgggaaacaccgatattaattatatcaaagacgatacaaggcacatccgatttgatgatcgccaactgcgtctggatgagagatccttcctggctctggattgggacccagaccttaagaagaggtacttcgacgagaatgctgctgaggattttgaaaagcatgagtcagtcgagtataagccgcctaagaagcctttcgtaaagctcaaggactgcattgaactgttcactacaaaggaaaagctgggggctgaagacccctggtattgtcctaactgcaaggagcatcagcaagcaacgaaaaaattggatctttggtccctgccccctgttctggtggtgcacctgaagcgattttcatatagtcgctacatgcgggataagctggacaccctggtcgatttccctattaacgacttggacatgtccgagttcctgattaatccgaacgccggtccttgtcgttataacttaatcgctgtgagcaaccattatgggggaatgggcggagggcactatacagcattcgccaagaataaggatgacggcaagtggtactactttgacgatagttccgttagcaccgcctccgaggatcaaatcgtgtctaaggctgcctatgtgcttttttaccaaaggcaagacacattttccgggacaggatttttcccacttgacagagagactaagggtgcctccgcagctacaggtatacccttagaatccgatgaagacagcaacgataacgacaatgatattgagaatgaaaattgcatgcacaccaattag

SEQ ID NO: 60590 - DNA, 2859 bp, Artificial Sequence
  Description of Artificial Sequence: Synthetic coding sequence
atggccgaagggggagcagctgatctcgatacacagaggtccgatattgccaccttactgaaaaccagcctgaggaagggcgatacctggtacttggttgacagccgttggtttaaacagtggaagaaatacgtagggttcgacagctgggacaaataccagatgggggaccagaatgtgtatccaggcccaatcgataacagcgggctcctcaaggacggcgacgcccagagcttgaaggagcacctgattgacgagctggattatatcttgctccccaccgaaggctggaataagctcgtttcatggtacaccctcatggaaggtcaagaacctatcgcccgaaaagtagtcgaacagggtatgttcgtgaagcattgcaaagtagaggtgtatcttaccgaattgaaactgtgcgaaaacggtaatatgaataacgttgtcactagaagattttcaaaagctgacaccattgatacaattgagaaagagataaggaagatcttctccatccctgacgagaaggagactcgcctttggaacaaatatatgtcaaatacgttcgagccattgaacaaaccagattctacaatccaggatgcaggactgtatcaggggcaggtgctcgtgatcgagcagaagaatgaagacggcacatggccaagaggaccctcgacccccaatgtgaaaaatagcaactattgtcttccttcctatactgcctacaagaattacgactactcggaaccaggtcgcaacaatgagcagccaggcctctgcggattaagcaacctcggaaacacctgttttatgaactctgccattcagtgtctctctaacaccccccctcttacagagtatttcctcaatgacaagtaccaggaagagctgaattttgacaaccccctaggcatgcggggtgagatcgccaagtcctacgccgagttaatcaagcagatgtggtctggtaagttttcttatgtaacacctagggcattcaagacacaggtggggagatttgccccacaattctccggttaccaacaacaggactgtcaggaactgcttgcctttctgcttgatggattacacgaggatctgaaccggattagaaaaaaaccttatatacagttgaaggacgctgacggccgaccggataaggtcgtggcggaggaggcctgggaaaatcacctgaaacgaaatgatagcattattgttgacatcttccacgggcttttcaagagcactcttgtttgcccagaatgcgctaaaatatcggtgactttcgatccgttctgctacctgactttgccactgccaatgaaaaaagagagaacactggaggtctacctggtcagaatggaccccctgaccaaacctatgcagtataaagtagtcgtccctaaaatcggcaacatcctcgacctgtgtaccgctctctcggccttaagcggtattcccgcagataagatgatagtaaccgacatatacaatcatcggtttcacaggatttttgccatggatgaaaatttatcttccatcatggagcgggatgatatttatgtgtttgagatcaacatcaacaggacagaagataccgagcatgtgattatcccagtttgcctgcgggagaagttcaggcattcaagctacacacaccacaccggcagtagtctatttggacagccattcctcatggctgtcccccgtaataacaccgaggataaactttataacttattgctactgcgtatgtgccggtacgtcaagatctccaccgagaccgaggagacagagggcagccttcactgttgtaaagaccagaatatcaatggcaacggacccaacgggatccatgaagagggctctccctccgaaatggaaacagatgagcctgacgatgagtccagccaagatcaggagctgccctcagagaatgagaactctcagagtgaagatagcgttgggggagacaacgattccgagaacggcctgtgcactgaggatacatgcaaagggcaactgacgggacacaaaaaaagattattcacatttcaatttaataacctcggaaatactgacatcaactatatcaaagacgatactcgtcacatcagattcgacgatagacaacttaggcttgacgaaaggagcttccttgccctcgactgggatcctgacttaaagaagcgatatttcgatgagaatgctgccgaagactttgagaagcacgagtctgtcgagtataaaccacccaagaagccatttgtgaagcttaaggattgtatagaactctttactactaaggaaaaattgggcgcagaggacccctggtattgtcctaactgcaaagaacaccaacaggctacaaagaaattggacctgtggtctctcccgccagtgctggtggtacacctaaagagattttcgtactcccgttacatgcgcgacaagttggatactcttgtggacttcccgatcaacgacctggacatgtcagagttcttaataaatccaaatgcaggcccttgcaggtacaatctgatcgctgtctcgaaccactacggaggaatgggtggcggtcactacactgcgtttgccaaaaataaagacgacggaaagtggtactattttgacgattcttcagtgtcgaccgccagcgaggaccagatcgtttccaaagctgcttacgttctattctatcagaggcaggatactttctcaggtaccggattctttccactggaccgtgagactaaaggagcaagcgcagccactgggatccccctggagtcagatgaggactctaatgacaacgacaatgacatcgagaacgaaaattgcatgcatactaattag

SEQ ID NO: 60591 - DNA, 2871 bp, Artificial Sequence
  Description of Artificial Sequence: Synthetic coding sequence
atggccgagggcggagctgcagatctcgacacgcaacggtccgacattgctacactgctgaaaacttccctgcgtaagggggatacttggtatttagtggatagtcgctggtttaaacagtggaaaaaatacgtggggtttgattcctgggataagtaccaaatgggcgaccagaacgtctatcctggtcccatagacaatagtggccttttgaaggatggcgacgcccagagcctgaaggagcacttaatcgatgagttggattatatcctgcttcctacagaaggttggaataaactagtgtcgtggtatacgcttatggaaggccaggaaccaatcgcccgaaaagtagtagagcaagggatgttcgtgaagcattgtaaagttgaagtttatctaactgaactcaaactttgcgagaacggtaacatgaacaatgtggtgacccggagattttccaaggcagacaccattgacacaatagagaaagaaattcgtaaaatattctctatacccgacgaaaaagagactagattgtggaacaaatacatgtcgaatacttttgaacctctgaataaaccagacagcaccatacaggatgccggactctatcagggacaggtcctttttattgtgctcgtgattgagcagaagaacgaggacggaacgtggccgagagggccaagcacccccaatgttaaaaattccaactactgtctaccctcctacacagcctacaaaaattacgattactcagagcctggccgtaacaacgaacagcctggcctgtgcggcctctctaacttaggcaacacctgctttatgaatagtgccatacagtgcctatcgaacacccctcctctgacagagtattttctgaacgacaagtaccaggaggaactgaatttcgacaacccgctgggtatgagaggagagatcgcgaagtcctatgccgagctgatcaagcaaatgtggagtggcaagtttagttacgttactcctagagccttcaagacccaggttggtaggtttgccccacagttttccggctatcagcaacaggattgccaggaacttctggcattcctgctggacggccttcacgaggacttgaacaggattcgaaaaaagccctatatccaactgaaagacgcagacggccgtcccgataaggtggtagccgaggaggcttgggaaaaccatctcaaaaggaacgactctatcatagtggatattttccatgggctgtttaagtctaccctggtctgccctgaatgtgcaaagatttccgtcacatttgatccattttgctacctcactctgccactgcccatgaagaaagaacgcacgctggaagtgtatctggtgcggatggatcccctgaccaaaccaatgcagtataaagtggtggttccgaagattggcaacatcttagatctgtgcaccgcgttgtctgccctgtctggtattcctgcagataagatgatcgtcactgacatatataatcaccggttccacagaatattcgccatggacgagaacctctcatccattatggagcgagatgacatctatgttttcgaaatcaatatcaatcgcacagaagacaccgagcatgttatcatacctgtctgtttaagagagaagttccggcattccagttacacacaccatacaggctcctccttgttcggccagccctttctgatggcagttccacgcaataacactgaggataagttgtataacctgctgctcctccgaatgtgccgatacgttaagatctccacagaaactgaggaaaccgagggctcgctgcactgttgtaaggatcaaaacatcaatgggaatggcccaaacggtatccatgaggaggggtctccctctgaaatggagacagatgaacccgatgatgaatcttctcaggaccaggagttacccagtgagaatgaaaattctcagtcagaggattccgttggcggagataatgacagcgaaaacgggttatgtactgaggacacatgcaaaggacaactcacaggtcacaaaaaacggttgttcaccttccagtttaacaatctcgggaatactgacatcaattacattaaggacgacacccgccatatcagatttgacgatcgacagctcagactcgacgagaggtcttttttggcccttgactgggatccagatcttaagaaacgctactttgatgaaaacgccgctgaagattttgaaaaacatgaatccgtggaatacaaaccgccaaagaaaccattcgtcaagctgaaggattgcattgagctcttcactaccaaagagaagttgggagccgaggatccctggtactgccctaactgtaaggagcaccagcaggcgaccaaaaaactcgatctgtggtcattaccccctgtactggtagttcacctcaaaagattcagttattcacggtacatgagagataagttagatacacttgtggactttcccataaacgacctggatatgtccgaatttttgattaatcctaatgctggcccatgcaggtataacttaattgcggtatcaaaccactacggaggcatgggcggagggcattataccgcatttgctaagaacaaggacgacggcaaatggtattacttcgacgattcctcagtctcaacagcatcagaagaccagatcgtgtctaaagcagcatacgtccttttctatcaacggcaggatacctttagtggcaccggcttttttcctcttgatagagagacgaagggagcttcagccgcaacgggaattccccttgagagcgatgaagattctaatgacaatgacaatgatatcgaaaatgagaactgcatgcacactaactag

SEQ ID NO: 60592 - DNA, 708 bp, Artificial Sequence
  Description of Artificial Sequence: Synthetic coding sequence
atggctgaagggggagctgcagatcttgatacgcagcggtctgacatcgccactctgctgaaaacctccctccggaaaggcgatacctggtatctggtggactctcgctggtttaaacagtggaagaaatatgtcggtttcgacagctgggacaaatatcagatgggtgaccagaacgtgtatcccggacccattgataacagcgggctgctgaaagacggggacgctcaaagtctgaaagagcatctgattgacgaacttgactacatactactgcctacagagggatggaacaagctcgtgagctggtacacattgatggaagggcaggagcccattgccaggaaggtggtcgaacagggaatgttcgtcaagcactgcaaggtcgaggtgtatctgacagaactgaagctttgcgaaaacgggaacatgaataatgtggtcacacggaggttcagcaaggcagatactatcgacacaatagagaaggagatcagaaaaatatttagcattcccgacgagaaagaaacccgtctgtggaacaagtacatgagcaacacattcgaaccactcaataagcctgacagcactatccaggatgctgggctgtatcagggtcaggtactagtgattgagcagaaaaacgaagatggaacatggcctcgaggtccttcaacccctaagaaaccattggaacagagctgttag

SEQ ID NO: 60593 - DNA, 2769 bp, Artificial Sequence
  Description of Artificial Sequence: Synthetic coding sequence
atgatcagcctcaaggtgtgtggcttcattcagatttggagccagaagaccggaatgactaaacttaaggaagctttgatcgaaacagtgcaaaggcaaaaggagataaagctcgtcgtcactttcaaaagcgggaagttcatccggattttccagcttagcaataacattcgaagcgttgtgctaaggcactgtaagaagcggcagagtcacttacggcttacattgaagaacaacgtattcctgtttatcgataagctttcctacagggacgccaaacagctgaatatgttcctcgacattattcaccagaataaaagccaacagcccatgaagagcgacgacgactggagcgtattcgagtcccgaaatatgctgaaggagattgacaagacttcgttttactccatctgcaataaaccaagttatcagaaaatgcctctgtttatgagcaagagccccacccatgtgaaaaagggaattctggagaaccagggaggcaagggtcaaaatacgctttccagcgacgtccaaaccaatgaggacatcctgaaagaagataatccagttcccaacaagaagtacaagaccgacagcctgaaatatatccagagtaacagaaaaaacccctcctccctcgaggacctggaaaaggaccgcgaccttaagctaggaccctcgtttaataccaactgcaacggcaatccaaaccttgatgagacagttctggccacccagactctcaatgcaaagaacggactgacctctcccctggaaccagaacactcacaaggggaccctcggtgtaacaaagcccaggtaccactggactcccactctcagcagctgcagcaagggtttcccaacctgggtaacacttgctatatgaatgcagtcctccagtcactttttgccattccctcttttgcagatgacctgttaacccagggggtcccatgggagtatatcccttttgaggccctcataatgacacttacccagctgctggccttgaaagatttttgtagcacaaagatcaaacgggagctcttgggcaacgtaaaaaaagtgattagtgctgtggccgagatattttcaggtaacatgcagaatgacgcacacgagtttctgggtcaatgtcttgatcagctcaaggaggatatggaaaaattgaacgcaaccctgaacactgggaaggagtgtggagacgagaatagctcccctcagatgcatgtgggcagcgccgctaccaaagtcttcgtctgtccggttgtggccaattttgagttcgaattacagctcagcctcatatgtaaggcctgtggacacgccgtgctcaaagtggagcccaacaactatctgagtataaatctgcatcaggagaccaaacccctgccactgagcatacagaattcgctggatctgttcttcaaagaggaagagcttgagtataactgtcagatgtgcaagcagaaatcatgcgtcgcccgacacacgtttagcagattatcccgagtgctgatcatccatctaaagcggtactcttttaacaacgcttggttgcttgtaaaaaacaatgaacaagtatacatcccaaagtcattatctctgtccagctattgcaacgaatctaccaagccgcctctgcctctctccagctccgcccctgttggaaagtgtgaggttctggaggtgtctcaagaaatgatctccgagattaattcccccctcacaccttcgatgaagctaacttctgaatcatcagattccttggttctgcccgtggaacccgacaaaaatgccgatttgcagcggttccaacgcgactgcggagacgccagccaggaacaacaccagcgagacttagagaatggatctgctctcgagtctgagctcgtacactttagagatcgggcaatcggggaaaaggagctccctgtggcagattccctcatggatcagggcgacatttccctgcctgtgatgtacgaggatgggggaaagcttattagttctcccgatactcgactcgtagaggtgcacctgcaggaggtccctcaacacccagagctgcaaaaatacgaaaaaactaacacgttcgtcgaattcaatttcgattccgttacagagtccacaaacgggttctatgattgcaaagagaaccgaatacccgaaggttcacaggggatggccgaacagctacagcagtgcatagaagaaagcatcatcgacgaattcctgcaacaggcgcctccaccaggagtccgtaagctcgatgcccaagagcacaccgaagagactctgaatcagagcaccgagctccggctccagaaggctgacctgaaccacctcggggcactgggatctgataaccctggtaataagaatatcctcgatgccgaaaatactcggggagaggccaaagagctgacccggaatgtcaaaatgggagatcctcttcaggcataccggctaatctccgttgtgtctcacatcggaagctctcccaactcaggccactatatctcagacgtctacgatttccagaagcaagcctggttcacgtataacgatttgtgcgtgagcgaaattagcgagacaaaaatgcaggaagccagattacattctggctacatcttcttctatatgcacaatgggatttttgaggaactgttgcggaaagctgaaaattcccggctgccttctacccaggccggagttattccacagggggaatacgaaggggactctctttatcgtccagcttag

SEQ ID NO: 60594 - DNA, 786 bp, Artificial Sequence
  Description of Artificial Sequence: Synthetic coding sequence
atgtccggtgagattgctatgtgcgagccggaattcgggaatgacaaggctagagagccctccgttggagggagatggcgcgtgagctggtatgaacgcttcgtgcagccctgcctcgtcgagctgcttggatcagccctgttcattttcattggatgcctctctgtgatcgagaatgggactgacaccggtctgctgcagcccgctttagcacacggactcgcactgggactagtgattgcaactctcggaaacatatcgggcggacatttcaatcctgcagtttctctcgctgccatgctaattggaggcttgaatcttgtgatgttattgccatactgggtctcacagctgcttggcggaatgctgggcgctgccctggcaaaagctgtgtccccggaagaacgattctggaatgcatctggggctgctttcgtcactgtacaggagcaaggacaggtggctggcgcactggtcgccgagattatacttaccaccttgcttgctttggcagtctgcatgggcgctattaatgagaagaccaagggacccctggcacctttttcaatcggctttgcagtgactgtggacatattagccggaggtcccgtcagcggaggatgtatgaacccagctcgtgccttcgggccagctgtggtggccaaccactggaatttccactggatttactggttggggcctctcctcgccggactgttggtggggctcctcatccgttgctttatcggcgatgggaagaccaggttgatattgaaggctagatag

SEQ ID NO: 60595 - DNA, 1332 bp, Artificial Sequence
  Description of Artificial Sequence: Synthetic coding sequence
atgagccagcgcgatggggtgtgtggttcacatgaggttgcaggcgcagccagtcctggcgcagatggcggactctccctggcggcatattgcaaaaactcggttgacggactttggtactgtttcgacgacagtgacgtgcagcagctttcggaggacgaagtgtgtacccagaccgcctatatcctcttctaccaacgtcgtacagctatcccttcgtggagcgccaattcctccgtggcaggatccacatcctcgagcctgtgtgagcattgggtcagccgtctgcctggaagcaaacccgcaagcgttacttccgccgcttccagcaggcggacttcacttgcctctttgtctgagagcgttgagatgactggggagcggtctgaggatgatggcggtttttcgactaggcctttcgtgcgatcagtccaacggcagagcctcagcagccgaagcagcgtcacatcccctctggcggtgaacgaaaactgtatgagacccagctggagcttaagtgctaaactgcagatgaggtcaaattcgccatctcgcttttctggtgattccccaattcacagttctgcctctacactggaaaagataggagaagccgctgatgacaaggtgagcatttcctgcttcggatctctaaggaatctgtcttcttcgtatcaggagccgtccgatagtcacagtaggcgagaacacaaggctgtgggacgcgctcctcttgccgtgatggagggggtctttaaagatgagtctgatacacgcaggttgaactcctccgttgtggatacccagtccaagcattccgctcagggtgaccgcctgccccctctcagtggccctttcgataataacaatcaaatcgcatatgtggaccaaagtgattctgttgactcttcaccagttaaagaggtaaaggctccatctcaccccggttcactggccaagaagcccgaatctacaactaagcgatcaccctctagtaagggcaccagcgagcctgaaaagtccttacggaaagggaggcctgcgctcgcttcgcaggagtcaagtctgtcatcaacatccccctcgagccctttgcccgtgaaggtgtcccttaaacctagtcgctctaggtccaaagcagattcctcgagccggggttcagggaggcacagctcccccgctcccgctcagactcagttcccttcgggcgagcctggaccttcacggggagggcagggagggagggaggcgcgagctgagctcctgcatggccagcccgctctcccacagcacaaacatcaggtgtggttcgaagaaggacaacaggtctag

SEQ ID NO: 60596 - DNA, 10185 bp, Artificial Sequence
  Description of Artificial Sequence: Synthetic coding sequence
atgaggaggaagaacagctactacgtctggcagatctttcagattcaatttcctctgtacacagcttacaagcacaacacccacccaaccatagaagatatcagcacacaggaaagcaatattttaggcgctttttgcgatatgaatgatgtggaggtgccattgcacctgctgaggtacgtgtgcctgttttgcggcaagaacggtctgtcccttatgaaggattgcttcgagtatgggacaccagaaactttgccattcttgatagcacacgcgtttattactgtggtgtccaatatacgcatctggctgcacatacccgcagtcatgcagcacataattcccttcaggacatatgtcatacgctacttgtgtaagttgtcagaccaggaactgcggcagagtgctgcccgaaatatggccgacttgatgtggtcaactgtcaaggaacctctggataccactctgtgtttcgacaaagagtcgctagatttggcgttcaagtacttcatgagcccaaccctgactatgcgactggccggactgtcccagattacaaaccagttgcatacattcaacgacgtgtgcaacaatgagtccctggtttctgacaccgagacatccatagccaaagaattggcagactggctcatcagcaataacgtcgtggagcacatctttggccctaatttgcatatcgagatcatcaagcagtgccaggtcatactcaatttcctggcagctgaaggcaggctctctacacagcacatcgattgcatttgggccgctgctcagctcaaacattgtagtcgctatatacatgacctctttcctagtctcattaagaatctggatcctgtccccttgcggcacctgctcaatctagttagcgcacttgaaccctctgtccacacggaacagacactctatctggcttctatgttgatcaaggcgctctggaacaatgctctcgccgcaaaggcacaactctctaaacagagttccttcgccagcctgttgaacactaatatccccataggcaacaagaaggaagaagaagagctgcgcaggacagctcctagcccttggtcgccggctgcctcacctcagtccagcgataatagtgatacacaccagagcggcggatcagatattgaaatggacgagcagttgatcaacaggactaagcacgtccaacagcgcctttccgataccgaggaatcaatgcagggatcttccgatgagactgcaaacagcggtgaggacgggtctagcggcccaggaagctcctctgggcattcagacgggagctctaacgaggtgaattctagtcacgctagccagagcgcagggtctcctggaagcgaagtgcaaagcgaggacatcgccgatattgaagcactcaaagaagaagacgaggacgatgatcatgggcacaacccacccaagtcaagctgcggcacagacctgagaaatcggaagctcgagagtcaggctggcatctgccttggcgattcgcagggcatgagcgagcgcaacggaacatccagcgggactgggaaagatctagtgttcaacacggagagcctgcctagcgttgacaaccgcatgcggatgttggatgcttgttcccattcagaagacccggagcacgacattagcggcgaaatgaacgccacccatatcgctcagggcagccaggagagttgcatcacccgaacgggcgatttcctgggtgaaactattggcaatgagctgtttaactgcaggcaatttattggaccccagcatcaccatcatcatcaccatcaccatcaccatcacgatgggcacatggtggacgacatgctgagtgccgatgatgtgtcatgttcatcttctcaagtgtctgccaaaagcgagaagaatatggctgacttcgacggcgaggagtctggctgtgaggaggagcttgtgcagattaactcacatgccgaactaacaagtcatctgcagcaacatctgcctaacctggctagcatttaccacgaacacttatcacagggccctgtggtccataagcatcaattcaattctaatgccgtgaccgacattaatctggacaacgtgtgcaagaaggggaacaccctcctgtgggacatagtccaggacgaagacgcagtgaatctgagtgaaggattgattaacgaggccgaaaaattgttgtgtagcttggtttgctggttcacagatcgacaaatcaggatgaggtttatagaaggctgccttgaaaacttgggcaacaaccgcagtgtcgtgatctctcttaggctgctacccaagctgttcggcactttccagcagttcgggtcttcctatgacacccactggatcactatgtgggctgagaaagaattaaatatgatgaagctcttttttgacaacctcgtgtattatatacagacggtgagagaaggcaggcagaagcacgcattatattctcattccgccgaggtacaggtgcgcctgcaatttctaacctgcgtgttcagcacgctaggatcgccggatcactttagactcagtcttgagcaggtggatattttatggcactgtctggtggaggattccgagtgctatgatgatgctcttcactggttccttaaccaagttcggtccaaggaccaacacgctatggggatggaaacctacaagcatctcttcctggaaaaaatgccccagctgaagcccgagaccatttcaatgaccgggttaaacctcttccagcacctctgcaacttggcacgtctggctacgagtgcctacgatggttgctctaactctgaactgtgtggaatggatcaattttggggaattgccttgcgggcacagtcaggagacgtatctagggccgcaatacaatatattaactcgtactatattaacggcaaaactggacttgagaaagagcaggagtttatttcaaagtgtatggagagcttaatgattgcaagcagttctctggaacaggaatctcacagttcccttatggtgatcgagcggggactcctcatgttaaaaactcacctggaagccttcaggagacgatttgcctatcatctgcggcagtggcagattgagggaaccggcatctcgagtcacttgaaggcactctctgacaaacagagtcttccactcagggtcgtgtgccagcctgctgggctgcccgataagatgaccatcgaaatgtacccctcggatcaggtggccgatctgagggccgaggtgactcattggtacgagaacctgcagaaggaacagatcaaccagcaggcacagttgcaggaattcgggcaaagcaaccgcaaaggagaatttcctgggggtttgatgggccctgttcgcatgatatcttcaggccacgagttaacaacagactatgacgaaaaggccctacacgaattgggattcaaggacatgcagatggtcttcgtatccctgggagctccacggcgtgagcgcaagggcgagggcgtacagctcccggcttcatgtcttccgccacctcagaaggataatataccgatgctgctcctactgcaggagccccaccttaccacgctgttcgacctcttagagatgcttgcaagctttaagccacccagcggcaaagtagcggtagacgactccgaaagcttgcgctgcgaggaactgcatctacatgcagaaaatttgtccaggagggtttgggaattactgatgttgttgcccacctgccctaatatgctgatggcctttcaaaacatctccgacgagcagtctaacgacgggttcaactggaaagagctgctgaagattaagtctgctcacaagctgctgtacgcactggagattattgaggcactggggaaaccaaaccggaggatacggcgtgagagtaccggctcctattctgatttgtaccccgacagcgatgatagcagcgaggaccaggtagaaaactctaagaattcatggtcctgcaaattcgtggcagccggtgggttacagcagctcctcgagatctttaactccggtatcctcgaaccgaaggaacaggagtcttggaccgtatggcaactggattgcctggcttgccttctaaaactgatctgtcaattcgccgtggacccatccgacctcgacttagcgtatcacgatgttttcgcatggagcggcatcgccgaatcccacagaaaacgaacgtggcctggaaagagccgaaaggcagcgggagaccatgcaaaaggcctgcacataccacgccttaccgaggtgttccttgtactggtgcagggcacaagtctcatccagaggttaatgtctgtggcttacacatatgataacctagcacccagagtcttgaaggctcagtccgatcatcgatcgaggcatgaagtctctcactattccatgtggttgctggtctcctgggctcactgctgctccctcgtgaaatcaagcctggccgacagtgatcacctgcaagactggctgaaaaagctgaccctgctaatacctgagaccgcggtccgccacgagagttgcagcgggttgtacaaactgtcactgagtggcctggacggaggagacagcatcaacagatctttcctgctgctggccgctagcacactgctcaagttcctccccgacgctcaggccctgaaaccaattagaatcgacgattacgaggaggagcccatccttaaacccggatgcaaagagtacttttggctgctttgcaaactggtggataatatccacattaaggacgcctcccagactaccctattagacctggacgctctggcgagacatttagccgattgcatccgcagcagagaaatattggatcaccaggatggcaatgtggaagacgatggcttgacaggcttgttgcggctcgcgacaagcgtggtgaaacacaagccaccatttaagtttagccgggaaggtcaggagttcctgcgggacatcttcaatctgctttttcttctccccagtttgaaggatagacagcaaccaaaatgtaaatcccatagttcacgagccgcagcctacgatctgttggtggaaatggtaaaaggtagtgtggaaaactacaggttaattcacaactgggtcatggctcagcacatgcagtcacacgctccttataaatgggactactggccccacgaagacgtgcgcgctgagtgccgatttgtgggcctcaccaacctgggagctacctgctatctggcctcaaccattcagcaactttatatgatccccgaagccagacaggctgtcttcacagctaaatactcagaagatatgaaacacaagaccaccctcctggaactacagaagatgttcacgtaccttatggagagtgagtgtaaagcttataatccaaggccattttgtaagacatacactatggataagcagccactgaacacgggggagcagaaagatatgacagaattctttactgatctgatcacgaagatcgaggaaatgtcccccgagctgaaaaacaccgtaaaaagtctttttgggggagtgataacaaacaacgtcgtatcacttgattgcgagcatgtgtcacaaactgccgaggaattttacacagtcagatgtcaggtggctgatatgaagaacatctatgagagccttgatgaggtgacaataaaagacactctggagggtgacaacatgtacacctgctcccactgcgggaagaaggtgcgggctgaaaaaagagcctgttttaaaaagttaccccgtattcttagctttaacactatgagatatacctttaatatggttaccatgatgaaagagaaggtgaatacccacttttccttcccgctgcgacttgatatgacaccttatactgaagacttcctgatgggcaagtctgagaggaaagaaggctttaaagaggtcagtgatcattccaaagacagtgaaagctatgaatatgaccttatcggcgtgactgtgcatactggaactgccgatggaggtcattactatagctttatcagagacatcgtcaacccccatgcctataagaataacaaatggtaccttttcaacgacgcggaggtgaagccctttgatagcgcgcagcttgctagtgaatgcttcgggggtgagatgacaaccaaaacctatgactcagtcacagacaagttcatggatttctcctttgagaagacacactctgcatacatgcttttttacaaacggatggagccagaggaggaaaatgggcgagagtacaaattcgacgtgtcatcggaactgctggaatggatatggcacgataatatgcagttcttgcaagataagaatatctttgagcacacttacttcggttttatgtggcagctgtgttcctgcatcccatccacattacccgatccaaaagctgtctcactgatgaccgctaaattgagcacatcttttgtgttggagacgttcattcatagcaaggagaagcctaccatgctacagtggatcgaacttctaacaaagcagtttaataactcccaggctgcttgtgagtggttccttgaccggatggcagacgacgactggtggcctatgcagattctgatcaagtgtccaaaccagattgtgaggcaaatgttccagagactctgcattcacgttattcaacgtttgagacccgtccacgcccacttgtacctccagccaggaatggaggatggaagcgatgatatggacacttcggtggaagatattgggggacgcagttgcgtaacacgcttcgtcaggacgctgttattaatcatggaacacggggtaaaaccccactctaagcatttgaccgaatatttcgcctttctgtacgaattcgctaagatgggggaggaagaatcacagttcctcctgtccctacaagctatctctactatggtgcatttctatatgggaaccaagggaccagaaaaccctcaggtcgaggttctctctgaagaggagggcgaagaagaggaggaggaagaagacattctgtcactcgcagaggaaaaatacaggcctgccgcactggagaaaatgatcgcactcgtggcactgctggttgaacagagtcgtagtgaaaggcatttaaccctgagtcagactgatatggcagctctgaccggcggtaagggcttcccatttttattccagcatatcagggatggtattaacatccgccagacgtgcaatcttatattctcgttgtgccggtacaataaccggctagctgagcacatagtctcgatgctattcactagtatcgcaaagttaacacccgaggccgcaaacccctttttcaaattgcttaccatgctgatggagttcgctggtggacccccaggcatgccccctttcgcatcctacatcttgcagagaatatgggaggtgatcgaatacaaccccagccagtgcttagattggctagccgtccagaccccacgcaacaaactggctcactcctgggtgttgcaaaacatggagaactgggtcgaaaggtttctgctggctcacaactaccccagggtgagaacaagcgcagcatacttgttggtcagtctgatccctagcaacagcttcaggcaaatgtttaggagcactaggtctcttcatattccaacacgcgacttgccactgtctcctgataccactgtcgtactgcaccaggtatacaacgtgctgcttgggctcttgtcgcgggcaaaactgtatgtcgacgccgctgtacatggcacaaccaagctcgtgccatacttctcttttatgacatattgcttaatttcaaagacagagaaattgatgtttagtacttattttatggatctgtggaacctgtttcagcccaaactttccgaacccgcaatagccaccaatcacaacaagcaggcacttctgagtttttggtataatgtatgcgctgattgcccagagaacattcggctgattgttcaaaatccagtggtgaccaagaacatagccttcaattatattttggctgaccacgatgaccaggatgttgtactgtttaaccgcggtatgcttcctgcttactacgggatcttgaggctgtgctgcgagcagagtcctgcctttacccgacaactggcatcccaccagaacatccagtgggccttcaaaaatctgacaccacatgctagccagtaccccggagccgtggaagagctcttcaatctgatgcaattattcattgcccaacgaccagacatgcgggaggaagaacttgaagatattaagcaattcaagaaaacaacaataagttgctatctgaggtgtcttgacggacgctcctgctggacaacacttatcagcgcttttaggattttgttggagtccgatgaagaccggctgctggtggtgttcaacagggggcttatcctgatgaccgagtcttttaacaccctgcatatgatgtaccacgaggccacagcttgccacgtgacgggagacttggtggagctgcttagtatttttctttccgttctgaagtctacacgaccatacctacaacgtaaggacgtcaagcaggctctcatccagtggcaggaacgtatagaatttgcccacaaactcctaacgctgctgaattcctattcaccgccagaactgaggaatgcatgtatcgacgtgttgaaggagctggtgctgctatctccccatgattttctccacacacttgttccttttttacagcacaaccactgcacataccatcactccaacattccgatgagcctaggtccatactttccatgccgtgaaaatataaagctgatcggcggtaagagcaacattcggcctccacgacctgagctgaatatgtgtctgctgcctacaatggtagagaccagcaaaggcaaggatgacgtttacgacaggatgctcctagattacttttttagctaccatcagtttatccacttgctgtgccgcgtagcgatcaactgcgagaagtttactgagaccctcgtcaaactgtctgtactggtagcctacgagggccttcctctgcatttggccttgttccccaagctgtggactgaattatgtcaaactcagtctgcaatgagcaagaattgtatcaaactactgtgcgaagacccagtattcgctgaatacatcaagtgtatcctgatggatgagagaacattcctgaataacaatattgtgtacacattcatgacccatttcctacttaaagtccagtctcaggttttcagcgaagctaattgcgccaaccttattagcaccctgattacgaacctgatcagtcagtaccagaacttgcaaagtgatttttcaaacagggtggagatatccaaagccagcgccagtctgaatggagacctgcgggcactggccctgctgctgagcgtccatacaccaaaacaactgaatcctgctctaattcccacccttcaggagctcttgtcaaaatgtaggacctgtttacagcagaggaactccctccaggagcaagaagctaaagagcggaagacaaaagacgacgagggagcaactccaatcaaacgaaggcgcgtgagctctgatgaggagcacaccgtggactcatgcataagtgatatgaagaccgaaacgagagaagtcctaaccccaacgtcgacttctgataatgagacgagagatagtagcatcatcgatccgggaacagagcaagatctgcccagccctgagaatagcagcgtgaaggaataccgcatggaggtgccctctagtttctctgaagacatgtccaatatccgttcccagcacgcagaggagcaaagcaacaacgggaggtacgacgactgtaaggagttcaaggatttgcattgttctaaagactccacgttagccgaagaagagtctgagtttccatccaccagtattagtgccgtgctgtccgatctagcagatctgcggtcttgcgatggacaggccctcccatcccaggatcccgaggtagctttgtccctttcatgcggccattcccgcggactttttagccacatgcaacagcacgatatcctggataccctttgccgtaccattgaaagcactatccacgtggtgactcggatctcaggtaagggcaaccaggcagcttcctac

SEQ ID NO: 60597 - DNA, 9935 bp, Artificial Sequence
  Description of Artificial Sequence: Synthetic coding sequence
atgcgccgtaaaaacagctactatgtgtggcaaatcttccaaatccagttcccactgtacaccgcttacaagcacaacacccacccaaccatcgaggacatcagtacccaggagagtaatatcttgggagctttctgcgatatgaacgatgtcgaggttcctctccacctactcagatacgtgtgcctgttctgcgggaagaacggcttgtctttgatgaaggattgcttcgaatatgggactcctgaaacgctgccttttctgattgcacacgccttcattaccgtcgttagcaacattcgcatttggctccatattcctgcagtcatgcagcatatcattccattcaggacatacgtaataaggtacctctgcaaactgtccgaccaagagctgcgccagtccgccgctcgtaatatggctgaccttatgtggagtaccgtcaaggaaccccttgacacaaccctctgcttcgacaaggagtcactcgacttagctttcaaatatttcatgagccccacactcacaatgcgcttggccggactgagccagattacaaatcaacttcataccttcaacgatgtgtgcaataacgaatcgctggtgagcgacactgaaaccagtatagcaaaggagctggctgactggctgattagtaacaacgtggtggagcatatcttcggcccaaacctgcatatagagatcatcaaacagtgccaggtgatcctcaattttctggcagccgagggccgactgagcacccaacatatcgattgcatctgggcagccgcacagctgaaacactgttccaggtatatccacgacctgtttccctccctgataaagaatctggacccagtgccacttaggcacttgttaaacctggtcagcgcgcttgaaccaagtgtccatacagagcagaccctctacctggcatccatgctcatcaaggctttgtggaataacgccctcgctgccaaagcccagttatctaagcaaagctcattcgcctctctcctgaatacgaatattcccattgggaataagaaagaggaagaagaactgaggagaacagcaccgtcgccttggtcccccgcagcatcaccccaatcgtcggataacagcgatacacaccagtctgggggatccgatatagaaatggacgagcagttaatcaatagaaccaaacacgtccaacaacggttgtctgacacagaggagtcgatgcagggcagcagcgacgagactgccaactctggcgaagatggcagcagcggtcctgggtccagttccggccattcagacggaagcagtaacgaggttaactccagccacgcatcacaatcagctggaagccccggttccgaggtacagagcgaggatatcgcagacatcgaggccctgaaggaggaggacgaggatgacgaccacggccataacccgcctaaatcatcttgcgggaccgacttacgcaacagaaaactggagagtcaggccggtatttgcctgggcgactcccagggcatgagcgagcggaatggtacaagtagcggcacgggtaaggacctggtgtttaacacagagtcgctgccttctgttgataatcgaatgcgtatgttggatgcgtgctcccatagtgaagaccccgaacacgatattagcggggagatgaatgctactcacattgcccaaggctcccaggagtcttgtataactaggaccggagactttctgggtgagactatcggcaatgagctgtttaactgccggcagttcattggaccacagcaccaccaccaccaccaccaccatcatcatcaccacgacgggcatatggtcgacgatatgctgtctgctgacgatgtgtcgtgttcatcatcccaggtctcagctaaaagcgaaaaaaacatggccgattttgatggagaagaatcagggtgcgaagaggaactggttcagataaattctcacgcagagctgacttctcatctgcaacaacatttacccaacttggcctcgatttaccatgagcatttgtctcagggcccagtcgttcataaacatcagttcaatagcaacgcggtgacagacatcaacctcgataatgtctgcaaaaaaggaaataccctcctctgggacatagttcaggacgaggatgccgttaatctgtccgagggcctgatcaacgaggcagaaaagctgctctgttcactcgtctgctggtttactgatcgccagatcaggatgcgatttatcgaaggctgcctcgaaaatttgggaaacaataggagcgttgtgattagtctgagactgttgccgaaactctttggaaccttccagcagtttggaagttcatatgatactcattggattacaatgtgggccgaaaaagagttgaacatgatgaagctgttttttgacaatctcgtgtattatatccagacggtcagagagggcaggcagaagcacgccttgtacagccatagcgccgaagtccaggtgcggcttcagtttctcacctgcgtgttttctaccttagggtcacccgaccattttagactgagcctcgaacaggttgacattctgtggcattgcctggtcgaagacagcgagtgctatgacgatgcccttcactggtttctgaatcaagtacggagtaaggaccagcacgccatgggcatggaaacatacaagcacctgtttctggagaagatgccccagctaaaacccgagacaatcagcatgactggcctcaatctttttcagcacctgtgcaacctagcgaggctagcgacttccgcctacgacggctgtagcaactcagaactgtgtggcatggaccaattctggggcatcgctctgcgggcacagtcaggggatgtgtctcgggcagcaattcaatacatcaacagctattatatcaacgggaagaccggtttggagaaagaacaggagtttatcagcaagtgcatggagtccttgatgatcgcatcctcctctctagaacaggaatcccattcatccctgatggttattgaacggggattactcatgctcaaaacccacctggaagcatttcgtcgtagattcgcttaccacctgcgccagtggcagatcgaggggactgggatatccagtcatctgaaagccctgtcagacaaacagagcttaccccttagagtggtgtgccagcccgcaggcttgcccgacaaaatgaccattgagatgtatccgtctgaccaggtcgctgacttgcgtgccgaggtcactcattggtacgagaatctccagaaggaacagattaaccagcaggcccagttgcaggagtttggacaatccaatcgaaaaggggagttcccgggtggcctgatgggcccagttcgtatgatctcatccgggcatgagcttactacggactacgacgaaaaggccctccacgaattgggatttaaggatatgcagatggtcttcgtctcgcttggcgcacccaggcgcgaacgtaagggggaaggggtgcaactccccgcttcttgccttcctcccccacagaaggataacatccctatgctgttactattacaggaacctcatctcacaacgctctttgacttgttggaaatgttagcaagcttcaaacccccatccggcaaggtggctgtggacgactctgaaagtctgaggtgcgaagagctgcatttgcacgccgagaatctttctcgcagggtctgggagctcttgatgctcctacccacttgcccaaatatgctgatggccttccagaacatcagcgacgaacagagcaacgatggcttcaattggaaggagttgttgaaaattaaatcggctcacaaacttctgtatgccttggaaatcatcgaagcacttggcaaaccaaataggcgaatcaggcgggagtcaacaggtagctattctgatctgtatcccgacagcgacgactcatctgaagatcaggtcgagaatagcaagaatagctggtcatgtaagtttgtggccgctggaggccttcagcagctgttagagatctttaattctgggattcttgagccaaaggaacaggagagctggacagtatggcaactcgattgcctagcttgcctcttaaaacttatctgccagttcgcagtggacccttctgaccttgatctggcataccatgatgtcttcgcctggtccggcatcgcagagtctcatcgtaaaagaacttggcccggtaaatctagaaaggcagccggagatcacgccaaagggctgcacatccctcgactgaccgaggtgttcctggtgctggtgcaggggaccagcttgattcagaggttgatgtccgtggcctacacatacgacaatctggctcccagggtgctgaaggcccaatcggaccataggagccggcacgaagtctctcactatagcatgtggctcttagtgtcctgggcgcattgttgctcactagtgaaaagctcactagccgattctgaccacctgcaggactggctcaaaaaacttacattgctgattcctgagacagcagtgcgccacgaatcatgcagcggtctctataagctgtccttgagcggcctggacggaggcgactcaatcaacaggtctttcttactgctggcagcttcaaccctgctaaagttcctcccagatgcccaggctctgaaacctattcgcattgacgattacgaagaagaaccaattctgaaaccgggatgcaaggagtatttctggctactgtgcaagctcgttgacaatatccacatcaaggacgcctcccagacgacactgctcgacctcgatgcgctggctagacatctggccgactgtataaggagcagagagatactcgaccatcaggatgggaacgtcgaggacgacggtctgacagggttactgagactcgccactagcgtggtaaagcataagcctcccttcaagttcagccgggaaggacaggagttcttgcgagatattttcaatctgcttttcttattgccttcactgaaggatcggcaacagccgaagtgcaaatcccattcctctcgggctgcggcttacgacctcctggttgagatggtgaagggctccgtggagaactatcgtcttatccataattgggtcatggcgcagcacatgcagagccacgcaccctataagtgggactattggccgcatgaggacgttcgcgctgagtgccgcttcgtggggctaacgaacctcggagccacatgttatctggcttctacgatccagcagctgtatatgatccctgaagccagacaggccgtctttactgcaaagtactccgaagatatgaagcataaaacaaccctcctggagctgcagaaaatgtttacatatctgatggaatcagagtgcaaggcctacaatcccagaccattctgcaagacctatacaatggacaaacaaccactcaatactggcgaacaaaaagatatgactgagttttttacagaccttatcaccaagatcgaggaaatgagtccagaactgaagaacacggtcaagtcactgtttggcggagtcatcacaaacaacgtggtaagcctcgactgtgaacatgtcagccaaactgccgaggagttctatacagttcgttgccaggttgcggatatgaaaaacatctatgagagcttggatgaggtgacgatcaaagacactctggagggtgacaacatgtacacctgcagccattgcggcaaaaaagtgagagcagaaaagcgcgcatgctttaagaagctgcctaggatcttgagcttcaacaccatgagatatacatttaacatggtcacaatgatgaaggagaaggtgaacacacacttcagctttcctctgcgacttgatatgaccccttacactgaggattttctgatgggcaaatccgagcgaaaggaagggttcaaggaggtaagcgaccacagcaaagatagtgagtcttacgaatacgaccttattggcgtcaccgttcatacagggacagccgacggaggtcactattattcgttcatacgtgatattgtgaatccacacgcctacaagaataacaaatggtatttgtttaacgatgctgaggtcaagccctttgatagtgcacagctggcttccgagtgcttcggaggagaaatgacgaccaagacctatgactcggttactgacaagtttatggacttttcttttgaaaagacccattctgcttacatgcttttttacaaaagaatggaaccagaggaagaaaacgggcgagagtacaagttcgatgtgagctcagaactgctggagtggatatggcatgataacatgcagttcctccaggacaaaaatatctttgagcatacgtatttcggcttcatgtggcagctgtgctcatgcatcccaagcaccctgcccgaccccaaggctgtctcccttatgaccgctaaacttagcacctcattcgttcttgagacttttatccatagcaaggaaaaaccgaccatgctgcaatggattgagctactcaccaagcagttcaataacagccaggcggcatgcgagtggtttctcgacaggatggccgacgacgattggtggccaatgcagatcctaatcaaatgtccaaatcagattgtacggcagatgttccaaagactctgcatacacgtaatccagagacttaggccagtccacgctcacctgtacctccagccgggaatggaggacggcagtgacgatatggataccagcgtggaggatattggcggacgctcgtgcgtcacaagattcgtgcggacattactcctcattatggagcatggggtgaagcctcactcaaaacacctcactgagtatttcgcatttctgtatgagtttgccaaaatgggcgaagaagagtcccagtttctgttatccttacaagccatctccacaatggtgcacttctacatgggaactaaaggccctgagaatcctcaggtcgaagtgctgtctgaagaagaaggcgaagaggaagaggaggaagaggatatcctttccttggctgaggagaaatacaggcctgcggctttagagaaaatgattgccctggtggccttgctggttgagcagtctcgttctgagagacatctgactctgagtcaaaccgatatggctgctctcaccggtggtaaagggttcccttttctgttccagcatatcagggatggaattaatatacgccaaacgtgtaacctcatctttagcctgtgcaggtataacaaccgcttggctgaacacatagtgtcaatgctttttacctcaatcgccaagctgacacccgaagcggcaaatccctttttcaaactgctaaccatgctcatggagttcgctggcggaccgcctgggatgccccctttcgcttcttacattctgcagcgaatctgggaagtaatcgagtataacccctcccagtgcctggattggctcgctgttcagaccccgcgaaataagctcgcgcattcctgggtgctacagaacatggaaaactgggttgaacggtttctcctggctcacaactaccccagggtcaggaccagcgcagcatatctcctcgtatccctcattccgtccaattcattccggcagatgttcaggagtaccagatccttgcatattcccaccagagatttgcccttgtccccggatactactgttgtactccaccaggtctataatgtattgttggggctgctgtcgagggccaagctgtacgttgatgccgcagtccacgggacgaccaagctggttccatactttagtttcatgacatattgcctgatttcgaaaaccgaaaagctcatgttttccacatactttatggacctgtggaatttgttccagcctaagttaagtgaaccagccatagccaccaaccacaacaaacaggccctgctgtcattctggtataacgtatgcgccgactgtcctgaaaacatcagacttattgtgcagaaccccgttgtaactaagaacatagcctttaactacattctggccgaccatgacgatcaagacgtcgtactcttcaaccggggaatgttacctgcgtactacgggattctgaggttatgttgtgaacagagccccgctttcacgcggcaattagcgtcgcatcagaatatccagtgggccttcaagaacctgactccacatgccagccagtacccaggtgcagtagaggagctattcaacctgatgcagctgttcattgcacagcgccctgatatgagagaagaagagttggaagatattaaacagtttaaaaagacaactatcagttgttatctcaggtgccaggccctgattcaatggcaggagcggattgaatttgcacataaactcctgacgcttctgaattcatattctccccctgagctgcggaatgcttgcatagatgttctaaaggaacttgtcctcctgtccccacatgatttcctccatactttagtacccttcttacagcacaaccattgcacctatcatcactccaatatccctatgagcctcgggccatacttcccatgcagagagaacattaagctgataggcggaaagagcaatatccggccacccagaccggagctgaacatgtgcctgctgcccaccatggtcgaaacttcaaagggtaaggacgatgtgtacgatcggatgcttctggactatttcttttcctatcaccaattcatccacctcctctgccgcgtggccataaattgcgagaaattcactgagaccttggtgaaattgtctgtgttggtcgcctatgagggcctgcccctccatcttgcactgttccctaaactgtggaccgaattatgccaaacccagtctgcaatgagcaagaattgcatcaagctcctctgcgaagatcccgttttcgccgaatacatcaagtgcatattgatggatgaaaggacattcttgaataataacatcgtgtacaccttcatgacgcactttctcctcaaagtgcaaagccaagtgttttctgaagctaattgcgctaatctcattagcaccctcatcaccaacctgatctcccagtaccagaatctgcagtcagacttctccaatcgtgtggagatttctaaagcctctgcgtccctcaacggggacctgagggctctggccctactattgagtgtgcatactccaaagcagctgaatcctgctctgattcctaccctccaagagctgttatccaaatgcaggacatgtttacagcagaggaactcattgcaagaacaggaagctaaagaacggaagaccaaagacgatgagggcgcaactcctattaagaggcggagggtcagctctgacgaggagcatacagtggactcctgtatttcagacatgaagaccgaaactagagaagtgttgacccctactagtacctcagataacgaaacaagggatagctctataatcgacccaggaactgagcaagacctgcccagtccggagaacagctcggtaaaagaatatcgaatggaggtcccttctagcttctctgaagacatgtctaacatccgttcccagcacgccgaggagcaatctaataatggtcggtatgacgattgcaaggagtttaaggatctgcactgcagcaaggattcaacactcgccgaggaggaatcagagtttccctcaacgtccatcagtgccgtgttatctgaccttgcggacctgaggtcctgcgacggtcaggctttgccgagccaggatcctgaggttgctctgtccctgtcttgcggacacagcagagggctctttagtcatatgcagcagcatgacattctggataccctgtgtcgcacaatcgagtccacaattcacgtcgtcacacgcatcagcggtaaaggcaaccaagctgcaagtta

SEQ ID NO: 60598 - DNA, 10641 bp, Artificial Sequence
  Description of Artificial Sequence: Synthetic coding sequence
atgtgcgagaattgcgcggatttagtcgaagtgctgaatgagattagtgatgtcgaaggaggcgatggtttacagttgaggaaagaacataccctgaaaatcttcacctacatcaattcttggacacagcgccagtgtctgtgctgcttcaaggaatacaagcacctggaaatctttaaccaggttgtgtgcgcactaatcaaccttgtgattgcccaagtgcaagtgctgagggaccaattgtgtaagcactgcacaaccataaacatagacagcacatggcaagatgagtcaaatcaggccgaagagcctttaaatatcgatagagagtgcaacgaggggagcacagaacgccaaaagagcattgaaaaaaaatctaatagcacaaggatctgcaacctgactgaagaggaaagtagcaaaagttcagatcctttctctctgtggagtacagacgagaaggaaaagttgctcctgtgcgttgcgaagattttccagatacaattccccttatacacagcctataagcacaatacacatcccacaatcgaggacattagtacccaagaatccaacatcctgggagcattctgtgacatgaacgacgtggaggtcccattacatttgttaagatacgtctgtctgttttgcggaaagaacgggctctctctaatgaaggattgttttgagtatggaacacctgaaactctcccattcttgatcgcacacgcctttattacggtggtttctaacattagaatatggttgcacattcctgctgtgatgcagcacatcattccctttagaacttacgtcatcagatacctctgtaagctgagcgaccaggaattaagacagagcgcagccagaaacatggcagatctgatgtggtcaacagtcaaggagcctctggataccacactctgtttcgataaggagtcgttagatctcgcctttaaatactttatgagtccaaccttgacaatgcgcttggcaggactgagccagattacgaaccagctgcacaccttcaatgatgtgtgcaataacgaatccttggtttctgatactgagacaagtattgccaaggaactggcagactggcttatttctaacaatgtggtggaacacatctttggccctaacctgcacatagaaataattaaacaatgtcaggtgatcctgaattttctggctgccgaaggacgtctttccacccagcacattgattgtatctgggctgcggctcagctgaagcactgtagccgctacatccacgatttgtttccctccttgattaagaacttggatcccgtccctcttaggcatctgctcaatctggtatctgccttggagccctctgttcacactgagcagaccctctatctggcctcaatgctcatcaaggcgttgtggaacaatgccctagccgctaaggcccagctgagcaagcaaagctcgtttgcctccctcttgaatactaatatccccattggaaacaagaaggaagaagaggagctgcggcgaaccgcgccaagcccatggtcccccgcagcaagccctcagtcaagtgataatagtgacacccaccagagtggcggttccgacatcgaaatggatgagcagctgatcaatagaacaaagcatgtacagcagagactctccgacacggaagaatccatgcagggctcatctgacgaaaccgccaactcaggcgaggacggctcatctggaccaggttcttcctcgggccattccgacggatcttctaacgaggtcaacagctcacacgcctctcagtccgcgggaagtcctggatcagaggtccaaagtgaggatattgccgacatagaggccctcaaagaagaggacgaagacgacgatcatggtcacaatcctcctaaatcctcatgcgggactgacctccgcaataggaaattagaatcccaggccggaatctgccttggggatagccaaggaatgtccgagaggaacgggacaagttcaggaacaggcaaggacctagtctttaacacagaatcactcccatcagtggacaaccgcatgcgcatgctggacgcctgttcccatagtgaggatcccgaacatgacatttccggggagatgaacgcaacccacatcgctcagggaagccaggaaagctgtatcacccgaacgggcgattttctgggcgagactattggcaacgaactcttcaactgccgacagttcataggccctcagcatcatcaccatcatcaccaccaccaccaccatcacgatggacacatggttgatgacatgctctccgcagacgatgtctcatgctcatccagccaggtctcggccaagagtgaaaaaaatatggctgactttgacggcgaagagagtggctgtgaagaagagttggtccagatcaacagccatgccgagctcacatctcatcttcagcagcacttgcccaacctggcttccatttaccatgagcacctttctcaaggacctgtcgtccacaaacaccagttcaatagtaatgctgtgaccgacatcaacctcgacaacgtctgcaaaaaggggaacacgctgctgtgggacatagtccaggatgaggacgccgtgaatttaagtgagggcttaataaacgaggcggagaaactgttgtgttccctggtctgttggttcaccgataggcagataagaatgcgtttcattgaggggtgcctggaaaatctggggaataataggtccgtggtgatctcactgaggcttttgcccaaactgttcggcacatttcaacagtttggcagcagctacgatacccactggatcacaatgtgggctgaaaaggagctcaacatgatgaaactcttttttgataaccttgtctattatatccagacagtgcgcgaaggcagacagaagcacgccctgtacagtcattccgcggaggtccaggttcgcttgcagttcctgacttgcgttttctctactttgggttcgcccgaccacttcaggctgagtctggaacaggtggacattctctggcactgccttgtagaagactccgagtgttacgatgatgccttgcattggttcctgaaccaggtgaggagcaaggatcaacatgctatgggtatggaaacctataagcatctttttctggaaaaaatgcctcagctgaaaccagaaacaattagcatgactggtctcaacctgttccagcacctctgcaacctcgccaggctagcgacatcagcgtatgacgggtgtagcaattcagaactgtgcgggatggaccagttctggggcattgcactccgcgctcagtctggcgacgtttcccgcgctgctattcaatacataaattcctactacatcaatggtaaaacgggcctggagaaggaacaagagtttatttccaagtgcatggaatccttgatgattgcctcaagctccctggagcaggaaagccatagtagcctaatggtaattgaacgcggtttacttatgctcaagacgcatctggaggccttccgacgcagatttgcataccatttgcggcagtggcagattgaggggactggaatttccagccacctgaaagctcttagcgacaagcagtccctccctctgcgggttgtgtgccagcccgcaggactacctgataagatgaccattgaaatgtatcctagcgaccaagtggccgacctgcgggcagaagtaactcattggtatgagaacctgcagaaggagcagatcaaccagcaagctcaactgcaagaatttggacagtctaaccgtaaaggagagtttccaggaggtctgatgggacccgtgagaatgatcagctcaggacatgaattaacgactgactacgatgaaaaggctttgcacgagctgggatttaaggatatgcagatggtcttcgtaagtctaggcgctccccgacgggagaggaaaggcgagggggtgcaacttccagctagctgcctaccaccaccccaaaaggataatatacccatgctgctgctccttcaggagccacatctgacgactctgttcgacctcctcgagatgctggccagcttcaagccacccagcgggaaagtagcagtggacgacagtgagtccctccgatgcgaggagctccacctccacgccgagaacctgagcagacgcgtgtgggaactactaatgttgttacctacgtgccctaacatgctgatggctttccaaaacatctcagatgagcagtctaatgatggtttcaactggaaggaactgctgaaaataaaaagcgctcataagttgctatatgccttggaaattatcgaggctctcggcaaacctaaccgtagaatacgcagggaatctacaggatcgtactctgacctctatccagactcggacgactcctccgaggaccaggtagaaaattccaagaattcctggtcttgtaagtttgtggcagccggagggctgcagcaactgctggaaattttcaatagtggtatcctggagccgaaggagcaagaatcctggaccgtttggcaattggactgtctggcctgcctactgaaactgatctgccagtttgccgttgacccatctgatttggacttagcataccatgatgtgttcgcatggagcgggatcgcagaatcccaccgcaaacggacatggcctggtaaatcgcgtaaggctgctggagaccacgctaaaggcctgcacattccgagattgaccgaggtgttcctggtgctggtgcagggtacttccctcatacagcgtctcatgagtgtagcctatacctacgataatctcgccccacgggtcttaaaggctcagagcgaccacaggtctcgccatgaggtttcccactactctatgtggctgttggtgtcatgggcccattgttgcagtctggtgaagtcttctttagcagactctgatcacctgcaggattggttaaagaaactcaccctattaattcctgagaccgcggtcaggcatgagtcatgctcaggcctatacaaattgtctctctctggtctggacggcggagatagcattaaccgcagtttcctgcttcttgccgcaagtaccctcctcaaatttctccctgacgcacaggctttgaagcctatcagaatcgacgattatgaagaagaacctattttaaaaccaggctgtaaggagtatttctggttgctgtgtaaactggtggataacattcatatcaaggacgcctctcagacgacgctcctggacttagacgcgttagctagacacttggcggattgtattaggtctcgtgaaatcctcgatcaccaggacgggaacgtcgaggacgacggactgactggcctgctacgtctggccactagcgttgtcaaacacaaacctcctttcaaattttctcgcgagggccaagaatttctgagggacatctttaacctgctttttttactaccgtccctcaaggaccgccagcagccaaagtgtaaatcgcactcctcccgcgctgcagcgtacgacctgctggtggaaatggtcaagggtagtgtcgaaaactaccggctcattcataactgggtgatggcacagcacatgcagagccacgctccctataaatgggactactggccacacgaagacgtgcgtgcagagtgtcgcttcgtcggcctgactaacctgggcgcaacgtgttacctggcaagcacgatccagcagctgtatatgattcccgaagcccgacaggctgtgtttaccgcaaaatactctgaagatatgaagcacaagactactctgctcgaattacagaagatgtttacttacctcatggaaagtgaatgcaaggcctacaacccgaggcctttctgcaaaacctatacaatggacaagcagcctctgaacactggtgagcagaaagatatgacagagtttttcactgacttgatcacaaagatagaggagatgtccccagagttgaagaatactgtaaaatccctgtttgggggagtgatcaccaacaatgtggtgagcttggactgtgagcatgtcagtcagacagctgaggaattctataccgtgaggtgtcaagtggcagatatgaagaacatctacgaaagtcttgatgaagtcacaatcaaggacaccctcgagggagacaacatgtatacctgcagccattgtggaaaaaaggtgagggctgaaaagagagcatgctttaaaaagcttcctaggatactgagtttcaacactatgaggtatacttttaacatggtcacgatgatgaaggagaaagttaacacacatttctcctttcctctgagactggacatgacaccttatacagaggactttttaatgggaaagagtgagaggaaggagggctttaaagaagtctccgaccactccaaggatagcgaatcatatgagtatgacctgatcggggtcaccgtgcacaccggcacggccgacggtggtcattactatagcttcataagagacattgtaaacccacatgcttataaaaataacaagtggtacctgtttaatgatgccgaggttaagccattcgattctgctcagctcgccagcgaatgttttggaggagaaatgaccactaagacttacgattcagtgacggataaatttatggatttttccttcgagaagacacactccgcatatatgctattctacaagcgaatggagcctgaggaggaaaacggcagggaatacaaatttgatgtgtctagcgagttgctggagtggatctggcatgacaatatgcagtttctgcaggataagaacatcttcgaacacacctattttggctttatgtggcagctgtgcagctgtatccctagtacgctgccggacccgaaggcagtctcactcatgaccgccaagctgtccactagttttgtgctggaaacatttatacacagtaaggaaaagccaaccatgttgcagtggattgaactgctgacaaaacaattcaataatagccaggcagcttgtgagtggtttctggatcggatggccgatgatgactggtggccaatgcagatactgatcaagtgcccgaaccagatcgtccgccagatgtttcagagattgtgtatccacgttattcagcggctacgtcccgttcacgctcacctttatttacagccaggtatggaagacggatccgatgacatggacacaagcgtggaagacatcggtggaagatcctgcgtgacaagatttgtgaggacactattgctgatcatggaacacggggtcaaaccccactccaaacacctcacggaatactttgcctttctctacgaatttgctaagatgggcgaagaggaaagtcagtttttactgagtctgcaagcgatcagcaccatggtccatttttacatgggcactaaggggccagagaatcctcaggtggaggttctatctgaagaagagggcgaggaagaggaagaggaggaagacatattatccctcgccgaggagaagtatagaccggcagccctcgagaagatgatcgcacttgtggcactgctggtcgagcagtcgaggtctgaaagacacctgacgttgtcgcagaccgatatggccgctcttacagggggtaagggctttcctttcctgtttcaacatatacgcgacggcattaacattcgccagacttgcaatctgatttttagtctttgcaggtataacaatagacttgcagaacacatcgttagtatgctgttcaccagcattgccaaactcacaccagaggcggcaaatcccttctttaagcttctcaccatgttgatggagtttgcagggggtcctcccggaatgcctccattcgcttcttacattctccaaagaatctgggaagtgatcgaatataatccctcccagtgtctggattggttggctgtacagacccctaggaataaactggctcattcttgggttttgcaaaatatggagaattgggtcgagaggtttttacttgcacataactatcccagagtgcgcacatccgcggcataccttctcgtgtctcttataccttccaatagcttccggcagatgttccgatcaaccaggtcactgcatatccctacccgcgatctgcctctgtctcctgataccacagtggtcctgcatcaggtttacaatgtgttgctgggcctgctttcacgcgctaagctgtatgtggacgctgcagtccacgggacaacaaaactggttccttacttcagcttcatgacctactgcctgatcagcaaaacggaaaaacttatgttctccacctacttcatggatttgtggaatctcttccagcccaagcttagtgagcctgcaatcgccacaaaccataataagcaggcactcctctctttttggtacaacgtctgtgcagactgcccagaaaacatccgcttaattgtgcagaaccccgtcgtgaccaaaaacattgccttcaactacattctggccgaccatgacgatcaagatgtggtgctgttcaatcggggtatgctacccgcttactacgggatactgagactctgctgcgagcagagcccggctttcacccgccagctggcatcccatcagaatatccaatgggccttcaagaatttaacaccccatgcttcccagtatcctggtgcagttgaggaattgttcaatctgatgcagctcttcattgcccagagaccggacatgcgcgaggaggaactggaggacataaagcagttcaagaaaactaccatctcctgttatctgcgttgcctggacggtcggagctgttggactacactgataagtgccttccgcattctcctggaaagcgacgaagataggctcctggtggtttttaaccgcggtctgattttaatgactgagagtttcaatactctgcacatgatgtatcacgaagcgaccgcatgtcacgtgactggtgatctcgtggaactactctctatattcctgtctgtactcaaaagcactcggccttacctgcagcgcaaggatgtaaaacaggctctgatccagtggcaagaacgcattgaatttgctcacaagctgctcactctcttaaactcgtatagccctccggagttaaggaatgcatgcattgacgtgctcaaggagcttgttctgctatcaccacacgattttctgcacactctggtcccattcttacagcacaatcattgcacgtaccaccattcaaatatccctatgtctctcggtccatactttccgtgtcgagagaatatcaaattgatcggcggaaaatctaacatcagaccgccacgcccagagttaaacatgtgtctgctgcccacaatggtggaaacctcaaagggtaaggacgacgtttacgatagaatgctattggactactttttctcttatcatcagtttattcacttgctgtgtcgtgtggctatcaattgcgagaaattcacagaaacattagttaaactcagcgtgctcgtcgcctacgaaggactaccactccatctcgctttattccctaaactgtggaccgaactttgccagacccagagcgcaatgagcaagaactgtatcaagctgctgtgcgaggacccagtcttcgctgagtacattaaatgtattcttatggatgagaggacttttttgaacaacaacatcgtgtacaccttcatgacacattttctgctgaaagtccaaagccaggtgttctcggaggcgaactgcgccaaccttatctctacgttaattacaaacctcatctctcaatatcagaatctgcagtccgacttttcaaaccgcgtcgaaatctcaaaggcctctgctagtttgaatggcgatctgagggccctggctctgctgctcagcgtccatacgccaaagcagctcaacccagcccttatccctactctgcaggagcttctgagcaagtgtcgaacctgtctgcagcaacggaacagccttcaggaacaagaggctaaagaacgcaagaccaaggatgatgaaggtgctacccccatcaagaggcgacgcgtctcatccgatgaggaacacaccgtggactcctgtatttccgacatgaaaacagaaacccgagaggtgctcacgcctacctccacatcagacaatgagacacgagacagtagcattatcgatccaggaacagagcaggatctgccgtccccggaaaatagtagtgtcaaagagtatcgcatggaagtgcccagcagcttcagcgaagacatgagcaatatccgtagtcagcatgccgaggaacagtctaacaatgggagatatgacgattgcaaagagttcaaggatctgcattgcagtaaagatagtacattggccgaagaggagagtgagtttccttccacttctatttccgcagtgctgagcgaccttgcagatctcagatcctgcgatggacaagcgctcccttcccaagaccccgaggtagccctatccctgagctgcgggcatagccgcggactgttttcacacatgcagcagcacgatatccttgacacgctctgccgaacaatcgagtccactattcatgttgtgacgagaattagcggaaagggtaaccaggcggcttcgtat

SEQ ID NO: 60599 - DNA, 1815 bp, Artificial Sequence
  Description of Artificial Sequence: Synthetic coding sequence
atgcccggtctgagacgacgagcttcttggcgagtctccatccctggcagctggccctcacagacacgcgctaggctcgtgagtagcacttgggccacccatgccatgagtacagcttccttcagaccttactcctggcgcttgtcgagctttcgccattgcgtgctcagacttaccgaaaacaactctcagccactaatgaccaaactgcagtggctgttcgggtttcttgagcactctcagcggccagccattagcccagaaaatttcctgagcgcgtcttggactccgtggtttagcccaggcactcagcaggactgtagcgaatatctgaaatatctcctcgacagacttcatgaagaggagaagacgggaacaagaatatgccagaaactcaagcaatcctcgagtccttctcctcctgaagaaccaccagctccctcaagcacttcagttgaaaagatgttcggtggaaagatcgtgacccggatctgttgtctgtgttgcctgaatgtaagcagcagagaggaggcattcactgacctgtcattagccttccctccccctgagcgttgccgcagacggagattgggctccgtcatgagaccaaccgaggacataaccgctagagagcttcctcctcctactagcgcccaggggccaggcagggtggggcctcgacgccagcgaaagcattgtattaccgaggacactcccccaaccagcttatacattgaaggccttgattctaaggaagcaggcggacagtcatctcaggaagaacggatcgagcgggaggaggaaggcaaggaggaaagaactgaaaaagaggaagtcggcgaggaggaggagtcaacgagaggcgaaggagagcgagaaaaggaagaagaggtggaagaagaggaagagaaagtggaaaaggaaacagaaaaagaggcagagcaggagaaggaagaagattcccttggggcaggcacacaccccgatgctgcgattccctccggtgaaagaacctgcgggagtgagggatccagatcagtgttggatttggttaactactttcttagtcccgagaaactcaccgctgagaaccgatactactgtgagtcctgtgctagcctgcaggatgccgaaaaggtggtcgagctctcccaggggccttgctacctgatattaacactgctgagatttagctttgatctgaggactatgaggaggcggaagatcctggatgacgtcagcatacccctactgctccggctgcctctggccggagggcgtggccaggcatacgacctgtgctctgttgtggtgcattcaggcgtgagttccgaaagcggccactactactgctacgcccgtgaaggggctgctagacctgctgccagcctgggtacagcagataggcccgaacccgagaatcagtggtatctgttcaatgataccagagtctccttttcctcctttgagagtgtgtcaaatgtgacttcatttttccctaaggatacagcctatgtcctgttttacagacagcgaccacgcgaggggcctgaagctgaattgggtagcagtagagttcgcactgagccgacgctgcacaaggacttgatggaggcaatctcgaaagataacatcctttatctccaagagcaggagaaggaggcgagatccagggcagcctacatctccgctctgccaacttctcctcactggggacggggattcgatgaggacaaggacgaagatgagggcagcccaggtggctgcaatccagccggaggaaacgggggagacttccaccggcttgtgttttag

SEQ ID NO: 60600 - DNA, 3057 bp, Artificial Sequence
  Description of Artificial Sequence: Synthetic coding sequence
atggataagatcctggaagcggtagtgacaagctcgtaccctgtttcggtcaaacagggactggtccgccgagtgctagaggcagcgaggcagcccctcgagcgggaacagtgcctcgcactgttggcccttggcgcacggttgtacgtgggcggagccgaggagcttccgcgtagggtgggatgccagttgctccacgtggcagggcgacatcatccagacgtgttcgctgaatttttcagtgcaagacgtgtgctgcgtctactccaggggggtgccggaccccctggcccacgagccctggcctgtgtgcagctaggcctccagcttttacccgaggggccagcagccgatgaagtattcgccctgctacgtagggaggtgctgcgtactgtgtgcgagcggccaggaccggcagcgtgcgcccaggttgcccgactcctggctcggcaccccagatgtgtgcctgatggaccgcatcgtcttctgttctgtcagcaactggtgcggtgtttgggacggttcagatgtcctgccgagggagaggagggggctgttgagttcctggagcaggcccagcaagtgagcgggctactggcacagctctggcgggcacagcctgccgctatcctgccttgtctcaaagaactctttgcggtgatctcatgcgccgaagaggagccaccctcgtctgcgcttgccagcgtagtccagcacctgccgcttgaactgatggatggagtcgtccgtaacctttcgaacgacgattcagttaccgattcgcaaatgcttactgccatttcgcgcatgatcgattgggtgtcctggccactggggaagaacatcgacaagtggattatcgcgttgctgaaaggcctggctgctgtgaagaaattctcaattctgatcgaagtgtcactgaccaagatagaaaaggtatttagcaaactcctttatccaatcgtccggggagctgccctctcagtgctgaagtatatgctgcttactttccagcatagtcatgaagccttccatctcctgctgccacacattccacctatggttgcatcccttgtgaaggaagattccaattccgggacgagttgcctggagcagcttgccgaactcgttcactgtatggtgtttcgctttccagggttccccgacctgtacgagcccgtgatggaggctatcaaggacctacatgtacccaacgaagaccggataaaacaactccttggccaggatgcatggacatcccagaaatctgagttggcaggtttctacccaaggctaatggccaagtctgacactggtaaaattggccttataaatctcgggaacacttgttatgtgaatagcattctgcaggccctgtttatggcgtcagacttccgccactgcgtattacggctgactgagaataattcacagccgctaatgactaaattgcagtggctgttcggcttcttagaacacagccagcggccagctatcagtcccgaaaattttctttcagctagctggacaccatggttcagtccagggactcagcaggattgcagcgaatatctgaagtatttactcgataggttgcacgaggaggagaaaacaggtaccagaatctgccagaagctcaaacagtcaagttccccatccccgcctgaagaaccaccagccccatctagcacatctgttgaaaagatgtttggaggcaagattgtaacaaggatttgttgcctctgttgtctcaacgtgtccagtagagaagaagcctttaccgacttgtccctcgcttttcccccacccgaacggtgtcggaggagacgcttaggtagtgttatgagacctacagaagacataaccgcacgcgagctcccacccccaacaagtgcacagggccctgggagggtaggaccaagacggcagcgcaaacactgcataacagaggacaccccacctacctctctatatatcgagggactggatagcaaagaggctgggggacagtcctcacaggaggagcgaattgagcgggaagaggagggcaaagaggagcgaaccgagaaggaggaggtcggcgaagaggaagagagtaccagaggcgagggcgagagggaaaaagaggaggaggttgaagaggaggaggaaaaggtggaaaaggagacagagaaagaggccgagcaggaaaaagaagaggattctctcggggcagggacgcaccccgatgccgcaattccctccggggagcggacctgcggctcagagggttcccgatctgtcttagacctggtgaattatttcttgtctccggagaagctaacagcggagaaccgctactattgcgaatcatgtgcatcgctgcaagacgctgaaaaagtggtcgaactaagtcagggtccatgctatctgatacttacactgctgagattttcctttgacctgcggaccatgcggagacggaaaatattagacgatgtctctatccccctactcctccgattgcccttggctggagggaggggccaggcatacgatctttgctcagtcgtagttcatagcggagtcagttctgagtcgggtcattactattgctatgcccgtgagggggcagcccgtcctgctgcttcactgggtacagctgacagacccgagcccgaaaaccaatggtaccttttcaatgacactagggtcagtttcagctcttttgagagcgtgagtaacgttacctctttttttcctaaagacaccgcatatgtgctcttttataggcaacgccctcgggagggaccagaggctgagctcgggtcctcccgcgtacgaacggagcccacgctccacaaggaccttatggaggccatttccaaggataacatactgtatttgcaggagcaggaaaaggaagccaggagccgggcagcatacatcagtgcccttcctacgtcacctcattggggacgcggtttcgacgaggacaaggacgaagacgaaggatcaccgggaggctgcaatccagccggtgggaatggtggagatttccaccgtctggtgttctag

SEQ ID NO: 60601 - DNA, 3129 bp, Artificial Sequence
  Description of Artificial Sequence: Synthetic coding sequence
atggataagatcctggaggggcttgtaagcagctcccatcccctgcccctcaagcgcgttatagttcggaaagtcgtcgagtccgcagaacactggttggacgaagcacagtgtgaagcaatgtttgatcttacaacccgtctgatcctggaggggcaggatccctttcaacggcaagtcggtcaccaggtgctcgaggcctatgccagataccataggcccgagtttgaatcatttttcaataaaaccttcgtgctcggtttactgcatcagggctatcactcactggatcgtaaagatgtggccattttggactatatccacaacgggttaaaactgatcatgtcctgcccttccgttttggatctgttttccctactacaggttgaagttctgcgcatggtatgtgaaaggccggagcctcaactgtgcgcgagactgagcgatttgctcaccgacttcgtgcagtgcattcccaaaggcaaactcagcattactttctgccagcagctcgtaagaaccatagggcacttccagtgcgtgtcaacccaggaaagggaattacgggaatatgtgagccaggtaactaaggtttcaaatttacttcagaacatttggaaggctgagccagcgaccctgcttcccagcctgcaagaagttttcgcatccatttcttctactgacgcgtcctttgagccaagtgtggccttggctagcttggtccagcacatccctctccaaatgatcactgtgctgatccggagcctaacaaccgaccctaacgtgaaggatgcctcaatgacacaggctctttgtcggatgatcgactggctgtcttggcccctagctcagcatgtagatacatgggtgatcgctctgctgaagggccttgcggcagtccagaagtttactatcctgattgacgtgaccctcctgaagatcgagctggtctttaatcgcctgtggttcccactcgtcagaccgggtgctttggctgtgctgtcacacatgctgctgtccttccaacactctcccgaggcttttcacctgatcgtcccgcacgttgttaacctcgttcattccttcaagaacgatggcctgccgtccagcacggcatttctggtccaactcacagagctgatccactgtatgatgtaccactacagcgggttccccgacctctatgaaccgatcctggaagccatcaaggacttccccaaaccatcagaagagaaaattaaacttatccttaaccagagcgcatggacctctcagtcaaactccttagcttcatgcctgtcaagactcagtggcaagtccgagaccggaaagacaggcctgatcaacttgggcaatacttgctacatgaacagcgtcatccaagcactgtttatggctacagatttccggagacaggtcctgtccctgaatcttaatggatgcaattctcttatgaaaaagctacagcacctattcgctttcttagcacatacgcagcgggaagcgtacgcgccacgaatcttttttgaagcttctagacccccttggttcacgcccaggtcacagcaggactgttctgagtatctcaggttccttctcgatcggttgcatgaggaagagaagatcctgaaggtccaagcctcccacaaaccgagcgagatactagagtgctccgagacctctctccaggaagtggctagtaaggctgccgtcctcacagaaactcctaggacctcggacggtgagaagactttgatcgaaaagatgttcggaggcaagctgcgtacccatattcgttgcctgaactgtcggtctactagccagaaggtagaagcgtttaccgacctcagcttggctttctgcccttcttccagtctcgagaatatgtcggtacaggaccctgcatcctctccaagcatccaagacggaggtctgatgcaggcctctgtccctgggccaagtgaggagcctgtagtgtacaaccctaccaccgcggcatttatttgcgactcactcgtcaatgagaagaccattggtagccctccaaacgagttttattgttctgagaataccagtgtcccgaacgaaagcaataaaatactcgttaacaaggatgtgccccagaagcccggaggtgagaccactccttccgttaccgacctcctcaattatttcctggctccagagattttaacgggagataaccagtattactgcgaaaactgtgctagtctacagaacgcagaaaagaccatgcagatcacagaggagccagaatacctcatcttaacgcttctgcggtttagctatgaccaaaagtatcacgtcagaaggaaaattctggataatgtaagcctaccactggttctggagctccctgttaagcgtatcacaagcttttcatctctttcagaatcctggtcagtcgatgtggactttacagacttaagtgagaaccttgctaaaaagctcaaaccgtcaggcaccgacgaagcttcctgcacaaagctggtaccttatctactgtccagtgtagtggtacactccggaatctccagcgaatctggccattattattcttacgccagaaatattacctccaccgatagcagttaccagatgtaccatcagtcagaagctcttgccctggcctcatcccagtcacatttgctgggccgagatagtcccagcgcggtgtttgagcaagatttggaaaataaggaaatgtccaaagaatggtttttgttcaatgattcccgagtcaccttcacatctttccaatctgtacaaaagatcacgagccgcttcccaaaagacacagcctatgtcttactgtataagaaacagcactctacaaacggactgtccggcaataaccctacctctggactctggatcaatggagatccacctctgcaaaaagaactgatggatgcaatcacaaaagacaataagctgtacttacaggaacaggagctaaacgcaagggcccgagccctgcaagccgcttccgcatcttgcagctttagacccaatgggtttgatgataacgatccacccggaagttgtggtcccactggcggtggaggaggagggggattcaacaccgttggtcgcctggtgttctag

SEQ ID NO: 60602 - DNA, 3708 bp, Artificial Sequence
  Description of Artificial Sequence: Synthetic coding sequence
atgttcggagacctctttgaggaggagtactcaactgtttccaataatcagtacggaaagggcaagaaactgaagacaaaagccctcgagccacccgctcctcgggaattcactaatctgtcgggcattcgcaaccagggtggcacttgctaccttaattccctgcttcagaccttgcactttactccagagtttagagaggccctattcagtctgggtcccgaggagctcggactgtttgaggataaggacaaaccagacgccaaggttcggattatccccctgcaactgcagcgattgtttgcacaactgctgctgctggatcaggaggccgcaagcacagccgacttgaccgattcgttcgggtggacctccaatgaagagatgcgacaacacgacgtgcaagaattaaatcgcattttattttcagctctggaaacttcgctcgttggaacaagtgggcacgacttgatctatagattatatcacggcactatagtgaaccagattgtatgtaaggagtgcaagaatgtcagtgaacggcaagaggatttcttagatcttacagttgctgtcaagaacgtctctggactggaggatgcattgtggaatatgtatgtggaagaagaagtgttcgactgcgataacttgtatcattgcgggacatgcgataggctggtaaaagctgccaaatcggcgaagctgcgcaagctgcccccatttctgaccgtaagcctgctcagatttaattttgacttcgtgaagtgcgaacgatacaaggagacttcttgctatacattccccctgcggattaacctgaagcccttttgcgagcagtcagaactggacgacctggagtatatatacgacctgttctcagtgatcatacacaaaggcggttgttatgggggacattaccacgtgtatattaaagatgtggaccacctgggaaactggcagttccaggaggagaaatcaaaacccgacgttaacttgaaggacttacagagcgaggaagagatcgatcatccgctgatgatccttaaggctatcctcttggaggaaaacaatttgatccctgttgaccagttgggccaaaagctgctgaaaaagatcggcatcagctggaacaaaaagtaccggaagcagcatggccctctcaggaaatttttgcagctgcactcccagatcttcctgctgtccagcgacgaatcgaccgtaagactcctgaagaattcatccctgcaggctgagtcggacttccaacggaatgatcagcagattttcaagatgttaccccctgagtccccgggattaaataactcgatatcttgtccgcattggtttgacatcaacgattctaaagtacagcctattcgagaaaaagacattgagcagcagtttcaagggaaagaatcagcttacatgctgttctataggaaatctcagctccagcggccaccggaagcacgagccaacccgaggtatggagtgccctgccaccttttgaatgagatggacgcagccaatatcgaactgcagactaagcgtgcagaatgtgactccgccaataataccttcgagcttcacctgcatctggggccacaatatcacttcttcaacggagctcttcaccccgtggtgtcccagacagaatctgtctgggatctgacttttgacaagcgcaagacgctgggagacttgcggcaatctatctttcagcttctggaattttgggaaggagatatggtcctctcagtcgcgaaactcgttcccgctggcctccatatttaccaaagccttggaggcgacgagttgaccctttgcgaaactgagatcgcggacggtgaagacatcttcgtgtggaatggcgtggaggttggaggcgttcatattcagactggcatcgactgcgagcccttgctgctgaacgtgctgcacctggacacttcgagcgatggggaaaagtgctgtcaagttattgagtctccgcatgtttttcccgctaatgcggaagtaggaacggtactgactgcactcgccattcccgctggagtgatttttatcaatagcgctgggtgtccagggggtgaaggatggaccgccataccaaaagaagatatgagaaaaacttttagagaacagggactacgaaacggctcttcgatattgatacaggatagtcacgacgataactccttgttgaccaaagaggagaaatgggtaacaagtatgaacgagattgactggttgcacgtcaagaatctgtgccagttagagagcgaagaaaaacaagtgaagatttctgccactgtgaatacaatggtgtttgatataagaattaaggccatcaaggagctgaagctgatgaaggagctggcggataatagttgccttcggcctattgaccggaacggaaaactgctgtgccctgtgccagattcttatacattaaaagaggcggagttgaagatgggttctagtctgggcctttgtctgggaaaggctccctcatcttctcaactattcctcttttttgccatgggctccgatgtgcagcctgggaccgaaatggagatcgtcgtggaggaaactatctctgtgcgtgactgtttaaaattaatgctgaaaaagagcggtctacagggagacgcctggcacttaaggaaaatggactggtgctatgaggccggagaacctctgtgtgaagaggatgccacgctcaaggaattacttatatgttcaggagatacgcttctactgatagagggtcagcttcctcccctgggtttcctcaaggtccccatctggtggtatcagctccaggggcctagcgggcactgggagtcacaccaggatcaaactaactgcacttcttcctggggcagggtgtggagggccaccagctcgcagggcgcatctggcaacgagccagctcaagttagtcttctctacttgggtgacattgaaatctctgaagacgccacactcgcagaattgaaaagtcaggccatgactctgcctcccttcctggaatttggagtgcctagccccgcacacctgagggcctggaccgtcgagagaaagcgtcctgggagattgctgaggacagaccggcagccacttcgcgagtacaaattaggcaggcggattgaaatctgtttggagccattgcagaagggcgagaatcttggaccgcaagatgttctgttgcgtactcaagtacgaatcccaggcgagaggacttacgccccagccttagatctggtgtggaacgctgctcaggggggaacggcgggatccttgcgacagagggtggcggatttctatagactgcctgtcgagaaaatcgaaattgccaagtactttccagagaaatttgagtggttgcctatttcttcatggaaccagcagattaccaagagaaaaaaaaagaaaaagcaagactatctgcagggcgctccctactaccttaaggatggggacaccatcggtgtgaaaaatctgcttatcgatgatgacgacgacttcagcacaatcagagacgacacggggaaagagaaacaaaagcaaagggcccttggacgccgaaaaagtcaggaagcccttcatgagcagagctcatacattcttagctctgcagagacacccgctcggcctagagcccctgagacctctctgtcaatacacgtagggtcttttagatag

SEQ ID NO: 60603 - DNA, 492 bp, Artificial Sequence
  Description of Artificial Sequence: Synthetic coding sequence
atgggatctagcctcggactgtgtttggggaaagctccaagttcgagtcagctttttctttttttcgctatgggcagtgatgttcaaccaggcacagagatggaaatcgtggtcgaagagactatctcagtgagggactgcctcaaactgatgttgaaaaaatcaggcctgcagggcgacgcctggcacctgcgaaagatggattggtgttatgaggccggtgagcccctgtgtgaggaggacgctaccctgaaggaactgttgatctgctcaggagacaccctcctgctgatcgaggggcaattgccccctctgggctttctgaaggtgcctatttggtggtatcagctacaaggaccgagcggtcattgggaatcccaccaggaccaaaccaactgcaccagttcttggggtagggtttggagagcaaccagcagtcagggggaaaaccgaatgggcttccaacaaccagtccatcataaggagaaatag

SEQ ID NO: 60604 - DNA, 3708 bp, Artificial Sequence
  Description of Artificial Sequence: Synthetic coding sequence
atgtttggagacctgtttgaggaagagtacagcaccgtgtcaaacaatcagtacggcaagggcaagaaactgaagacaaaggccttagagccccctgctcccagggaattcaccaacctgtccggcattcggaaccagggagggacatgctaccttaactcactgctgcagaccctgcattttaccccggagtttcgggaagctttatttagcctcggcccagaggaattgggcctgtttgaggacaaagataaacccgatgctaaagttcggattatccccctccagttgcagcgtctcttcgctcagttactcttactggatcaagaggctgcaagcaccgcagatctgaccgatagctttggatggaccagcaacgaggagatgagacaacatgacgtccaagagctgaataggatcctgttttctgctcttgagacaagccttgtgggaacctccggccacgatctgatctacagactttaccacggcaccatcgtaaaccaaattgtgtgcaaagaatgtaagaacgtcagcgaacggcaggaagacttcctggatttgactgttgctgtcaagaatgtgtccggcttggaagatgccctctggaatatgtacgtggaagaggaggtgtttgactgtgacaatctttaccactgcggaacatgcgatcggttagtgaaggctgcgaagagcgctaagctgagaaaactcccaccattccttacagtgagtttgctccggtttaattttgattttgtgaagtgcgagcgctataaggaaactagctgctacacattccccctaaggattaacctaaagccgttctgcgagcaatccgaattggatgatctagaatacatctatgatttattcagtgttatcatacacaagggaggatgttacggtggtcattaccacgtgtatattaaagatgtggaccacttgggaaattggcagttccaggaggagaagtcaaagcctgacgtcaacctgaaggatctacagagcgaggaagagatcgatcatcctctcatgattctgaaggctatcttactggaagaaaataatttgatcccggttgaccagttgggtcagaagctattgaagaagatcggaatttcatggaacaagaagtatcgtaagcagcatggacccttgagaaaatttctacagcttcactcccagattttcttgttatctagcgatgagtctaccgtccgcctcttaaagaattcttccctgcaggcagagtcggactttcagaggaacgaccagcagatctttaaaatgctccccccagaatcccctgggttgaacaattccatcagctgtccccactggtttgatattaatgacagtaaggttcagccaatccgtgaaaaagacatcgagcagcagttccaaggcaaggagtctgcatacatgctcttttaccgtaagagccagctgcaaaggcctcccgaagcaagagcgaacccaaggtatggagtcccatgtcacctgttgaacgaaatggatgctgccaatattgaactgcagacgaaaagggccgagtgcgacagtgccaacaacaccttcgaactacacctgcacctggggcctcagtaccactttttcaacggcgctcttcaccctgtagtttctcaaaccgaatctgtgtgggacctgacgtttgataagcggaagactcttggcgatttgagacagtctatctttcagcttttggagttctgggagggagacatggttctttcagtggcaaaactcgtccctgctggcctccacatctaccaatcccttggtggcgatgagttgacattgtgtgaaacggaaatcgcagatggggaagatatctttgtgtggaatggcgttgaagtgggaggagtccacatccagactggcattgactgcgaacctctgttactcaacgtgctgcacctggacaccagttcggacggcgaaaagtgctgtcaggtcattgaatcccctcacgtattccctgcaaatgccgaggtgggcaccgtactgactgctctggctatacccgcaggcgtaattttcatcaattccgccggttgcccaggaggcgaaggatggaccgccattcccaaggaagatatgaggaaaactttcagggaacagggcctgaggaatggcagctcaatcctcatccaggattcacatgatgacaattctctgctgacaaaggaggaaaagtgggtgaccagtatgaatgaaatcgattggctgcacgtgaagaacctctgccaactggagagcgaggagaaacaagtaaagatctctgccaccgtgaatacgatggtctttgatattcgcattaaggcgattaaggagctcaagttgatgaaagaattagcagataattcctgcctgcgcccaatcgatagaaacggtaagctgctgtgccctgtccccgacagctataccctaaaagaagctgagttgaagatgggcagctccctggggctgtgcttaggcaaggcgccatcatcgtcacaactcttcctgttcttcgctatggggagcgacgtgcagccaggcaccgaaatggagatcgttgtcgaggaaacgatttccgtcagagattgcctgaaactgatgttgaagaaaagtggcctgcagggggatgcctggcacctgagaaagatggattggtgttatgaggcgggtgaaccactttgcgaggaggacgccaccctgaaggagctattgatctgctctggggataccctactcctaatagagggacagctccctcctctggggtttctcaaggttccaatctggtggtatcaacttcagggccctagcggccattgggaatcacaccaagaccagactaactgtacctcatcctggggacgagtctggagggccacctccagtcagggtgcaagtggtaatgagccagctcaagtgtctctgttgtatctaggagacatcgaaatcagcgaagacgcaaccctggcagagctgaagagtcaagcaatgacgctgccccctttcttggaattcggagtcccctccccagctcatttaagggcctggaccgttgaaaggaaaagacccggaagactccttcgaacagaccgccagcccctacgtgagtataaactgggaagacgaatcgagatctgtctggagcccctgcagaagggtgagaacctaggcccacaggacgtgctgctgaggacgcaggtcaggatcccaggtgaacgcacctatgcgcctgccctcgatctggtctggaatgccgctcagggtgggactgccggttcgcttagacaacgtgtcgctgatttctacagactccccgtggagaaaatcgagatagcaaagtatttcccagagaaatttgagtggctgcccatctcctcttggaaccagcagattaccaagcgtaaaaagaagaaaaagcaggactatctgcaaggcgcaccctattacctgaaggacggagacactatcggcgtaaagaatcttctcattgatgacgacgacgactttagcactatccgcgacgataccggcaaggagaagcaaaaacagcgcgctttgggccgtcggaagtcgcaggaggcactccacgaacagtcctcctatattctgagctctgcagagaccccagccaggcccagagctcccgaaactagtctttccatacacgttggctcctttagatag

SEQ ID NO: 60605 - DNA, 987 bp, Artificial Sequence
  Description of Artificial Sequence: Synthetic coding sequence
atgtttggagatctgtttgaggaagaatactccacagtctctaataatcaatatggaaaaggcaaaaagctgaagaccaaggccttggaacccccagctcctagggagttcacaaacctgagcggcattaggaaccagggaggcacatgttaccttaacagtctcctgcagaccttgcacttcacacccgaattccgcgaggccctgttttcactgggtcccgaggaactgggcctctttgaggacaaagataaacccgatgccaaagtaaggatcatcccgctccagctgcagagactgttcgctcagcttttgttgcttgatcaggaagcggcttcaacagccgacctcaccgactccttcggatggaccagtaacgaagagatgagacaacacgacgtccaggagctgaatcgaattctgttttctgctctcgaaacctctctggtgggcacctcaggccacgatttgatctatagactgtatcacggcactatcgtcaaccagatagtttgtaaagaatgcaagaatgtctcagagcgtcaagaggacttcctcgacctgaccgtagcagtgaaaaacgtgtccgggcttgaggacgccctgtggaatatgtacgtggaggaagaagtattcgactgcgataacctttaccactgtgggacgtgtgaccgtcttgtcaaagcagccaaatcagctaagttacgaaagttgcctccattccttaccgtgagcctgctgcgcttcaacttcgattttgtaaagtgcgagcggtataaagagacctcctgttataccttccccttgaggattaaccttaagccattctgcgagcagagcgagctcgatgacctggagtatatgacatctagtcaactgttgtacactaaggtggcagcgaccgaagcgataaccatgtacatcctcaaaatgctgatcatttgggagactgggagcttcaagagaaagaaagttaatcagatgtag

SEQ ID NO: 60606 - DNA, 3744 bp, Artificial Sequence
  Description of Artificial Sequence: Synthetic coding sequence
atgagtctatttctcagggtggtgttctctttcaccatgttcggcgacttgttcgaggaggagtacagtacagtcagcaataaccagtatgggaagggcaaaaaacttaagaccaaggcactcgagcctccagcccctagggaatttactaacctgtcaggaattaggaaccagggtggcacatgctacctgaacagtctgctccaaacgctgcacttcacaccagagtttagagaggctttattcagtctgggtcccgaagagttaggcttgttcgaagacaaagataaaccggatgcgaaagttcggattatcccactgcagcttcaaagattatttgcccagcttctattattagatcaggaggcggcaagcaccgccgatcttactgatagtttcgggtggacttccaatgaggagatgaggcagcatgatgtccaggagctgaatcgaatcctgttctctgctcttgagacctcgctggtcggcacttcagggcatgacctcatctacagactgtatcatggaacaatcgtgaaccagattgtttgcaaggagtgtaagaacgtgtccgagaggcaggaagattttctggatcttaccgtagctgtaaagaacgtcagcggtctcgaggatgcactttggaacatgtatgtagaagaagaggtttttgactgtgacaacctctatcattgcggaacttgcgaccgccttgtgaaggctgcaaaatcagcaaaactgcgaaagttacctcccttcctcaccgtttctctgctcagatttaacttcgattttgtgaaatgcgagaggtacaaggaaacatcgtgctacacattccctctccgcatcaatctgaagccgttctgtgagcaatctgagctggacgacctggagtatatctatgacctgttcagcgtcatcattcataaaggcggttgctatggtggccactaccatgtgtacatcaaggatgtagatcatttaggaaactggcagtttcaggaagagaagtcaaaaccggatgtgaatctgaaagatctccagagcgaagaggagattgaccaccccctgatgatactgaaggcgatcctactggaggaaaacaatcttatcccagtggaccaactgggccagaaattgctcaagaagattggaatctcctggaacaaaaagtatcgaaagcagcatgggccacttaggaagtttctgcaattacatagtcagatctttctgctctcctcagatgaatccaccgtgcggctgctgaagaactccagcttgcaggcggagagtgatttccaaagaaacgatcagcagatcttcaagatgttgcctcccgagagcccaggcctgaataactccatatcatgcccacactggttcgacattaacgacagtaaggttcagcccatccgagagaaggatatcgaacaacagttccaaggtaaagagtcagcctatatgctcttttaccggaagtctcaactgcagagaccacccgaggcacgggctaacccaagatatggagtgccgtgccatctgctgaatgagatggacgccgctaacatcgagctgcagacgaagcgcgcagagtgtgattccgccaacaataccttcgagttgcacttgcacctgggcccacagtatcacttcttcaatggtgctctgcatccggtagtgtcacagaccgagagcgtttgggacttgactttcgacaagcgcaagaccctgggagatcttcgccagagtatatttcagctgctggaattctgggagggggacatggtgttgtccgtggccaagctcgtccctgccggtctccacatctaccaaagcctgggaggggacgagctgactctgtgtgagaccgaaatagccgacggcgaggatatattcgtctggaacggggtggaagtgggcggagttcatatccagacggggattgactgcgaaccattactgctgaacgtcttgcacctggatacaagctccgatggcgagaagtgttgccaggtcattgagagcccccacgtgttccccgcaaacgcagaggttgggaccgttcttaccgctctagcgattccagctggcgtgatcttcattaacagcgctggatgccctggaggggagggatggaccgcaatccctaaggaagacatgaggaaaacattcagagagcaagggcttcgcaatgggagctccatacttatccaggacagccacgacgacaacagcctgttaacaaaggaagagaagtgggtaaccagtatgaacgagatcgattggttgcacgtcaaaaacctgtgccagctagaaagtgaagaaaaacaagtaaagatctccgccaccgtgaataccatggttttcgatattcgtatcaaagcaattaaagaattgaagctcatgaaagagcttgccgataactcctgtctccgtccaattgatcgcaatgggaaacttctgtgcccagtcccagatagttatactctcaaggaggccgaattaaagatgggatcctcactcggtttgtgcctcgggaaagcgccatcatccagccagctttttttgttcttcgctatggggagtgacgttcagccagggacagagatggaaattgtggttgaggaaactatttctgtcagggattgtctcaaacttatgctgaaaaagtccggcctgcagggcgacgcctggcatctgagaaagatggactggtgttatgaggccggtgagccactttgtgaagaggacgccaccctgaaagagcttctgatctgctccggagacacgctcctccttatcgaaggccagctgccccctctgggatttctcaaggtacctatctggtggtatcagctccagggaccatccgggcattgggaatctcaccaggatcagacaaactgcacaagctcctggggccgagtgtggcgcgctactagttctcaaggtgccagcggaaatgagcccgcacaagtgtccctgctgtacctgggggatattgaaatctcagaggacgctactctggccgaattaaagagccaggcgatgacactcccacccttcctggagttcggtgtccctagtcccgcacacttgagggcctggacggttgaaagaaagcggccaggcagattgcttagaaccgatagacagcctttaagggagtacaagctcggcaggcggatcgagatctgcctggaacctttgcaaaaaggcgagaatctggggccacaggacgtccttctgcggacgcaggtgaggatccctggggagcggacctacgcacccgcactggacctagtgtggaatgcagcccaggggggaaccgctggaagcctgagacagcgagtggctgatttctacaggcttccagttgaaaagattgagatcgccaaatatttccccgagaaattcgaatggttacccatcagctcttggaatcaacagattacaaaaagaaagaagaaaaaaaaacaggactatctacagggcgcaccatattaccttaaagacggcgacacaatcggggtaaaaaacctgcttatcgacgacgacgacgacttctccaccatccgcgacgataccggcaaggagaaacagaagcagcgtgctcttggcaggcggaagtcacaggaagccctacatgagcagtcaagttatatcctctccagcgccgagacccccgctagaccccgtgctccagaaacctcactgtctattcacgttggcagttttagatag

SEQ ID NO: 60607 - DNA, 1074 bp, Artificial Sequence
  Description of Artificial Sequence: Synthetic coding sequence
atggacggggttttatttcgcgctcatcagtgccaatatgtccatccatgcgtgcacgtctacgttacagtgggtctaatggatcctctgtgtctgcagcggcacaaggagcatgccaaggggagagagccaccgtgccctgcactctctacatccggactggtaggcctgcataatataggtcagacctgctgcctgaacagcctgatacaggtttttgtcatgaacgttgactttgcaaggattttaaagaggattaccgtgccccgtggcgcagacgagcagcgaagaagcgtgccgttccaaatgctgttgctcctcgaaaaaatgcaggactctcggcagaaggcagtgtggccactggaactggcatattgcctccagaagtataacgtgccactttttgtccagcacgacgccgctcagctttatctgaaattgtggaacctgataaaagatcagatcgctgacgtccatcttgtggaacgacttcaggcactttacatgataagaatgaaggattctttgatttgcctggactgtgcaatggagtcctccagaaacagtagcatgctcaccctccgcctgagcttcttcgatgtcgatagcaagcccctgaagactctggaggacgccctacactgcttcttccagccaagggaactgtcttccaagagcaaatgcttttgcgaaaattgcggaaagaagacacgcggaaagcaggtcttgaagctgacccacttgccccagactttgactattcatctaatgcggttttccatacggaactctcagacgagaaaaatttgtcactccctctactttccgcagagcctagacttcagccagatcctgccaatgaagcgcgaaagctgtgacgcagaggaacagtcaggcggtcaatatgaactttttgcagtgatagcccacgtgggcatggctgatagtggtcactactgcgtgtatatacgcaatgccgtggacggaaaatggttctgttttaatgattccaatatctgtctcgtatcatgggaggacatccagtgcacttatggcaatcctaactaccactag

SEQ ID NO: 60608 - DNA, 3951 bp, Artificial Sequence
  Description of Artificial Sequence: Synthetic coding sequence
atgacaatcgttgacaaagccagcgaatcctccgatcctagtgcataccagaatcaacccggtagttcggaagcggtgagcccaggtgacatggatgcgggaagtgcctcttggggcgctgtgagctcacttaatgacgtcagcaaccataccctgagtctgggtcccgtgccgggtgctgtggtctacagctcttcctctgtgcctgataagtccaagccttccccacaaaaagaccaagcgctgggcgacggcattgcgccaccccagaaggtcttattccctagtgagaagatctgtctgaagtggcagcagacccacagagttggggctggactgcagaatcttggaaatacatgcttcgccaacgcggcattgcagtgtctgacatatacaccccctcttgccaattacatgctgagccacgaacacagcaagacatgccacgccgagggtttctgcatgatgtgtacaatgcaggcccacatcactcaggcccttagtaatccaggagatgtcattaagccaatgtttgtgatcaacgagatgaggcggattgccaggcactttcgctttggaaatcaggaagatgctcatgagtttctccagtataccgtcgacgcgatgcaaaaagcctgtctaaacggctctaataagttagatagacatacccaggccacaactcttgtctgtcagatcttcggaggctatctccgaagtagggtcaagtgcctcaactgcaaaggcgtcagtgatacgtttgatccttatctggatattacattagagatcaaagcggctcagagcgtaaataaggctttggagcaattcgtcaagcctgaacagctggatggggagaactcttacaagtgctctaaatgtaaaaaaatggtgcctgcctcgaagaggtttacaatccacagatcaagtaacgttttgacattgagcctgaaacggttcgcgaactttaccgggggtaagatcgcaaaggatgtgaagtacccggaatacctggacattcgtccttacatgagccagcccaacggtgagcctattgtgtatgtgctctacgctgtgctggtgcataccgggtttaattgccatgcagggcactacttctgctatataaaggctagcaacggactatggtaccaaatgaacgactctattgtgtctactagtgatatccggtctgtgctttcccaacaggcctacgttctattttatatccgctcccacgacgtgaaaaacggaggggaactgacacatccaacccactcacctggacagagttcgcccaggccagtaattagccagagagtagtcacaaataaacaagccgctccaggattcattggccctcagctgccctctcacatgattaagaacccgccacatctcaatgggaccggccctttgaaagacaccccaagttcatccatgagttcgccgaacggcaacagttccgtcaatagggccagtcccgtgaacgcaagcgccagtgtccagaactggtcagttaaccgttcaagtgtcattcccgagcaccctaaaaagcagaagatcacaatttccatccacaacaagctccctgttaggcagtgtcagtcccagccaaatctacattccaattcactggagaaccccacaaaaccagtccccagcagcaccattacaaacagcgcggtccagagcactagcaacgccagtaccatgtctgtgagtagtaaggtgactaagcctatcccaaggagcgaatcctgctcgcagcccgtcatgaacgggaaaagcaagctgaattcatcagttctcgtcccctatggcgctgagtcctctgaagatagcgatgaggaatcaaagggcctgggtaaggagaacggcatcggtacgatcgtttcttcccactctcccggtcaggatgctgaggatgaagaggccacaccacacgaattacaggaacccatgaccctaaacggtgctaattcagctgacagtgactccgatcctaaagaaaacggtctggcccctgatggagcatcatgtcagggccagcccgcactgcatagcgaaaacccttttgcgaaggcgaatggcctgcctggcaagctgatgccagctccattgctgtctttgccagaggacaagattctggaaacattcaggctcagtaataagcttaaagggtcaacggatgagatgtcggcacctggtgctgagcgagggcctcccgaggatcgtgacgcagagccgcagcctggcagcccggctgccgagtcgttagaagaacccgatgccgctgctggactctctagcactaaaaaagctccacctcctcgcgatcccggaacaccagcgaccaaggaaggcgcttgggaggccatggcagtcgcgcctgaggagccaccgccaagcgccggagaggacattgtgggagacaccgctccacccgacttgtgcgacccaggttccctgacgggagacgcctctccactgtcccaggatgccaaagggatgatcgctgaaggaccaagagattccgcactagccgaagcacccgaaggactctcaccagccccaccagcccgaagcgaggaaccatgtgagcagcccctgcttgtgcacccttcaggagaccatgccagggatgcccaggatcccagccagagcctgggagcccctgaggccgctgagagaccccctgctccagttctggacatggccccagctgggcatcctgaaggggatgcggaaccatcacctggagagcgcgtggaggatgctgcagccccaaaagcacccggaccatctcccgcaaaggagaaaattggctcgttgcgtaaggtggatcggggtcattaccggagccgaagggagcggagctcctcaggggagcctgcgcgtgaatctagaagtaagactgagggccacaggcacaggagacgcagaacatgcccgcgtgaacgagatcgccaggaccgccacgcccctgagcaccacccgggacacggcgatcggctttctcccggagaaagaaggagtctcggcagatgttcccaccatcactctcgtcaccgctccggggtagaacttgattgggtgaggcaccattacaccgagggtgaaaggggctggggcagggaaaaattctatccggaccggccacgatgggaccgctgcagatactaccatgaccgctacgctctctacgccgctagggactggaagccatttcatggagggagagaacacgaaagggccggactccacgagagaccgcacaaagaccataatcgaggaagaagaggatgcgagcctgcccgtgaaagggagcggcatagaccaagtagccctagggccggagctcctcacgctctggctcctcaccctgacaggtttagccatgaccggacagccctcgtggcaggagacaactgcaacctctccgacaggttccatgaacacgagaatgggaagtcccgcaagagacggcacgactctgtagaaaactccgacagccacgtggaaaagaaagctagacgcagtgaacagaaagaccccttggaggagccaaaggccaagaagcataagaagagtaaaaaaaaaaaaaagtctaaagataaacatcgagacagagatagcaggcatcagcaggacagcgatctgtccgccgcttgcagtgatgctgatttacatcgccataagaaaaaaaaaaagaaaaaaaagcgtcactcaaggaaaagtgaagatttcgtgaaggacagcgagctgcatctgccacgagtgacatccctggagactgtggcccagtttaggcgggctcaaggtggatttcccctgagtgggggaccgccattagaaggggtcggcccattccgcgagaaaactaaacatctacgtatggaaagcagagatgacaggtgccgcttgtttgagtacggccaaggtgactag

SEQ ID NO: 60609 - DNA, 3372 bp, Artificial Sequence
  Description of Artificial Sequence: Synthetic coding sequence
atggatctgggaccaggtgacgcagctgggggtggcccactcgctccgaggccgaggcggcgtcgctccctacggaggttgttctctagattcttactggcccttgggtccaggagtagacccggtgactccccgccacggcctcagcctggacattgtgatggtgacggggaggggggatttgcctgtgccccagggccagtgccagcggcacccggtagtcctggggaggagcggcctcctggtcctcagccacagctacaactgcctgcaggtgatggcgcaaggcctcctggggcacagggcctcaaaaaccatggcaatacttgctttatgaacgcagtagttcaatgcctctctaacacggatctgctagccgaattcttggctctcgggcgatatagggctgctcctggcagagctgaagtcaccgagcaacttgcagctctcgtgcgcgctctgtggacccgcgaatacacacctcagctgtccgcagagttcaagaatgccgtatccaagtacggatcacagtttcaggggaatagtcaacacgatgctctggagtttctgctgtggctcctggaccgggttcacgaagatttggagggttcaagtaggggaccagtatccgagaaactaccccctgaggctacgaagacatccgagaattgcttatccccctccgctcagctcccactggggcagtcttttgtacagtcccacttccaggcgcagtaccgatctagcctgacctgcccacattgtcttaagcaaagcaacacgttcgatcctttcctctgcgtgtcactcccgattcctctcagacagacaagattcctttcggttacgctggtgtttcccagtaagtcacagcgctttctgcgggtgggtctggcggtgcctattttgtcaacagtagccgctctcagaaaaatggtagcggaagaaggaggggtgccggctgatgaggttatattggtggagctctatccgtcaggcttccagcggagcttttttgacgaagaggacttgaacactatcgctgagggcgataacgtctacgcttttcaagtgcctcctagtccatcgcaggggactctgagtgctcacccactgggactcagcgcgagtcctcgcctagcagcgagagaaggtcagcgattcagcctcagcctgcactccgagtccaaagtgttgatattgttctgcaacctggttggctcgggacagcaggccagccgtttcggaccgccatttctgatcagagaagacagagctgtttcatgggctcagttgcaacagtctattctctccaaggtcaggcatctcatgaagagtgaggcgcctgtgcagaatctgggtagtttattttccattcgagttgtggggctttcagtagcctgttcatacctcagccctaaggatagccgcccactctgccattgggcagtggaccgcgtattgcacctgcgcagacctggcggtccaccacacgtgaagctcgcagtggaatgggacagtagcgtgaaagagcgcctgttcgggtcactccaggaggaacgggcacaggacgcagacagcgtgtggcagcaacagcaggctcatcagcagcattcttgcacactggatgagtgttttcagttctacaccaaagaggagcagctcgctcaagacgatgcatggaagtgtccacattgtcaggtactccagcagggaatggttaagctctcactttggaccctaccggacatccttatcatacatctcaagagattttgtcaggtgggggagaggcgcaataagcttagcactctggtaaagttccccctctctgggctgaacatggctccacatgtcgcacagcggagtacatcccctgaagccggtttgggcccttggcctagttggaagcagccagattgcctgccaacttcctatcccctggatttcctgtacgatctgtacgccgtgtgtaaccaccatggaaatctgcagggcggacattataccgcttactgccggaatagcctcgacggacagtggtactcatatgatgactcaacggtagaaccactccgcgaagacgaagtgaatactcggggtgcctacatcctgttctaccagaagcgaaactccattcccccttggtctgccagtagttccatgcgtggctctacaagctcatctttgagtgaccactggcttcttaggctggggtctcatgcaggatctacacgcggaagccttctgagctggagtagcgcaccgtgtccctccctgcctcaggtgcccgattcacccatttttacgaatagcctgtgtaaccaggagaaagggggactggagcctcgtaggctcgtcaggggcgtgaaagggagatctatttccatgaaagcaccgacaacctcgcgcgctaaacaagggccattcaaaactatgccactgcggtggagcttcgggtcaaaagaaaagcctcccggtgcttccgtagaactagtggaatatcttgagtctaggaggcggcctagaagtacctctcagagcattgttagcctcctgactggaaccgcgggagaggatgagaagagtgcaagccctagatcgaacgtggcccttcccgctaattcagaggacggaggtcgggctatcgagagagggcctgccggagtgccctgcccttccgctcaacccaaccattgcctggccccaggtaactccgacggacccaacaccgctcgaaagctgaaggaaaatgccggtcaagacattaaattgccacgaaagtttgacctgccattaactgtcatgcctagcgtggagcacgagaaaccagcaagaccggaaggacagaaggcaatgaactggaaggagtcatttcaaatgggcagcaaaagcagtcccccttcaccttatatgggatttagcggcaattctaaggatagtagacgagggacgtctgagctcgaccggccactccaagggaccttgaccctgttacggtccgtgtttaggaaaaaagaaaataggcgcaacgagagggccgaagtgagtcctcaagtgcctcctgtttccctggttagcggaggactgtctcccgcaatggatggtcaagccccaggatccccccctgccttacgtatcccagaaggattggcaaggggcctgggtagtaggttggaacgggatgtctggtcagcaccttcgagcctgagattacctcgaaaagcttcccgggctcctaggggctctgcactgggaatgagccaacgtacagtacctggggagcaggctagctacggcaccttccagagagtgaagtaccataccctgtcactggggcgtaaaaaaaccctgcctgagtcctcattctag

SEQ ID NO: 60610 - DNA, 3357 bp, Artificial Sequence
  Description of Artificial Sequence: Synthetic coding sequence
atggatctgggcccaggggatgccgctggcggaggcccactcgctcccagacctcggagaagaaggtccctgagacgcctgttctctcgtttcctactcgctctgggttctaggtcacggccaggcgacagtccccctcgacctcagcctggtcattgcgacggcgacggcgagggaggattcgcctgcgcccctggtccagtccctgccgctcccggatctcctggtgaggaaagaccccctggcccacaaccacagctgcagctcccagcgggtgatggtgccaggccacccggagcacagggtctgaagaaccacggcaacacttgtttcatgaatgccgtggttcagtgcttgtccaataccgatctcctcgccgagtttttggccttggggcgatacagggctgcaccaggcagagccgaagtgactgagcagcttgccgctctcgtccgagcattgtggacccgcgagtacactccccagctgtcggctgagtttaaaaacgctgtgtccaagtatggctcacaatttcaggggaactcacagcacgatgccttggaatttctcctgtggctactggaccgggtccatgaagatcttgagggttcatctaggggacccgtctccgaaaaactgcccccagaggcaactaagacctccgaaaactgtctgtccccatctgcccagctcccactcggccagagtttcgtacagtcccacttccaggcccagtacagatcttctctcacctgtcctcactgcctcaaacagtcgaatacctttgacccctttctgtgtgtgagtttgccaattccccttcgccagacacgtttcctgagtgtgactctggtgtttccttcaaaatcgcagcgcttcttgagagtaggcctggccgtgcctatcctgagcactgtggctgctttgcggaaaatggttgccgaggagggcggagtgcctgcggatgaagtcatcctggtcgaactgtacccctcaggctttcagcgttcgttcttcgatgaggaggatcttaacaccatcgccgagggagacaacgtctacgcctttcaggttccaccatccccgagtcagggtactctgtcagctcaccccctagggttgagtgcatctccacgcctcgcagctcgcgaggggcagcgcttctccctgagcttgcattccgaaagtaaagtgctcatcctcttttgtaacttggtcggatctggacagcaggcctctcggttcggccctcctttcttaattagggaggaccgagccgtatcctgggctcagctgcaacagtctattttatccaaggtgcgccatcttatgaaatcagaggcccctgtgcagaacctgggcagtcttttctcaatccgagttgtcgggttatccgttgcctgtagctacctaagcccaaaggatagtcgaccactgtgtcattgggccgttgatcgagtactgcatcttagacgcccaggcggaccccctcacgttaagctagcagtagagtgggacagttcagtgaaggagcgtctcttcgggtcgctccaggaagagagggcccaagatgccgacagtgtgtggcagcaacagcaggcccaccagcaacacagctgcacccttgacgagtgttttcagttctacacaaaagaggaacaactggcgcaggacgacgcgtggaagtgtcctcactgccaggtgttgcagcaagggatggttaaattatcactttggacactgccagatatcctaattatacacttgaaaaggttctgccaggtgggagaacgcaggaataaattaagcactctggtgaagtttccactgagtggactgaatatggcacctcacgtagcccagaggtccactagcccagaggccggactgggaccctggcctagctggaaacagccggattgtctgccaactagctatcctttggactttctttacgacctctacgccgtctgcaatcaccatggcaacttacaggcctattgtagaaattccctggacggacagtggtactcctatgatgactccacagtcgaacccctccgagaagacgaggttaatacccggggtgcttatatcctgttttatcaaaagcggaattccattcccccttggagcgctagttcttccatgagaggctcaacgtcctcgtccttgagtgatcactggctgctgcgccttgggtcgcatgccggtagcacgagggggtctctgctttcctggagcagcgcaccgtgtccaagcctgccccaagtacccgattccccgattttcactaactcactgtgcaaccaggaaaaaggagggctagagcctcggcgacttgtaagaggtgtgaaaggacgatcaataagcatgaaggctccaaccacaagcagggctaaacagggtccctttaagacgatgcccctaagatggtcttttggatccaaagaaaagcccccaggggcaagcgtggagctggtggagtatctggaaagccgcagacgacctcggagcacctcacagagcattgtgtccctcctgaccgggactgctggcgaagatgagaaaagcgcctctccacgctctaatgttgcgctgccagccaattccgaggatggaggcagagccatcgaacggggtcccgctggcgtcccatgtccctccgcccaaccgaaccactgcctcgccccaggcaattctgacggacccaacacggctcggaagctgaaggaaaatgctggccaggacattaagcttcctagaaaattcgatctcccactcaccgtcatgcccagcgtggagcacgagaaaccagccaggccagagggccagaaagccatgaactggaaggagtcctttcagatgggctccaagagtagcccaccctccccctacatgggcttttcaggaaattccaaagattctagacgcggtactagcgaactggataggcccctgcaaggaaccctgacactgcttcggtccgttttcaggaagaaggaaaaccggagaaatgagcgggctgaagtgtcgccacaggttccacctgtgtccctcgtgtcaggaggactgagcccagccatggacggccaggcgcctgggagtccgcctgcattgagaattcccgaaggcctagctagaggactgggctccagactagagagagacgtgtggagtgccccttcttccctgaggctccctaggaaggcttcacgcgctccacgcggatccgctctggggatgagtcaacgcacagtaccaggcgagcaggccagctacggaacattccagcgagtgaagtaccacacattgtccttaggcaggaaaaaaaccctccctgagagctccttttag

SEQ ID NO: 60611 - DNA, 2445 bp, Artificial Sequence
  Description of Artificial Sequence: Synthetic coding sequence
atgcgtgtgaaagaccccacaaaggccctgcctgagaaggccaagcgtagtaagagacccaccgtgcctcacgacgaggacagctccgacgacatagccgtgggactcacctgtcagcacgtgtctcacgctatctcagtgaatcacgtgaagagggcaatcgctgagaacttatggtctgtatgctcagagtgtctgaaagagcggcgattttatgacgggcagttggttctcacctccgatatctggctgtgtctgaagtgcggtttccaggggtgcggtaaaaattcagaaagccaacattccctcaaacacttcaagtcttcgaggacggaacctcactgtattattatcaacttgagcacctggatcatttggtgttacgagtgcgacgagaagctgtccacacattgcaacaaaaaggtgttggcccagatcgtagacttcctgcagaaacacgcatctaagacccagactagcgcgttctcgcgcattatgaaattgtgtgaggagaaatgtgagacagatgaaattcagaaagggggtaaatgtcgcaatctttcggtgagagggattaccaacctgggaaatacctgtttcttcaacgccgtgatgcaaaatctagctcaaacttatacactcacagaccttatgaacgagataaaggaatcctctactaagctaaagatcttccctagcagtgacagccaactggacccactagtggtggaactgtcgcggcctgggcctttgactagtgccctattcctgtttttacactctatgaaagagaccgagaagggtccgctttctcctaaagtcctctttaatcaattgtgccaaaaggcacccagattcaaagacttccagcaacaggatagccaagagctcttacattatctcttggatgccgtccgtacagaggaaaccaaaaggatccaagccagtatcctcaaagcctttaataatccaacaactaaaactgccgacgatgagacacggaagaaagtcaaagcctacgggaaggagggcgtcaagatgaatttcattgatcgtatattcattggagaactgacatccacagtgatgtgtgaggaatgcgcaaacatttctacagtgaaggatcctttcatcgatatcagcctgcctattatcgaagagagggtaagtaagccacttctgtggggtcggatgaacaaatataggtccttgagagagaccgaccacgataggtatagcggtaatgtgaccatcgagaatattcaccaacccagagctgccaagaagcactcgagctcgaaggataagtctcagctgattcatgatagaaagtgcattcggaagttaagttcaggggaaacagtgacctaccagaagaacgagaatcttgagatgaatggcgattctctgatgttcgctagcttaatgaattcagagtcgcggcttaacgagagtccaacagacgacagcgaaaaggaggcctcccacagtgaatccaatgttgatgcagactcggaacccagcgagtctgagagcgcttccaaacaaaccggcctgtttcgttcatcttctggctcaggcgtccaacctgacgggcctttgtatccgttatctgctggtaaactcctgtataccaaggagactgattctggcgataaagaaatggctgaagccatctcagaacttcgactgagtagcacagtgactggcgaccaggattttgatcgagaaaaccagcctctgaacatttctaataatctatgttttctggaggggaaacatctgcgcagctactcaccgcagaatgcgtttcagacactgagtcaaagttatataacaacctctaaggagtgctctatccagagttgcctctatcaattcacctccatggagttgctgatgggcaacaacaagttgctgtgtgagaattgcacaaaaaataagcagaagtaccaggaggagacatcttttgctgagaagaaggtcgagggagtgtatacaaacgccaggaagcagttactaatctcagccgtgcctgccgtactgatccttcatctcaagcggtttcaccaggcaggtcttagcctgcgcaaggttaacaggcacgtggatttcccactgatgcttgacctggccccattttgctctgccacctgcaaaaacgcatcggtaggtgataaggtgctgtacggcctgtacggcattgtagagcacagcggttccatgcgcgagggccactacaccgcttacgtgaaggtgcgcacccccagccgcaaactatcggaacacaatacaaagaagaagaacgtccctggcctgaaggccgctgataatgagtcagcgggtcagtgggttcatgtgagtgatacttacttgcaggttgtaccagaaagccgtgctctatcagcccaggcttacctcctgttctacgagagagtcctctag

SEQ ID NO: 60612 - DNA, 870 bp, Artificial Sequence
  Description of Artificial Sequence: Synthetic coding sequence
atgcgtgtcaaagatcccacaaaggctcttcccgagaaagcaaagagaagcaagcgccctaccgttccacacgatgaagactcctctgacgacatcgccgtggggctgacctgccagcatgttagccacgcaatttccgtgaaccacgtgaagcgcgctattgctgagaacctttggtccgtttgcagtgagtgtctcaaggaacgacggttctatgacggtcagctggtgctaactagcgacatctggctttgcctcaagtgcggatttcaggggtgtggcaagaactccgagagccaacatagcctcaagcatttcaagagcagtcggaccgagccccactgcataatcattaacctgtcgacctggattatatggtgttacgagtgcgacgagaagttgagcacacactgcaataagaaggtgctcgcccagattgtggatttcctccaaaaacacgcctctaaaacacaaacgagtgccttttcccgcatcatgaagctgtgtgaggaaaagtgcgagacggacgagattcagaagggcggtaaatgcaggaatcttagtgtcagggggattaccaatctgggcaacacatgtttctttaatgctgtgatgcagaatctggcccagacctacactctgacggacctgatgaatgagattaaggagagcagtacaaaattgaagatcttccccagctccgactctcaactcgacccacttgtggtggagctcagtcgccctgggcctctgacctccgcactattcctgtttttgcactctatgaaagagaccgagaagggacctctcagtccaaaggttctgtttaatcaactttgtcaaaagtgggttcatcttcatttaatttag

SEQ ID NO: 60613 - DNA, 549 bp, Artificial Sequence
  Description of Artificial Sequence: Synthetic coding sequence
atgagggtgaaagaccctactaaggccttacctgagaaggctaagcgcagtaaaagaccgacagtaccccacgacgaggactcctctgacgacatcgcggtaggcttaacttgccagcatgtgtctcacgccatttccgtgaaccatgtaaaaagggctatcgccgaaaacctgtggtctgtatgtagtgaatgtctcaaggaacgtagattttatgacggccagcttgtattgacatccgatatctggctttgcctgaaatgtggcttccagggttgtggaaagaactccgagagccagcacagtctcaagcattttaagtctagcagaactgagcctcactgcatcataatcaatctgtccacctggatcatctggtgttacgagtgtgatgagaagctgagtacgcactgtaacaagaaagtgctggctcagatcgtggatttcttgcaaaagcatgcgtctaagacccaaacacggcctggccctatcctgattcacctgttctctatcaactgcctaggtgcacattcggagtcagtctgttag

SEQ ID NO: 60614 - DNA, 1485 bp, Artificial Sequence
  Description of Artificial Sequence: Synthetic coding sequence
atgcggtctaaaaaagtggtccagaatagccgtttttttctgccgcaaactttaagctgggcacctcggtttaaagactttcagcaacaagattcccaagaactgctgcactatttactggatgcggtgcggacagaagaaactaagattagcacagtaaaggacccctttatcgacatcagcctgcccatcattgaagaaagagtaagtaagcccctgctttggggcaggatgaacaaatatcgtagtcttcgtgaaactgatcacgacagatattctggaaatgtaactatagaaaacattcatcaaccaagagccgctaagaagcattcaagctctaaggacaagtcacagctgatccacgacagaaagtgcatcaggaagctatctagcggcgaaaccgtcacctaccaaaagaatgagaatttggaaatgaatggcgacagcctcatgttcgctagcttgatgaattccgagtcccggctgaacgagagccctaccgatgactccgaaaaggaagcatcccattcagagtctaatgtggatgctgattccgagccatcagagtcggaatccgcttcaaagcagacaggactgttcaggagtagctccgggagcggcgtccagcctgatgggccactgtacccactgagtgctggcaagctgctctatacaaaggagaccgacagcggggacaaggagatggccgaggctatctccgagctaaggttgagttccaccgtgaccggagatcaggatttcgatagggagaaccagccgctaaatattagcaacaacttatgcttccttgaaggcaagcacttacgttcgtacagccctcaaaacgccttccagacactttctcaatcttatatcacaacttctaaagagtgttccatccagtcatgcctgtaccagttcacatctatggagcttcttatggggaacaacaaacttctttgtgagaattgtaccaaaaacaagcaaaagtaccaagaagagacaagctttgccgaaaaaaaagtggaaggcgtgtacacaaacgcaagaaaacagctcctaattagtgctgtgccagccgtcctgatactgcatcttaaaaggtttcaccaagccggtctctccttaaggaaagttaaccggcacgtggactttccgcttatgttagatcttgctccattctgctcggctacctgtaaaaatgctagcgtgggggataaggtgctatatgggttgtacggcatagtcgagcatagtggcagcatgcgagagggtcattatacagcatatgtcaaagttagaaccccctctaggaagctcagcgaacacaatacaaaaaagaaaaacgtccccggtctgaaggctgccgacaacgaaagcgcaggtcagtgggtgcatgtgtctgacacgtacttacaagtcgtcccagagagtagagcactgagcgcccaagcgtatctgctgttttacgagcgggttctgtag

SEQ ID NO: 60615 - DNA, 870 bp, Artificial Sequence
  Description of Artificial Sequence: Synthetic coding sequence
atgagagttaaggatccgaccaaagccctgccagagaaggctaagaggtccaagcgtcctacagttccacacgatgaggactcaagtgatgatattgccgttggtctgacctgccaacatgttagccatgcaatttctgttaatcacgtgaagagggcaatcgcagaaaatttgtggtccgtgtgctccgagtgtctgaaggagcggcgattctatgacgggcagttggtcctgacttctgatatttggctttgtctgaagtgcgggttccaggggtgtggaaagaactctgagtcacagcatagtcttaagcattttaaaagttcaagaaccgagccacattgtatcattattaacctctcgacttggatcatttggtgctacgaatgcgacgaaaaactgagcacccactgcaacaagaaggtacttgcccagattgtggacttcctacagaagcacgcttccaaaacccagacgtccgcctttagtcgtataatgaaactgtgtgaggagaaatgcgaaaccgatgagatccagaaaggcggaaagtgtagaaacctctctgtgagagggatcacgaacctgggcaatacctgcttcttcaacgccgttatgcagaatcttgcacagacgtacaccctgaccgatctaatgaacgaaattaaggagtcctctactaaactaaaaatcttcccctccagcgacagtcagctggaccccctagtggtggagctctcaagacctggcccactgacttcagccctgtttctgttcctgcattccatgaaggagaccgagaagggccctctgtctccaaaagttctgtttaaccagctctgtcaaaagtgggtacatctccatcttatttag

SEQ ID NO: 60616 - DNA, 2445 bp, Artificial Sequence
  Description of Artificial Sequence: Synthetic coding sequence
atgagagtcaaggaccctactaaagccctccccgagaaggctaagaggtctaagcgccctaccgtgccccacgatgaggattcatcggatgacatcgcggtgggtctgacctgtcaacacgtgtcacatgctatctccgtgaatcacgtaaagcgcgcaatagctgagaacctgtggagtgtctgtagtgagtgtttaaaggagcgccgtttttatgacggccagctagttctcacctcggacatctggctgtgtctgaagtgcgggttccagggctgtggcaaaaactcagagagtcagcattctctgaaacactttaaatccagccggacagagccccattgtatcatcataaacttgagcacatggatcatctggtgctacgagtgcgacgagaagctctcaacacactgcaataaaaaggttctggctcagatagtggacttcttgcagaaacacgcttctaaaacacagacaagtgctttttcacgtatcatgaagctgtgcgaggaaaagtgcgaaaccgacgagattcagaaaggagggaagtgccgaaacctgagcgtgagaggcatcactaaccttgggaatacttgcttcttcaacgccgtcatgcaaaatttggcccagacatatactctcaccgacttgatgaacgaaatcaaggagtccagcacgaagctaaagatctttccatctagcgattctcagctggatccactcgtggtggagctttctagaccagggccacttacgtccgctctgtttcttttcttgcactcaatgaaggagacagagaaggggccactgagcccgaaggtcctgttcaaccagctgtgccagaaggctccacgctttaaagatttccagcaacaggatagccaggagctactgcactacttacttgacgctgtgcggactgaggaaacaaagagaatccaggcctctatactcaaagcttttaataatcccactacaaagaccgccgacgatgagactcggaagaaagtgaaagcctacgggaaggaaggcgttaaaatgaattttattgacaggatctttataggcgagctgacctccactgtgatgtgtgaagagtgcgcaaatatctctacggtgaaagacccctttatcgatatcagcctccccattattgaagaaagagttagcaaacccctcctctggggcagaatgaacaaataccgctcgttgagggagacggaccacgatagatatagtggtaacgtgactatagagaatatacaccagcccagggctgccaagaagcactctagctccaaggataaaagccagctgattcacgatcgcaagtgcattaggaaactgtccagcggagagacagtcacataccagaagaatgaaaaccttgagatgaatggcgatagcctgatgtttgcaagcctcatgaacagcgagagcagactgaatgaaagcccaacggatgacagtgagaaggaagcttctcactctgagtccaacgtggacgcagactccgaaccatccgagagcgagagcgcctccaaacagaccggactgtttcgctcttcctccggctccggagtgcaacctgacggtcctttgtatcccttgagtgcagggaaactcttgtatacgaaggagaccgactctggagacaaggaaatggccgaggccatcagtgaactgcgcctaagctctaccgtgaccggggaccaagacttcgatcgagagaatcagccattgaatattagcaacaacctgtgtttcttagaagggaaacatctccgtagctatagcccccagaacgctttccagacactttctcagtcctatattactacaagcaaggagtgcagcattcagagctgcctctaccagttcactagcatggagcttctaatggggaacaacaagctgctgtgcgaaaactgcacaaaaaataaacagaagtaccaagaagaaacctcttttgcggagaagaaagtagagggggtgtacactaacgcacggaaacagttgttaatcagcgcggtcccagcagtacttatcttgcatctgaagagatttcaccaagctggcctgagtttaagaaaagttaatcgtcacgttgatttccctctcatgcttgatctggcgccattctgcagcgccacatgcaagaatgcatcagttggcgacaaggtactgtacggactttatggtatcgtggaacactctgggtctatgagagaaggacattatactgcatacgttaaagtccggactccttcccggaagctctccgaacacaatacaaagaagaagaatgtccctggcctgaaagctgctgacaatgagtccgccggacagtgggtacacgtttcagacacttatctgcaggtggtacccgagtctagagccctgtccgcccaggcatatctgctgttttacgaacgcgtgctatag

SEQ ID NO: 60617 - DNA, 159 bp, Artificial Sequence
  Description of Artificial Sequence: Synthetic coding sequence
atgcgagtgaaagaccccacaaaagctctccctgaaaaagcaaaacgtagcaaaagacctacggtgccacacgacgaagactcaagtgacgacattgccgtaggtctgacatgtcagcacgtgagccatgccataagcgtaaatcacgtgaaacggtag

SEQ ID NO: 60618 - DNA, 324 bp, Artificial Sequence
  Description of Artificial Sequence: Synthetic coding sequence
atgctggatctagcacctttttgttctgccacgtgtaagaatgcttccgttggggataaggtattgtatggcctctatggcatagtggaacacagcgggagcatgcgggaagggcactataccgcttacgtgaaggtccgcaccccaagccggaagttatccgagcataacaccaaaaaaaagaacgtgcccggactcaaagcggcagacaacgagtcagcaggccaatgggtgcatgtgtctgatacctacctgcaggtggtacccgagtcgagggccctgtctgcacaggcctatctgctattttatgagagggtgctgtag

SEQ ID NO: 60619 - DNA, 1923 bp, Artificial Sequence
  Description of Artificial Sequence: Synthetic coding sequence
atggataggtgtaaacacgtgggccgtcttcgccttgcacaagatcacagcatcctcaatcctcagaaatggtgctgcttggaatgtgccaccacagagtccgtctgggcatgcttaaaatgcagtcacgtcgcttgcgggagatacatcgaagatcatgcactgaagcattttgaggagactggtcaccccctggccatggaagtgagagacttatatgttttctgttacctgtgcaaagattacgttctgaatgacaatcccgagggagatctcaaacttctgaggagcagtttgctagcagtgcgcggtcaaaaacaagataccccggtgagaaggggcagaacattgcgatcaatggcctctggcgaggacgtcgtactgcctcagagggccccacagggccagcctcagatgctgaccgccctctggtatcgcagacaacggttgctggcaagaaccctgcgcctgtggttcgaaaagtccagccggggacaggccaaactagagcagcgacgtcaggaggaggcactcgagcgaaaaaaagaggaggcacggagacggagacgcgaggtgaaaagaaggttgctggaagaactcgctagcacgcccccacgcaagtccgcccgactcttacttcataccccaagggacgcaggcccagccgcatcacgcccagcagctcttcctacttctagacgcgttccggctgcaacactcaaactccggaggcaacccgctatggccccaggcgtgacaggcctacgcaacctgggcaacacctgctacatgaattccattctgcaggtgctgagccatttacagaagtttcgggagtgcttcttgaatctcgatccctccaaaactgaacatctcttccctaaagcaacaaatggtaagacgcagctgagcggaaaaccaactaactcgagcgcaaccgagctgtcgctccgaaacgaccgagccgaagcatgtgagcgcgaggggttttgctggaatgggagagcgtcaatcagccggtccctcgagctgattcagaacaaggaaccctccagcaaacacataagcctctgccgcgaattacacactttgtttagggttatgtggtccggtaagtgggccctagtgagccccttcgctatgctccattcggtgtggtctctgataccagcctttaggggctatgatcaacaggatgcacaggaatttctctgtgaacttttgcataaagtccagcaggagcttgagtctgagggaaccacgcgacgcatcctgatccccttctcacaaaggaaactgactaagcaagttctgaaagtggtaaatacaatctttcacgggcaactgctgtcccaggtgacctgtatatcttgtaactataaaagcaacactatcgaaccgttttgggacctctctctggaattccccgaacgataccattgcatagaaaaaggctttgtcccgttgaatcagacagagtgtttgcttaccgagatgctggccaagtttaccgagacagaggccctggaaggaaggatctatgcttgtgatcagtgcaattctaaacggcgtaagagcaaccctaagcctcttgtgctgtcagaggcaaggaagcagctcatgatctaccggctcccccaggtgctgaggttgcacctaaaacgcttcagatggagtggcaggaaccatcgtgagaaaattggcgtgcacgtggtatttgatcaggtgctgaccatggagccttattgctgccgagacatgctatcctctctggacaaggaaacctttgcttatgatttgtctgcagttgtaatgcaccatgggaaagggttcggttcaggccactatacggcctattgctacaacacagaaggaggagcttgtgccctgctgtgtggggtaggggacactgaaagaggctag

SEQ ID NO: 60620 - DNA, 1923 bp, Artificial Sequence
  Description of Artificial Sequence: Synthetic coding sequence
atggacagatgcaaacatgtgggtcgcctaaggttagcccaagaccattccatcctgaacccccagaagtggtgctgtctggagtgcgccaccacggaatcagtttgggcttgccttaaatgttctcacgtggcctgcggaagatatattgaggatcacgcactcaaacactttgaggagacgggacaccctctcgcgatggaggtgcgggacctatatgttttttgttacttgtgtaaagattacgtcctcaacgacaacccagagggagacctgaagttactgcgatccagcctgctggctgtgcgcggacaaaaacaggacactcctgtgcggcgagggaggaccttaaggtccatggccagcggcgaagacgtcgtgttaccacaacgcgctccgcaaggccaaccacagatgctgaccgctctgtggtatcgaaggcagcggcttctggccaggacgttgaggctgtggttcgagaaatcatcacgaggacaagcaaagctagagcagaggcgccaggaggaagccctggaaaggaagaaagaggaggccaggcgcagaaggagggaagtcaagaggcgcttgcttgaggaactggcgagcaccccccctcgcaaatctgcacggttacttctccatacacctagggatgccggtccagctgcatccagacctgccgctttgcctacatcccgtcgagtaccagctgcgaccttgaagctgcgcaggcaacccgcaatggctcctggtgtgaccggccttcggaacttgggcaatacatgctatatgaactccattctgcaggtattgtcccacttacagaaatttcgcgagtgtttccttaaccttgatccctccaagactgagcacttgttccctaaggccaccaacgggaaaacccagttgagcgggaagccaaccaactctagtgccactgagttgtcactccgtaacgacagagcggaagcttgcgaacgagaaggcttctgttggaacggtcgggcaagtatttcacgatccctggaacttattcaaaacaaagaaccatccagcaagcacatatccctgtgtagggaactgcacaccctcttcagagtgatgtggtcaggtaaatgggccctggttagtcccttcgccatgctgcattctgtgtggagcttaattccagcatttaggggctacgaccagcaggacgcccaggagtttctctgcgagctcctacataaggtgcagcaggaacttgagagcgaaggcacaactcggcgaatcttgatcccttttagtcagcgcaagctgacaaagcaggtcttaaaggtggtgaatacaatctttcacggacagctcctatcacaagtgacgtgcatcagctgtaattacaaatccaataccattgaacctttttgggatttgtccctagagttcccggaaaggtatcattgcattgagaaaggcttcgtgcccctaaaccagaccgagtgtctcctcactgagatgctggcaaaattcaccgaaaccgaagccctggagggcagaatatacgcatgcgaccagtgcaactccaaaagacgcaaatccaatccaaaaccactggtactgagtgaggccagaaaacagctaatgatttatcggctgcctcaggtcctgagactccatttaaaacgttttagatggtccggccgtaatcaccgggagaaaatcggcgtgcacgtggtcttcgatcaggtcttgaccatggagccatattgctgtcgggacatgctgtcttctctggacaaggagaccttcgcgtacgatctgtctgcagtggtgatgcatcacggcaaaggctttggcagcgggcactacaccgcgtactgctacaacacggaggggggagcatgcgcccttctgtgcggcgtcggtgatacagaacgcggatag

SEQ ID NO: 60621 - DNA, 2067 bp, Artificial Sequence
  Description of Artificial Sequence: Synthetic coding sequence
atggatcgttgtaagcacgttggcagactgcgcctggcgcaggatcattctattctgaacccccagaagtggtgttgcttggagtgtgccactaccgaatcagtgtgggcttgtctgaaatgctcccacgtggcgtgtggccgttacattgaggatcacgctcttaagcatttcgaagagaccgggcatcccctggcaatggaagtgagggatctttacgttttttgctacctatgtaaagattatgtgctgaatgacaacccggagggtgacctgaagttattgcggtcatcgctgttagccgtcaggggccagaagcaggataccccggttcgcagaggtagaacgctgaggtctatggcatccggtgaggacgtagtgcttccgcagcgtgcaccccaagggcagccccagatgttaactgcgttgtggtacaggcgacagcgcctgctggccaggacactcaggctctggtttgagaaaagttcaagaggacaggcgaaattagagcagcgtcgacaggaagaggcccttgagagaaagaaggaagaggcacgacgcaggagacgcgaggtcaagcgcaggctgttggaagagctcgcgtctacccccccaagaaaaagtgctcgactgctgcttcacactccaagagacgccggacccgcagcgagtaggccagctgccttgccaactagcaggagggtcccagctgcgactctgaaattgcggcgacaacctgcgatggcaccgggtgttaccggcctccgtaaccttggaaacacctgctacatgaactccatcttgcaagtcctttcccacctgcagaagttcagagagtgttttttaaaccttgacccgtccaaaaccgaacacttgtttcctaaagcaactaacggcaaaacccagctaagcggtaagccaacgaattcatcagctactgagcttagcctgcgaaacgacagggcggaggcctgtgagcgagaggggttttgctggaatggacgggcttcaattagtcgcagtctggaactgatccagaacaaggagcccagtagcaaacacataagcctgtgccgggagctgcatacgctgtttcgcgtcatgtggtcagggaagtgggctttggtgtcgcctttcgcaatgcttcatagcgtttggagcttaattccagccttcaggggttacgaccagcaggatgcccaggagttcctctgcgaactgttgcacaaagtgcaacaggaattggaatcagaagggactaccaggagaattctgatcccctttagccaacggaagctgaccaagcaagttcttaaggtcgtcaatacaatctttcatggccagctgttgtcacaggtgacctgtatcagttgtaactataagtctaacacaattgagcccttttgggatttatcgcttgagtttcctgagagataccattgcattgagaaaggtttcgttccacttaatcagacggagtgtctgctgaccgagatgcttgctaaattcacagagaccgaggcactagagggtaggatttacgcctgtgaccagtgcaatagtaagcggcgaaagtccaatccaaagccactcgttctgtccgaggcccgtaaacaattgatgatttacaggctcccccaggtgttgcgcctacatctgaaaaggtttagatggtcaggacgcaatcatcgcgagaaaatcggggttcacgtagtgttcgaccaagtcctgacgatggaaccgtattgctgtcgcgacatgctcagtagtctcgacaaagaaacttttgcctatgatcttagtgcagttgttatgcaccacggcaagggttttggctccggccattataccgcctattgctataatactgagggagggttttgggtccattgtaacgacagtaaactcaatgtatgttctgtggaggaggtttgcaagacacaggcttatattttgttttatacgcagaggactgtgcaggggaatgccagaatctcagagacccatctccaggctcaagtgcaatcttcaaataacgacgagggccgtccccagaccttctcctag

SEQ ID NO: 60622 - DNA, 2067 bp, Artificial Sequence
  Description of Artificial Sequence: Synthetic coding sequence
atggaccgttgcaagcacgttggcagactgcggttagcgcaggatcacagtattcttaacccacagaagtggtgctgcctggaatgtgctaccacggaatcggtttgggcgtgccttaagtgcagtcatgtggcttgtggccgttatatagaagatcatgcgctgaaacattttgaagagaccggacaccccttagcgatggaggtccgggacctctacgttttctgttacctttgtaaggattacgttctgaatgataaccctgagggagatctcaagttgcttcggtcaagcctgcttgcggtgagaggtcaaaagcaagatactccagtgcggaggggccgaactctccgttctatggccagcggcgaggacgtggtgctgccccagcgggctccacagggtcagccccagatgttgaccgccctttggtatcgccgtcaacggctgctcgctcgaacattacgtctctggttcgagaagtcatccagaggccaagcaaaactcgagcaacgccgacaggaagaggcactcgagagaaagaaggaggaggcccgtagaaggagacgagaagtgaagaggcgactgctcgaggagctggcttcaaccccccctagaaagagtgccagacttctccttcatacacccagagacgcaggccctgcagcctctagacctgccgctctgcctacttctagaagggtgcccgcagctacccttaaactccggagacagcccgcaatggctcctggagtgaccggtctcaggaatctgggtaatacatgctatatgaattccattctccaggtgctgagtcatctgcagaaatttagggagtgcttcctgaatctggacccatccaaaaccgaacacctgttccctaaagcaactaatgggaaaactcaattgagcgggaagccaaccaattcctccgccactgagctttctctgagaaatgaccgggcagaggcctgcgagagggagggcttctgctggaacggccgagcgtccatcagcagatcactcgaactcatacagaataaggagccttcgagtaaacatatctccctatgcagggaattgcacaccctattccgagtgatgtggtcaggcaaatgggctcttgttagcccatttgcaatgctccacagcgtgtggtcactaatccccgctttcagaggttatgatcagcaagatgctcaagaattcctgtgtgagctcctgcacaaagtgcagcaagagcttgaaagcgagggtaccactcgtcggatattgattccgtttagccaacgcaagttgaccaagcaagtactgaaggtcgtgaataccattttccatggacagctcctgtctcaggtcacatgcatatcatgcaattacaagtccaatactatcgagcctttctgggacttgagcttagagtttcccgaaaggtaccactgcatcgagaaaggattcgttcctctgaaccaaaccgagtgtctcctgactgagatgttggctaagtttaccgaaacagaagctctggaaggcagaatttatgcctgcgatcagtgcaactccaaacgcagaaaatcgaaccccaagcctcttgtgctatccgaagcaagaaagcagctaatgatttatcgactgccccaggtactaagactgcacctcaagaggtttcggtggtcgggtcggaatcatagggagaagatcggtgtgcacgtagtctttgatcaggtgctcaccatggagccatattgttgtcgagacatgctttccagtctcgacaaagagacgttcgcatatgacttgtcagccgtcgtgatgcaccatggcaagggattcgggtcaggtcattataccgcgtattgctacaacacagaaggcggattttgggtgcattgcaatgatagtaaactgaatgtttgtagcgttgaagaggtttgtaagacacaggcctacattctgttctatacccagcgtacagtgcagggcaacgccagaatctctgagacccacctccaggctcaggtacagtcaagcaacaacgacgagggacgtcctcagactttttcctag

SEQ ID NO: 60623 - DNA, 48 bp, Artificial Sequence
  Description of Artificial Sequence: Synthetic coding sequence
atggatcgctgcaagcacgtgggtagactgcgcctcgcccaggactag

SEQ ID NO: 60624 - DNA, 114 bp, Artificial Sequence
  Description of Artificial Sequence: Synthetic coding sequence
atggatcggtgtaaacacgtcgggcgactgaggctggcacaagaccattcaatacttaacccccagaagtggtgttgtctcgagtgcgctacaaccgaaagtgtctgggcttag

SEQ ID NO: 60625 - DNA, 1005 bp, Artificial Sequence
  Description of Artificial Sequence: Synthetic coding sequence
atgacatcccagccgtctctgccagctgacgatttcgacatttatcatgtcttggctgagtgcaccgattactatgataccctgccagtgaaagaagcagatggaaatcagcctcacttccagggcgttactgggctgtggaacctgggcaacacatgctgcgtaaacgctatctcacaatgtctgtgcagcatcctcccgctggtggagtacttcctcactggcaaatacatcacagctctgcagaacgattgttcagaagtggctacagccttcgcatatctcatgacagatatgtggctgggcgacagtgactgcgtgtcccccgagatcttctggagtgccctcggcaacttgtaccccgcatttacaaagaagatgcagcaggatgctcaagaatttctcatctgcgtgctcaacgaactccacgaggcattgaagaagtaccattactccagacggcgttcctatgagaagggatcaactcagaggtgctgccgcaaatggattacaacggagacctctatcataacccaactgtttgaggagcagctcaattattctattgtgtgtttgaagtgcgaaaagtgcacttataagaatgaagtttttaccgtgttcagcctgcctatcccttccaaatatgagtgctccctccgagattgtctgcagtgtttcttccaacaggacgctctgacctggaataatgagatccactgctctttttgcgagactaagcaagaaaccgcagtccgcgcatcgatttctaaagctcctaaaatcatcatcttccatctcaagcgtttcgacattcagggtacaaccaagcgcaagcttcgtactgacatccactaccccttaacaaacctggacctgactccatacatctgctctatatttcgcaagtatcctaaatataacctctgtgccgtcgttaaccacttcggagatttagatggcggacactacaccgctttctgcaagaatagcgtcacacaggcgtag

SEQ ID NO: 60626 - DNA, 2136 bp, Artificial Sequence
  Description of Artificial Sequence: Synthetic coding sequence
atggcgcaggttcgcgagacttcactcccctctggaagtggcgtccgctggatttccgggggaggtggcggagccagtcccgaggaagccgttgaaaaagctggcaaaatggaagaagccgctgccggtgcaactaaggcaagctctcggagagaagcggaggagatgaaactggagcccttacaggaaagagagccagctcctgaagaaaacctcacttggagcagcagcgggggtgacgaaaaggttttgcctagcatccctctgcgatgtcattcaagtagtagcccagtgtgcccacggcgaaaaccacggcctaggccacagccaagagcaagaagccgatcccagcctgggctgtcagctcccccacctccacctgccaggccccctcctcctcctcctcctcccccacctccagcaccaaggccacgggcttggagaggctctcgccgtcgctcacgtcccggtagccgcccacagactcggagatcttgttccggcgacctggacggctcaggagaccctggcggtctaggggattggctgctggaggtggagtttggacagggacctacaggatgttcacacgtggaatcctttaaggtgggaaagaactggcagaagaacctgaggcttatataccaacgatttgtgtggagcgggacaccggagacacgcaaaagaaaagccaagagttgcatttgtcacgtgtgtagcacacatatgaaccgattgcattcatgcctgtcttgtgtgttttttggctgttttactgagaagcatatacataaacacgccgagaccaagcagcatcatttggcagtcgacctctaccacggggtcatttactgctttatgtgcaaggattacgtgtacgacaaggacatcgagcaaatcgccaaagagacgaaggagaaaattctaaggctactcactagcaccagcactgacgtgtcccatcagcagttcatgacgagcgggtttgaagataagcagtcaacttgtgagacaaaggagcaagaacccaagctcgtgaaacccaagaagaagcggaggaagaaaagcgtctataccgtggggctgagaggtttgatcaatttgggtaacacttgttttatgaactgcatagtgcaggctctgacacatattccgctactcaaagatttctttctttcggataaacacaagtgcattatgacgtccccatccttatgtctggtgtgtgagatgtcctctctgttccatgctatgtatagcggctctagaaccccgcacattccatataaacttcttcacctcatctggattcatgctgagcatctcgccggatacaggcagcaggacgctcatgaatttcttatagccattctggacgtgctgcacagacatagtaaagatgattctggcggacaggaggctaataatcccaactgttgcaactgtatcattgaccagatttttaccggcggtctgcagagtgatgttacgtgtcaagcatgccactcagtgagtactactatcgatccgtgctgggacatctcactcgatcttcccggttcttgcgctacattcgatagccagaatcccgagcgagccgacagcacagtcagtcgggacgaccatatcccgggaatcccaagcctgactgactgcctgcagtggtttacaaggcctgaacaccttggcagctctgctaagattaaatgcaattcctgtcaaagctatcaggaaagtaccaaacagttgacaatgaagaagctgcctatcgtagcctgttttcacctgaagcggttcgagcatgttgggaaacagcggagaaaaatcaatactttcatatcctttcccctggagctggatatgaccccatttctggcttctaccaaagaatcacggatgaaggaaggccagccaccaaccgactgcgttccaaacgagaacaagtactcactgttcgccgtgatcaatcaccacggcactctggagtcaggacactacacttcattcataaggcagcaaaaagaccagtggttttcatgcgacgatgccatcatcacaaaggctaccatagaagacttactctacagtgaaggctacctactcttttatcacaaacagggcctggagaaagattag

SEQ ID NO: 60627 - DNA, 3222 bp, Artificial Sequence
  Description of Artificial Sequence: Synthetic coding sequence
atggcctgggtcaaattcctgaggaagcccggtggaaatctcggtaaagtctaccagccaggctctatgctgagtttggcgcctactaaaggcctactgaacgagcctggccagaatagctgttttcttaattccgcagttcaggttctgtggcaactcgacatattccgccgttccctgcgagtcctgacaggccatgtgtgtcagggcgatgcttgcattttttgcgcattaaaaacaatttttgcccagttccagcattcccgggagaaagccttgccctcagataatattaggcacgcgcttgccgagagcttcaaggacgagcagcgctttcagcttggcctgatggacgatgcagccgaatgttttgagaacatgctggagcgaattcactttcacatcgtgccctcccgagacgcagacatgtgtacctcaaaaagctgtatcacgcaccagaagtttgctatgactctatacgagcagtgtgtgtgcaggtcatgtggggcatcgtctgatcctctgcctttcacagagtttgtcaggtacatctctacaacagccttgtgtaacgaagttgagaggatgctggagcgtcatgagcgtttcaaaccggagatgttcgccgaactgcttcaggccgcaaatactaccgacgactatcgcaagtgcccaagcaattgcggccagaagattaaaatccgcagggtgctgatgaattgtcccgagattgttaccatcgggcttgtttgggatagtgagcactctgaccttacggaggctgtggtccggaatctcgcgactcatctttacctgcctggcctgttttatagagtgaccgatgagaacgccaagaattcggaactgaacctagtcggaatgatctgttacacctcccagcattattgtgcatttgctttccacacaaaatcatcaaagtgggtgttcttcgatgatgccaacgtgaaggaaataggtacacggtggaaagacgtggtgagcaagtgtatccggtgccattttcaaccactgttgctgttttatgccaaccctgacggaacagccgtatcaactgaagatgcactgagacaggtcattagctggtctcactataagtctgttgcagagaatatgggctgcgaaaagcccgtaatccacaagtcggataacctcaaagaaaatggtttcggagatcaggccaagcagcgggagaaccaaaagttccccacagataatatttcgagctctaatagaagccacagccacaccggcgtgggtaagggccctgccaaattaagccacattgatcagcgtgagaagattaaagatatctccagagagtgtgcactcaaggcaatagaacagaagaacctgttgagctcccaacgcaaggacctggagaaaggccagcgcaaggatctcggaagacatcgagatttagttgatgaagatttaagccactttcagagtggttcacccccagcccctaatggatttaagcagcatggaaaccctcacctgtaccacagccaaggcaaggggtcatacaagcatgacagagtcgtcccccagagtcgggctagtgcccagattatctcatcctctaagtcccaaatactggctccaggcgagaaaatcactggcaaggtcaaaagtgacaatggaactgggtatgacaccgactcttcgcaagatagcagggaccgtggaaacagctgcgatagcagctctaaatcgcgaaacagaggttggaagcccatgcgtgaaactctaaacgtggattcaatctttagcgaaagcgagaaaagacagcacagcccaaggcacaagcctaacatttccaacaaacctaagagctctaaagacccttcattttctaattggcccaaagagaacccaaagcagaaggggctcatgactatctacgaagatgagatgaagcaggagatcggatctaggtcaagcctggagtctaacggtaagggcgctgagaagaataaaggacttgtggagggtaaggtgcatggtgacaattggcagatgcagcgcacggaaagcggttatgagagctcagaccatatttcgaacgggtccaccaacctcgactcacctgtgatcgacggaaacggaactgttatggatattagtggcgtgaaggaaacagtttgcttctctgaccagattactactagcaacctcaacaaagagcgcggagactgcaccagcttgcaatcacagcaccatttagaaggcttccgaaaggaactgcgcaacttagaggccggatacaaatcacatgaattccaccctgagagccacttacagattaagaatcatctgatcaagaggagccacgtccacgaagataatgggaagctcttcccctcatcttctctacagatacctaaagatcacaacgctagggaacacatccaccagagcgacgagcaaaaactcgaaaaacccaacgagtgcaaatttagcgagtggttaaacatcgagaactccgaacgcactggcctcccattccacgtggataactctgcttctggaaagagggtaaattctaatgagccaagcagcctctggtcatctcacctgagaacagtcggactgaaaccagaaactgcaccccttatacagcagcagaatattatggatcagtgctatttcgagaattcccttagtactgagtgtatcatcagaagcgcaagtagatctgacggctgccagatgcctaagctgttttgtcagaacctgccgccacccctgcccccaaaaaagtacgctattacctctgtgccccagagcgagaaatcagaaagtaccccagatgtgaaattgaccgaagtgttcaaggccactagtcacctgcccaagcactccctgagcaccgcttccgagcctagcctggaggtctccacccatatgaacgacgagcgacacaaagaaacctttcaggtgcgagagtgcttcgggaataccccaaactgcccctctagctcttccactaacgattttcaggccaattccggagctattgatgctttctgccaacccgaactcgactctatatctacctgtcctaacgagacggtgtccctgaccacatactttagcgtggacagctgcatgactgatacgtatcgactaaagtaccatcagcgccctaagttatcctttcccgaatcctccggcttctgcaacaactccctgagttag

SEQ ID NO: 60628 - DNA, 3222 bp, Artificial Sequence
  Description of Artificial Sequence: Synthetic coding sequence
atggcttgggtgaagtttcttcgcaagcctggtggtaatctcggaaaagtgtatcagcccggatcaatgctgagtctcgcccctacaaaaggactgctgaacgagcccggtcagaacagttgttttctaaacagcgctgtgcaggtgctgtggcagctggacattttccggaggtctctgagggttctgacgggtcacgtatgccaaggagatgcctgcattttttgtgcactgaagacaatttttgcgcagttccagcacagccgcgaaaaagccctcccgtcagacaacattcgacacgctttagctgaaagcttcaaggacgaacaacgcttccaactgggactgatggacgacgccgcagagtgctttgaaaatatgctggaaagaatccatttccacatcgtgccgtcccgcgatgccgacatgtgtacttcgaaatcctgtattacccaccagaagttcgctatgaccctgtatgagcagtgcgtatgccggtcttgcggagccagtagcgatccactgcctttcactgaatttgtgcgctatatatcaaccactgctctctgtaatgaggtcgaacgcatgcttgagcggcatgagagattcaagccagaaatgtttgctgagctgctgcaggctgcaaataccaccgatgactacagaaagtgccccagtaattgcggccagaaaattaagattagaagagtgctgatgaactgccctgagatcgtgactatagggttggtctgggacagcgagcactcagatcttacggaagctgttgtgcggaacctggctacccacctgtatttgcctggcctgttttaccgggtgacggacgagaacgctaaaaactctgagttgaacttagttggaatgatctgttatacctctcagcattactgtgcgtttgctttccataccaagtcttcaaagtgggtatttttcgacgacgcaaatgtgaaggaaatcggcaccagatggaaagatgtagtgagcaaatgtatcagatgccacttccaacccctgcttctcttctacgctaaccctgatggcaccgctgtcagtaccgaggacgcactacgccaggtcatctcttggtcgcattacaaatcggtggcagagaacatgggctgcgaaaagcccgtcatccataaatctgacaatctgaaggaaaacggattcggggaccaggctaagcaacgcgaaaatcaaaagttcccaacagacaacatttctagcagcaatcgcagtcacagtcacactggcgttggcaaaggacctgcaaaattatctcacatcgaccagagggagaagataaaagatatctcaagggagtgcgccttgaaggctatagaacaaaagaacctgctgtctagccagcggaaggacctggagaaggggcagcgcaaggatttgggcagacatcgggaccttgtggatgaggacctgagtcactttcagtctgggtccccgcctgctccaaacggcttcaaacaacatgggaatcctcacctataccactcgcagggaaagggatcctataaacacgaccgagtggttcctcagagcagagcatccgctcagatcatttccagcagcaagagccagattctagcccctggcgaaaaaattacgggaaaggtgaagtctgataacggcactggatatgacacggactctagccaagacagtagagacagaggcaatagttgcgattctagttccaaatcaaggaatagggggtggaagcctatgagggagacattgaatgtggactcaattttctctgagagcgagaagcgccagcattcacccagacacaaacccaacatttccaataagcctaagagttccaaagatcctagcttttctaattggcccaaggaaaatcccaagcaaaaaggactgatgacaatctacgaggatgagatgaagcaggagatcggctctcggagttcgctcgaaagcaatggcaaaggcgcagagaagaacaagggtctggtagagggcaaggttcacggggataactggcaaatgcagagaactgagagcggttacgaatcctcagatcacatcagcaatggttcaaccaacctggattctccggtgatcgatgggaacggcactgtgatggacatttctggggtcaaggaaaccgtttgcttttctgaccagatcaccactagcaatctcaacaaagagcgaggagattgcaccagccttcagagtcagcaccatcttgaaggctttagaaaagagctgcgcaatctcgaagcagggtataagtcccatgaattccatccagaatcgcacctgcagatcaaaaaccatctgattaagaggagtcacgtgcatgaagataacggcaagttgttcccctcttcctctctacagattcccaaggatcataacgccagagaacacatccatcagagcgatgaacagaagcttgagaagccgaacgagtgtaaattctctgaatggctcaacattgagaacagtgaaagaactggattaccttttcacgtcgacaattcagcctcaggcaagcgggtgaattcaaatgaaccaagctccctatggtcatcccacctccggactgtggggctgaaacctgaaactgctcccctcatccaacagcaaaacattatggatcagtgttactttgagaactccctgtccaccgagtgtatcatccggagtgcctctcgttccgacggttgccagatgccaaagctattttgtcagaatcttccaccaccccttccccctaaaaaatacgctatcacctctgtccctcagagcgaaaagtcggaaagtacccctgatgtcaagttaacagaagtgtttaaggccaccagccacctccccaaacactccctaagcactgctagtgagccttccctggaagtcagtacgcacatgaatgacgaaagacacaaagaaacattccaggtgagggagtgcttcggaaataccccaaactgtccatcttcttctagcacaaacgatttccaagccaattccggggctatcgacgccttctgccagcccgagctggactctatatccacatgtccaaacgaaactgtgagcttgaccacatacttctccgtggatagctgcatgaccgacacttatcggttgaagtaccaccagcggcctaagctgtcattcccagagtcgtccggcttctgtaacaattctttatcgtag

SEQ ID NO: 60629 - DNA, 2235 bp, Artificial Sequence
  Description of Artificial Sequence: Synthetic coding sequence
atgtcatggaaacggaattacttttccggcggtcgcggatctgtgcagggcatgtttgctccgcgaagctctacatctattgctccttcaaaaggactctcaaatgagcccggtcagaactcttgtttccttaattcagcactgcaggttctctggcatttagacatattccgacggtcttttagacagttaactacccacaagtgtatgggcgactcctgcatattttgtgcgttgaagggtatcttcaatcaatttcagtgcagtagcgaaaaagtgttaccatcggacaccctgcggtcagccctagccaagacttttcaggatgagcaacgattccagctagggatcatggacgatgcggcagaatgtttcgagaacttacttatgcgtatccactttcacattgcagatgagaccaaagaggatatctgtacagcacagcactgcatatcgcatcaaaaattcgccatgacgctattcgagcaatgtgtgtgtactagctgtggggctacctccgatccacttccatttattcagatggtgcactatataagcacaacctccctctgcaatcaggctatttgcatgttggagcgcagagagaagccgtccccttctatgttcggcgaattgctgcagaacgcttctacgatgggcgacctgcgcaactgcccatctaattgcggcgagcggattcgcattagacgtgtactaatgaacgcaccacagatcatcacaatcggacttgtttgggacagtgatcacagcgatctggccgaagacgtcatacacagcctgggcacatgcctgaagcttggggacctctttttccgcgtgactgatgacagggccaaacaaagcgagctctacctcgtcggtatgatttgctactacggaaaacattactctacttttttcttccagactaagattcgcaaatggatgtattttgacgatgcccacgtaaaggagattggcccaaagtggaaagacgtggtgactaaatgcatcaagggacattaccagccgctgctcttgctttacgccgacccacagggtacccccgtcagtactcaggacttaccaccacaggccgaatttcagagctacagcaggacgtgttatgactccgaagactctgggagagaaccatcaatcagctctgacacgcgaactgacagttccacagagtcctacccatacaaacactcccaccacgagagcgtggttagtcacttcagctcggactcacaaggaactgtgatctacaatgtagaaaacgatagcatgtcgcagagctctcgggatactggccacctaaccgatagtgagtgcaatcagaagcatacctcaaaaaagggctctctgattgagcggaaacgcagctcaggacgggtccggaggaaaggcgatgaaccacaggcctcaggttatcatagcgagggagagactctgaaagagaaacaggcccctagaaatgcgagcaagccctccagtagcactaatcggctgcgcgacttcaaggaaacagtgagcaacatgattcataaccggccttcccttgccagtcagacgaacgtaggatcccattgtcgtggcaggggaggagaccaacctgataagaagccacccagaacattgccactgcattcacgcgactgggaaatcgaaagcacctcttccgagagtaaatcaagctcctccagcaaataccgcccaacttggaggccaaaacgggagagccttaatatcgattctattttcagcaaagataagagaaagcattgtggctacacccagctcagtccctttagcgaggatagcgctaaggagttcattcctgatgagccctcaaaacctcccagctatgatattaagtttggtggaccctctccccagtacaagaggtgggggccagctcgccctggttcccacctactggagcagcacccaagattaattcaaaggatggagagcggctatgaaagcagtgagcggaattcaagcagtccagtctctctcgatgccgctctgcccgagtctagcaatgtttacaggtactgtcttgccttcgagcaacaacattgtcttttgcagcaatgtgagccacccacttggggattccaagcttggctccgacaggtcgagggatggcccctgctcttatccctgtgcgcccttagcacatcctacaacaatagcacactttgttggaaaaatcgcggaacctag

SEQ ID NO: 60630 - DNA, 5054 bp, Artificial Sequence
  Description of Artificial Sequence: Synthetic coding sequence
atgagttggaaacgaaattattttagcgggggtcgaggctccgtccaggggatgttcgccccacggtcctctacctctatcgccccttcgaaaggcctgagtaatgagcccggacaaaattcttgctttctgaactcagccttgcaggtgctgtggcacttggacatcttcagaaggtcattccgtcagctaacgacgcacaagtgtatgggggattcatgtatattctgcgctctgaaaggtattttcaaccagttccaatgcagctctgagaaggttcttccctcagataccttgaggagcgcattagcgaagactttccaggacgagcagagatttcaattaggaatcatggacgatgcggcagaatgtttcgagaacttgctgatgcgcatacatttccacatagctgacgagacaaaggaggatatttgtactgctcagcactgcatcagccatcagaaatttgcgatgacactgttcgagcaatgtgtctgcacatcctgtggagcaactagcgatccactcccattcattcaaatggtgcactacataagcacaaccagcctgtgtaatcaagcaatctgcatgctggagcgccgagagaagccatcccccagcatgtttggcgaactgctccaaaatgcctcaaccatgggcgatttgaggaattgccccagtaattgcggagagcggatccggatccgcagggtactgatgaacgctccccaaatcattactatcggtctggtatgggatagcgatcactccgacctggccgaggacgtcattcattctctgggcacatgcttaaagctgggagatctgttttttcgggtcaccgacgaccgggcaaaacagtctgaactctacctggtgggcatgatctgctattatggtaagcattattccacgttttttttccagactaaaatacgaaaatggatgtatttcgacgatgctcatgtgaaagagatcggacccaagtggaaagacgtggtgactaaatgtattaagggacactaccagcccttgctcctgctgtacgccgacccccagggcacacctgtatcgacccaggatctgcctcctcaagccgagtttcagagctactcccgcacttgttacgacagcgaggactcaggccgagaaccttcaatttcatcagatacacgaacagacagcagcacagaaagttatccatacaaacactcccatcacgaaagcgtggtatctcacttctcctccgattcacaaggcacggttatttataatgtggagaacgacagcatgtcccaaagctcaagggatacaggccacctgactgactccgaatgcaatcagaaacacaccagtaaaaaaggcagtctcatcgaacggaagagaagttctggcagagtgaggagaaagggagacgagccacaggcttctggataccactctgagggagaaacattgaaggaaaagcaagctccccgaaacgcttccaaacctagctccagcactaaccggctgcgtgactttaaggaaaccgtgagcaacatgatacacaataggccttctttagcttcccagacaaacgtgggctctcactgccgaggacgcggaggagaccaaccagataaaaagccccctcgcaccctgcccctccactccagggattgggaaatcgagtccacatcatcagagagcaagtccagttccagttctaagtatcgtcctacttggcggcctaagcgtgagagccttaacattgacagtatattcagtaaagacaaaagaaagcactgcggctacacccagctctctccatttagcgaagattcggctaaggaatttattcccgatgagccaagcaaaccaccgagctacgatattaagttcgggggaccgagccctcaatacaaaaggtggggcccagcacggcctggatcccacttgctggagcagcaccccagactgatccagcgcatggaaagtgggtacgaatcgtccgagcgaaactccagctcacccgtctcattagatgccgctctgcccgaatcctcaaacgtttatcgcgatccttccgcaaagaggagtgcaggcctcgtgccatcctggaggcacatccctaagagccatagctcctctattcttgaggttgactcgaccgcgtctatgggtgggtggactaaatcccaacccttctctggtgaagaaatctcctcaaaatctgagctggacgagttgcaagaggaagtggctagaagggctcaggagcaagagttgagacggaagagggaaaaagaactcgaagccgcaaagggtttcaaccctcatccatctcggttcatggacctcgatgagttacagaaccagggtcgctcggatgggttcgagagatcactgcaggaagccgaaagtgtcttcgaggagagcttacatctcgagcagaaaggcgactgcgcagccgctctcgcattatgtaatgaagccattagtaaattgcgtttggccctgcatggcgcttcctgctccacgcattcgagagctttggtggacaaaaaactccagattagtatcagaaaggccaggagtttacaagacaggatgcagcaacaacaaagtccccagcaaccatctcagccctctgcgtgtcttcctacacaagccggtacactgtcccagccgacttcggaacagccaatccctcttcaggtcctgctgtcccaagaagcgcagctggaaagcgggatggacaccgagtttggcgcttcctccttcttccactcaccagctagttgccacgagtcacatagctcactgagccccgagagcagtgcccctcagcattcctcaccttctcggagcgcgcttaagctgctcacaagcgttgaggtggataatatcgagccatccgcattccatcgccaaggcttgccaaaggcgccagggtggacggagaaaaatagtcaccacagctgggagccccttgacgccccagagggtaaattgcagggttcacgctgcgataatagctcctgctcaaagctgcctcctcaggaagggagaggcattgcccaggagcagttgtttcaggagaaaaaagaccctgccaaccccagccctgtgatgcccggtatagccacaagtgaacgaggcgacgaacactctctcggttgcagtccctccaatagctcagcccagccatctctccctctgtataggacctgtcatcccatcatgcccgtggcatccagctttgtgttgcattgccccgatcctgtccagaagactaaccagtgcctacagggacagtcattgaagacgtcactgaccctgaaagtggatcgaggaagtgaggagacataccgaccggaattcccttcaactaaaggattagtccgaagtctggccgagcagtttcagcgcatgcagggggtcagcatgagggactcaactgggttcaaggaccgatccttgtctggcagcttgaggaagaattccagtccttccgactcaaagccacctttctcacaggggcaggagaagggccactggccttgggctaagcagcagtcctccctcgagggaggggacaggccgctgagttgggaggaatccacggagcacagctctctggctctgaattccgggttgcctaatggcgagacctcctccggaggtcagccaagattagccgagccagatatttaccaagagaaattatcacaagtacgagatgttagatcgaaagatctgggatcttctaccgacctgggaactagcctccccctcgatagctgggtaaacatcacaagattttgcgactcccaactgaagcatggcgcaccccgacctggaatgaagagcagcccgcacgatagccatacctgcgtgacctaccctgagcggaaccatatactgctccaccctcactggaaccaggatacagagcaggagacgagcgaactggagagcctgtatcaggctagcctccaggcctcacaggcagggtgttccggatggggccagcaggatacagcctggcatcccctgtcacagacaggctcagcagacgggatgggccgtaggctgcatagtgcacacgatccaggcctgtccaaaacctccaccgcagaaatggaacacggactgcacgaagctcgaacagtgcgcacttcccaagcgaccccatgccgaggactgagccgggaatgtggggaagatgagcagtactccgccgagaacttaagaaggatctcacgttccctcagtggcacggtggtgtctgagcgtgaagaagctccagtctcgtcacattcctttgactccagcaacgtacgaaagcctttggagactggacacaggtgcagttcatcgtcttcactgcccgtcattcacgatccatccgtgtttctgctggggcctcaactctatcttccacagcctcagtttttgtctcccgacgttctgatgccaactatggcaggagagccaaacagactaccaggcacatctaggtctgttcagcagtttctggccatgtgtgaccgaggagagacctcccagggcgcaaagtataccggcaggacactgaactaccagagcctgcctcacagatctcgcacagacaacagttgggccccatggtccgagactaaccagcacatagggactcggtttctcaccactcctggctgcaacccacaattgacttatacagccactctaccagagaggtccaaagggttgcaagtcccccacacacagtcatggtccgatctgtttcactctccaagccatccccctattgtacaccccgtttaccccccatcatcaagcctgcacgtacctctgaggagcgcctggaatagcgatcccgttcctggaagcagaacaccgggtccccgacgcgtggacatgccccctgacgatgactggcgacagtcatcttatgctagtcatagcggccatcgcaggactgtaggagaaggttttctgttcgttttgtcagatgcaccgcgaagagagcagatccgggcaagagttctccaacacagccaatggta

SEQ ID NO: 60631 - DNA, 2178 bp, Artificial Sequence
  Description of Artificial Sequence: Synthetic coding sequence
atggacaccgagtttggagcaagctctttctttcactcgcccgcatcttgccatgaaagccacagcagcctatctcccgaatccagtgctcctcaacattcttctccgagcagatccgccctgaagctcctcaccagcgtcgaagtggacaatattgaaccctctgcatttcaccggcaaggcctcccaaaggcacctgggtggacagaaaaaaattcgcatcactcctgggagccactggatgctccagagggaaagctacaaggttcccggtgtgacaactcctcctgctccaagctccccccacaggagggcaggggaatagctcaggagcagctgttccaagaaaagaaagacccggctaatccctctcccgtgatgccaggaatcgccacaagcgagagaggagatgaacattccctcggctgttcgcccagcaatagtagtgcacaaccgtccctccccttgtacagaacgtgtcatccaatcatgcctgtggccagtagcttcgtcttacattgcccagaccccgtgcagaagaccaatcaatgtctccagggacaatctctaaaaacctccctcactctgaaagtggaccgtgggtcagaggagacctacagacctgagtttccatccacgaaaggcctagtgcggtccctggcagagcagttccaaaggatgcaaggggtgagcatgagagacagcaccggcttcaaggaccggagtttatccggctccctccggaagaattcctcccccagtgattcaaaaccgcctttctcacaaggccaagagaaaggccactggccctgggcgaaacagcaatcaagcctcgagggaggtgatcggccactgagttgggaggaaagtaccgaacattcctcactagctcttaactcaggcctcccaaatggcgaaacatcatccggcggacagccccgtcttgcagaacccgatatataccaggagaaacttagtcaggtgcgggatgtaagatctaaggacctgggcagcagcacagatctgggaacaagtctgcccctcgactcgtgggttaacattaccagattttgcgattcccagttaaagcatggcgctcccagacccggaatgaagtcctcccctcacgactctcacacctgcgttacatatccggagagaaaccatatcctgctgcacccacattggaaccaggacacagagcaggaaaccagtgagctggagtctctataccaggcttcgctccaggcgagccaagccggttgctcaggttggggacagcaggatactgcttggcatccactaagccaaactggttcagccgacgggatgggccgtaggctacatagtgcccatgaccctggactcagcaagacaagcaccgccgagatggaacacggcctgcacgaggccaggaccgtgcggacatctcaggattcctctaacgtgcgcaaacctctcgagacagggcaccggtgttcatcttctagcagcctcccagtgatccacgatcctagcgtcttcctgctggggcctcagctgtatctcccgcagcctcagtttctctctcctgatgtcttaatgccaacaatggcaggggagcctaaccgcctgcccggaacatctcgatcagttcaacaatttttggctatgtgtgatagaggtgaaacgtcacagggcgctaaatacactgggaggacattgaactaccagagcctgccacataggagcagaactgataattcttgggccccatggtcagagactaaccagcacattggcaccagatttctcactactccgggatgtaacccacagcttacctacacagccactttgcctgagagatcaaagggtctacaagtaccccacactcagtcctggtctgatcttttccattctccaagtcaccctccgatcgtgcacccagtgtaccctccgtcttcatccctccacgtcccattgcggagcgcttggaattccgatcctgttcccggtagcagaacacccggtccaagacgcgtcgacatgcctcctgacgacgactggcggcagtcatcttatgcttcccacagtggccatcgtcggaccgtgggcgaaggctttctattcgtgctgtctgacgctccaagaagggaacagatacgagctagggtcctgcagcacagtcagtggtag

SEQ ID NO: 60632 - DNA, 5054 bp, Artificial Sequence
  Description of Artificial Sequence: Synthetic coding sequence
atgagctggaagaggaactatttttccgggggacgcggaagcgtgcaggggatgtttgccccacgctcaagcacgagcattgccccatcaaagggcctgtcgaacgagcctggccagaatagctgcttcctcaattcagctctccaggtcctttggcatctcgatatatttaggcgtagtttcagacaactcacaactcataaatgtatgggagactcttgcatcttttgcgccctgaagggaatattcaaccagtttcaatgtagttccgaaaaagttctgcccagtgataccctgcggtccgctctcgccaaaacattccaggacgagcaaaggttccagttagggattatggatgacgcagctgagtgctttgagaatctgttaatgcggatccattttcacatcgcagacgaaacgaaagaggatatatgcacggcgcagcactgtatttcacatcagaaatttgcaatgaccctgtttgagcagtgcgtttgtacctcatgtggagctacctcagacccactgcctttcatacagatggtgcattatatctccactacgtccctctgcaatcaggcaatctgcatgctcgaacgccgagaaaagccaagccccagcatgtttggcgaactgctacagaacgcctctactatgggagatctgcgaaactgcccctctaactgtggtgaacgcatacgtatccgcagagtgctcatgaatgctccacagatcataactataggcctcgtctgggactctgatcacagtgacctggcagaagatgtcatacattccctgggtacatgcctgaagctcggagatctcttcttccgagttacagacgaccgggcaaaacagagtgagctgtacctggtgggtatgatatgctattacggaaaacactatagcaccttctttttccagactaaaatcaggaagtggatgtattttgacgacgcacacgtgaaagaaatcggcccaaagtggaaagatgtggtcacaaagtgcattaagggacactaccagcctctgcttcttctgtatgccgatccgcaggggacgccagtgagtactcaagatcttccaccccaagctgaattccagtcatactcgagaacgtgctatgattccgaggacagcggacgcgaaccctcaatcagctcagacactaggaccgattcctcaacggagtcatatccctataaacatagccaccatgagtccgtggtgagccacttcagttcagattctcaagggacggtcatttacaatgttgagaacgacagtatgtcccagtcctcgcgggacacaggccacctgaccgactccgagtgcaaccagaaacacacatccaagaagggcagtctgatagaacgtaaaaggtcttctggaagggtgaggcggaagggcgacgagccccaggcatcggggtaccatagcgagggcgagacactgaaagaaaagcaggctcctcgtaacgccagcaaacccagctcttcaacaaacagattgcgggatttcaaggagaccgtgtctaacatgatccataatcggccatcactcgcttcccagaccaatgtgggcagtcattgccggggtaggggaggcgatcagcccgacaagaagccacccagaaccttgccgttacacagccgcgattgggaaatcgagtcaaccagcagcgagtcaaaaagttcctccagcagtaaatacagacccacctggaggcctaaacgtgaatccctcaatatcgacagtatcttctccaaggataagaggaaacattgcggctacacgcagttgagtcccttttccgaggactccgcaaaggaatttattcctgatgagccatcaaaacccccttcatacgacatcaagtttggcggaccctccccacagtataaaagatggggacctgctcgtcccggaagccatctgctcgagcagcatccacggctcatccagagaatggagagtggatatgagtcgagcgagagaaattcatcatctcctgtatccctagacgccgctctgcctgaatccagcaatgtgtacagagacccatctgctaagcgctcagccggtttggtcccttcttggaggcacataccaaagagtcatagcagctctattttagaagtggattccactgcctcaatggggggatggacaaagagtcaaccctttagcggcgaggaaatctcttcaaagagcgaactcgacgaactgcaggaggaagtggccagacgggcacaggaacaagagctccgcagaaagagggagaaagagttggaggctgcaaagggattcaatccccatccatctagatttatggatctggatgaactacaaaatcagggccgatcagacggttttgagaggagcctgcaagaggcagagagcgtttttgaggaaagtcttcacctagagcaaaagggggactgcgcagccgcactggccctgtgtaatgaagcaatctctaagttaaggctggccctgcacggcgcatcgtgtagtactcactcacgtgcccttgtcgataagaagctgcaaattagcatacggaaagcaaggtcattgcaggatagaatgcagcagcagcaaagcccgcaacaacccagccagccctcagcatgcctccctacccaggctggcaccctgagtcagcctactagcgagcagcccataccgctgcaagtccttttgagccaagaggcccagctggaatccgggatggacacagagtttggcgcaagtagctttttccactctcccgcatcttgtcacgagtctcattcatcactaagcccagagagcagcgcaccccagcactcctcaccaagccgctccgccttaaagctgctgacatccgtggaagttgacaacattgagcccagcgctttccatcgacaggggctgcccaaagcccctggctggacggaaaagaattcgcatcatagctgggagccattggatgcacccgaagggaaattgcagggctctcgttgcgacaacagctcttgcagcaaactcccgcctcaggaagggcgagggatagcgcaggaacagctatttcaggaaaagaaggatccggcaaacccatcacctgtgatgcccggaatagcaacctcagagcgcggtgacgagcacagtctcggttgttctccgtccaactcctctgcccagccatcactgccactctataggacgtgtcatcctatcatgcctgtagctagctctttcgtcctgcactgccccgaccctgtgcagaagactaaccaatgtctgcagggccagagtcttaagaccagcctaaccctgaaagtggatcgtggaagcgaggaaacctatagacctgagtttccttcgactaagggcctcgtgcgctccctggctgagcaatttcaaaggatgcagggcgttagcatgagggatagcacagggttcaaggatagatccttgagtggctctctgcgcaaaaatagcagtccaagcgactctaagccacccttttcacaaggacaagagaaaggccattggccctgggccaaacagcagtcatccctggaaggcggagatagacccctgtcatgggaggagagcaccgagcactcctccctcgccctcaactctgggcttcccaatggcgaaacgtccagcggaggacagccaaggctagctgagcctgatatctatcaggagaagctgtctcaggtgcgagacgtgcgttccaaggacctcgggtcttctacggatctcggaacctccctgcctctggactcctgggtgaatataacacgattttgtgattcccagttaaaacatggcgctccacgaccaggcatgaagtcctcccctcatgactctcatacttgtgtcacctatccagagcgaaatcatatcctgctgcacccgcactggaatcaggacaccgagcaggagacctccgagctagagtctctttatcaagccagcctccaagcaagccaagccggttgttccgggtgggggcaacaggatacagcttggcaccccctgagtcagaccgggagcgccgacggaatgggcaggaggctgcacagcgcacacgatcctgggctctccaagaccagtaccgcagaaatggagcacgggttgcacgaggcgaggaccgtgcggactagtcaagccaccccatgcagaggattgagtcgtgagtgtggcgaggacgaacagtattccgctgaaaatttgcggagaataagcaggagcttgagtggaacagtggtgtcagagagagaagaggcaccagtctcttcgcattcttttgattcatctaatgttcgaaaacccctggaaactgggcatagatgttcatcttctagttccctcccggtcatacacgatcctagcgtgttcctgctaggaccacagctgtatcttccccaacctcagttcctctctcccgatgtacttatgcccactatggccggagagcccaataggctaccagggacctcaagaagtgtgcagcagttccttgccatgtgtgatagaggagagacgtctcagggcgcaaagtacactggacgcactttaaattatcagagcttgccccaccgttctagaaccgataactcgtgggccccatggagtgagaccaatcagcacattggcaccagatttctcaccaccccaggatgcaatccccaattgacctacaccgccaccttaccagagcgttcaaagggtctgcaagttccgcacacacagtcctggtccgacctgttccacagtccttcccacccccctatagtgcatcctgtgtatcctccttcttctagcctgcatgtgcctcttaggtcagcttggaatagtgatcctgtccctggatcccggactcccggtccaagacgggtggatatgccacctgacgatgactggagacagagctcctacgcatcccacagtggacatagaaggaccgtgggagagggatttctgttcgtcctgagcgacgcacctcgtcgggaacagataagggcccgtgtgctgcagcacagtcagtggta

SEQ ID NO: 60633 - DNA, 462 bp, Artificial Sequence
  Description of Artificial Sequence: Synthetic coding sequence
atgagctggaagcgcaattatttctctggaggccgtgggtccgtccagggcatgttcgcccctcgaagttccacctctatcgccccatccaagggactgtctaacgagcctgggcagaactcatgctttctgaactcagctcttcaagtgctgtggcacctcgacatctttcgcagatcattccgccagctcactacacacaaatgcatgggcgatagctgcattttctgtgctctgaaaggcattttcaatcaattccagtgctcctccgaaaaggtgcttcccagcgatacactccgctccgcactggccaaaaccttccaagacgagcagagatttcaactgggtataatggacgatgcggcagagtgctttgagaacctcctcatgcgtatccattttcacatcgcagatgagacgaaggaggacatatgcactgctcagcactgcatctctcattag

SEQ ID NO: 60634 - DNA, 2460 bp, Artificial Sequence
  Description of Artificial Sequence: Synthetic coding sequence
atggacctggatgagctacagaaccaggccaaactcaggctggcactgcatggggcttcatgcagcacccacagtcgagcgttggtggacaagaaactacagattagcatccggaaggctagatccctgcaggatcgtatgcagcagcaacagtcacctcagcagccaagccagccttctgcttgcctgccaactcaagcagggacactttcacaaccaacttccgagcaacctatacccctgcaggtgttgctgagtcaggaagcacaactcgaatctggaatggacaccgaattcggcgcatcttcatttttccacagccccgcttcctgccacgaaagccattcaagcctgtccccagagtctagcgctccgcagcattccagcccttctcggagcgcgttgaagctcttaacaagcgttgaggtggacaatattgaacctagcgcctttcaccgacaggggctgcctaaagctcccggttggaccgaaaagaatagtcatcactcatgggaaccactagacgcacccgaagggaagctgcaggggtcccgctgcgataactcatcatgcagcaaactgccaccccaggagggccgaggcatagctcaggagcagctcttccaggaaaaaaaggatccggctaacccctctcccgttatgcccggaatcgccactagtgaacgaggcgatgagcacagcctcggctgctctccttctaacagcagcgctcagccctctttacccctgtatcggacctgccatccaattatgccggtggccagcagcttcgtcctgcactgccctgatccagtgcaaaagaccaaccagtgtttgcagggtcagtcgctaaagacatcacttacactgaaagtggatagaggttccgaagaaacataccgccctgagttcccaagtaccaaagggctcgttcgctctttagcagagcagttccagaggatgcagggggtcagtatgagagattccacgggcttcaaagataggtccttgagtgggtcgctgagaaagaacagctcccctagcgacagcaagccccctttttctcagggtcaggagaaaggccattggccttgggctaagcagcagagttccctggagggtggggatagacctctgtcctgggaagagtccaccgaacattcaagtttagccctgaactcaggactgcccaatggggagacttcctcaggaggccagcctcgcctcgcagaaccggatatctaccaggaaaaactcagccaggtgcgagatgttagatcgaaggatctgggatcctcgaccgaccttggaacgagtcttcccctggactcctgggtaaacattacgcggttttgtgacagccagctcaaacatggggcacctcgaccaggcatgaaatctagcccgcacgacagccatacttgcgttacatacccagagaggaatcatatcctgctgcatccacactggaaccaggacactgaacaagagacttcagaactcgagtccctctaccaggccagtctgcaagcttcccaagccggttgctccggatggggtcagcaggataccgcttggcatccactctcacagactggatccgctgatgggatggggaggcggctacattccgcccatgatcctgggctctccaaaacctcaactgcagaaatggaacacggactgcatgaggccaggaccgttaggacctcacaagattcgtctaacgtacgcaaacctctggaaacaggacataggtgttcgtcatctagcagcctcccagtgatccacgatccttctgtattcctgttgggcccacagctctatttaccccagccgcagttcctgagcccggatgtgctgatgcctactatggccggagagccaaatcggctgcctggaacttcacgcagcgtacaacaattcctcgccatgtgtgatcgaggcgagaccagccaaggggctaagtatactggaaggaccctcaactaccaatcactgcctcatcgcagcaggaccgacaacagctgggcaccttggagtgagacaaatcagcacataggtactcggttccttacaacacccggatgcaatccacaattgacctacactgctaccctcccggagcgtagcaaaggcttgcaggtgccgcacactcagagctggtctgacttgtttcattcaccatcacacccccctatcgtacatccagtctatccccctagcagctcattacacgttcccttgcgttccgcatggaatagtgaccctgtgcctgggtctagaacaccaggcccacggagagtcgacatgccaccggatgatgattggaggcagtcttcatacgctagtcactccggacatcgcagaacagtcggtgaaggcttcttgttcgttctctctgacgccccacggagggagcagatacgcgctcgagtcctccagcactctcagtggtag

SEQ ID NO: 60635 - DNA, 4605 bp, Artificial Sequence
  Description of Artificial Sequence: Synthetic coding sequence
atgtcatggaaacgtaattacttcagtggtgggagaggctcagttcaggggatgtttgctcctcggtctagcacatctatagcgccttcaaagggcctgagcaacgagcccggacagaacagctgtttcctaaattcggctctgcaagtcctgtggcatttagatatttttcgcagatcctttcgacaattaacgacgcataaatgcatgggcgacagttgcatattttgtgctctgaaggggatttttaaccagtttcagtgcagctctgaaaaggtcctaccctcagacactcttcgcagcgctttggccaagacctttcaggacgaacaaaggttccagctgggaataatggacgacgccgctgaatgctttctatttttccgggtcaccgatgacagggcgaaacaatccgaattgtacttggtcggcatgatatgttactatggtaaacattactctactttcttcttccaaaccaaaattagaaagtggatgtacttcgacgacgcacacgtcaaggaaatagggccaaaatggaaagatgtcgtaacgaagtgtatcaaaggacactatcagccactgctcctgctctacgctgacccacagggaacccctgtgtctactcaagatttaccaccacaggctgaattccagtcctattcccgaacttgttacgacagcgaggactcaggcagagagccctctatctcatccgacactagaaccgattcaagcacagagagctacccctataaacactcacaccacgaatccgtcgtgtctcatttcagttctgactcgcagggcaccgtgatctataacgtggaaaacgattcgatgagccaaagttccagggataccgggcacctgaccgatagcgagtgcaatcaaaagcacacatctaaaaaaggatcactcatcgaacgcaagcgctcgtccgggagggtccgtaggaagggagacgagccacaagccagtggttatcatagtgagggggagacactaaaagaaaaacaggctcccagaaatgcgtccaagcctagttcatccactaataggctccgagattttaaggagacagtgagtaacatgattcacaatagacccagtcttgcatcacagacgaatgtcggaagtcactgtcgagggaggggcggtgatcagccagacaagaaacccccaaggaccctaccattacattcccgcgactgggaaatcgagagtacttcgtccgagtcaaaatccagtagctcctcaaaataccgacctacttggagacctaagagggagtcactgaacatcgactctatattcagcaaggacaagcggaagcactgcgggtacacccagcttagtccattctctgaggactctgcaaaagagttcatccctgacgagccatctaagcccccaagctacgacattaaatttggaggcccttcaccccagtacaaacggtggggtccagcgcgtcccggttcacacctcctagagcagcaccctagactgatccagcgtatggagtctgggtatgaatccagtgagaggaacagctcctctcctgtctcactggatgctgccttgcccgagtcgagcaatgtttatcgcgatccctccgccaaaagatcagccggtttggtcccaagctggaggcatatccctaagtcccattctagctccatcctggaggtggattcgacagcttccatggggggatggactaaatcccaacctttctcaggggaagaaatctcaagcaagtccgagctcgacgagctgcaggaagaagtagccagaagagcacaggagcaggagctcaggaggaaacgtgagaaagagctggaagcggcaaagggctttaacccacatcccagccgcttcatggatttagacgagctgcagaatcaagggaggtcagatgggtttgaacgctctttgcaggaagcagaatctgtttttgaggaatctctccatctggagcaaaagggcgactgtgctgcagcactcgccctgtgcaatgaagcaatttctaaactgcgactggctcttcacggcgcatcgtgtagtacgcatagtagggctttggtggataaaaaactccagatatccatccgtaaggcccgaagtctccaagatcgaatgcagcagcagcagagcccacagcagccttcacagccaagcgcctgtctccctacccaggctggcaccctcagtcaaccgaccagcgagcagcccataccactccaagtccttctttctcaggaggctcagttggagtcagggatggatacagagtttggggcttctagctttttccactccccagccagttgtcatgaatcccactctagcctctctcctgaatctagcgctcctcagcactcctccccgtccaggtccgcgttgaaacttttgacgtctgtggaagtggataacatagagccttctgcgttccacagacagggtctgcctaaggcccctggctggacagaaaagaattcacatcatagttgggagcctctcgatgctcccgagggtaagctgcagggcagtaggtgcgacaattcctcatgttctaaattgccaccccaggagggacgtggcatagcccaggagcagttgttccaggaaaagaaggatccagctaacccatctccagttatgcccggaatcgccacaagcgaaaggggggacgagcattcactgggctgttctccctccaattcctctgcacagccctctctcccattgtacaggacctgtcatccaatcatgcccgtggctagctcctttgtgctgcactgtccagatccagtgcagaagaccaaccagtgcctgcagggacagtccttgaagacgtccctgacattaaaagtagataggggttcagaagagacataccgacccgaattcccctccacaaaagggcttgttaggagcctggccgaacagttccagaggatgcagggggtgagcatgagggactctacaggatttaaggacagatcactttctggctctctgcgaaagaactcaagtccttccgactcaaaaccgccttttagccaggggcaggaaaagggtcattggccttgggcaaaacagcagtctagtctggaaggcggagacagaccactgtcgtgggaagagagcacagaacattcatccctcgctcttaactctgggcttcccaatggcgagacctcatctggaggacagccacgtctggccgagcctgacatctaccaggaaaaactctctcaggttagagatgtcaggagcaaagatctagggtccagcacagatttaggtacatcattacctctggattcatgggtcaatattactcggttctgtgattcccagctgaaacacggagccccaagacccggaatgaagagctccccacatgatagtcatacttgtgtgacataccccgagcgtaaccacattctacttcatccacactggaaccaagacaccgaacaggagactagcgagcttgaatctctgtaccaggcatcactgcaggcaagccaggcaggttgttcgggttgggggcagcaggatacagcatggcatccactcagccagactgggtctgcggatgggatggggaggcggttacacagtgcccatgaccctggactgtccaagactagcaccgccgaaatggaacacggactccatgaggccaggaccgtgcgcacctctcaggcaaccccatgccgcggtttatctcgcgaatgcggggaggacgaacagtatagtgccgaaaatctgcgacgaatatcaaggtccctgagcggtactgtggtgagcgagagagaggaagcccctgtgtcctcccattcatttgattcgagcaatgtgcgcaagccactggagacagggcatcggtgctccagttcatcgtcactgccggtgatccatgatccttcggttttcctcctcggcccacagctctatcttccacagccccagtttctgagccccgacgtgctgatgcctacaatggccggtgaacccaacagactccccggaactagccgaagcgtgcagcagtttctcgctatgtgtgaccggggtgaaaccagccaaggggcaaaatacaccggtcgcacattaaactatcagagtctgccccataggagcagaacagataattcttgggccccatggagtgagacaaaccagcacatcggtacacggtttctgactacacccggttgcaatccacagttgacctacacagcgacgctgccagaacggtcaaaaggattacaggtgcctcacacccagtcttggtccgacctgttccattccccttcccaccctcccatcgtccatccagtctatccgccatcttcatcactacacgtgccactcaggagtgcgtggaacagcgaccctgtccccggatctcggactccaggcccacgtagagtggacatgcccccagatgatgactggcgtcagtcctcatacgcgagccattcaggtcaccggaggacagtgggtgaaggatttttattcgttctctcagatgctcccagaagagagcagattagagccagggtgctccaacactcacagtggtag

SEQ ID NO: 60636 - DNA, 243 bp, Artificial Sequence
  Description of Artificial Sequence: Synthetic coding sequence
atgtcttggaagaggaattacttcagcggcggacgagggtccgtacagggcatgttcgctccgaggtctagcacctcaatagctccttctaaaggattaagtaacgaacccggacaaaattcgtgcttccttaactcagccctgcaggttttatggcacctggatatatttcgcaggtccttcaggcaactgaccacacataagtgcatgggtgatagttgtattttttgcgcactcaagtag

SEQ ID NO: 60637 - DNA, 3279 bp, Artificial Sequence
  Description of Artificial Sequence: Synthetic coding sequence
atgatggactccccgaagatcggaaacggactgccagtgatcgggccaggcaccgacatagggatcagctccctgcacatggtgggttacctgggcaaaaatttcgactcagcaaaggttccatctgatgaatattgcccagcttgcagagaaaaagggaaacttaaggccctcaagacatataggatcagcttccaggaatcaatattcctgtgtgaagacctacaatgcatttatcccctggggtcaaaatcactgaataatttaatcagccccgatctcgaagaatgtcatacgccccataaaccccaaaagagaaagagtctggagagctcctacaaagactcactactgctggcaaactcaaaaaagacccgcaattatatcgcgatagatgggggtaaagtgctgaactcgaagcacaacggagaggtgtatgatgagacctcatccaaccttccggacagcagcggccagcagaatccaatccgaacagcagactcactggagcgcaacgaaatcctggaggcggacacggtggacatggctacgacaaaggacccagccaccgttgacgtctcgggtacagggcgtccatcccctcagaacgagggctgtactagcaaattggaaatgcctcttgagtccaagtgcacctccttcccgcaggccctctgtgtgcagtggaagaatgcatatgcattgtgctggttggattgtatcctttccgcactggtgcactcggaagagctcaaaaacacagtaactgggctgtgttcaaaagaagagtcaatattttggcgcctgctgactaagtataatcaggccaacactcttctttatacctctcagctgagcggcgtgaaagacggagactgtaaaaagctgaccagcgagatcttcgctgagattgagacatgtttgaacgaagtgcgtgacgaaatctttatcagtctgcagccacagctgcggtgtaccctaggcgatatggagagccccgtttttgccttccctctgctgctcaaacttgagacacatattgagaagctgtttctgtattcattttcttgggacttcgagtgcagccaatgtggccaccagtaccagaatagacatatgaaatctctggtgacattcacgaacgtgatacctgagtggcatcccctgaatgcagctcattttggcccttgcaacaactgtaactccaagtcacagatacgcaaaatggtgttggagaaagtctcccccatctttatgctgcactttgtggagggtttacctcagaatgatctacagcactacgcctttcatttcgaaggttgtctgtaccagattacctctgtcatacagtacagagccaataaccacttcatcacctggatcttagacgcggacggatcctggctcgaatgtgacgatctcaagggcccttgctccgaaaggcacaagaagttcgaggtgccagcttccgaaatacacattgttatttgggaacgaaagatatctcaagtaacagacaaggaggccgcttgcctgccactcaaaaagactaatgaccagcacgcactgtcgaacgaaaagccggtcagcctgacatcttgttcagttggggatgcagcctctgccgagacggcaagcgtgacccatccaaaggacatcagcgtggctcctaggactctcagccaggatacagctgtgacgcatggcgaccacctgctttcgggtcctaaaggcctcgtagacaatattctgccccttaccctcgaggaaactatacagaagacggccagtgtgtcccagttaaactcagaagcttttctcctggagaataagcccgtagccgaaaacaccggcattctgaaaaccaatacacttctgagccaggaatcattgatggctagcagtgtgtccgcgccatgtaatgagaaactcatccaggaccagttcgttgatataagtttcccttcccaagttgttaataccaatatgcagagcgtacagctgaacacggaagacacagtaaacacaaaaagcgtaaacaatactgacgccactggcctgatccaaggagtcaagagtgtagagatcgagaaagacgctcagcttaaacagttcctcacacctaagaccgagcagctgaagccagaaagagtcacatctcaggtgtctaatctaaagaaaaaggagacaactgcagattcccaaaccactacctcaaaatcattgcagaatcagtctctcaaagaaaatcagaagaagcctttcgtgggcagttgggtcaagggtctgattagccgcggagcctcattcatgccactgtgtgtgagcgctcacaatcgcaacacgataacagatctgcaaccaagtgtcaaaggcgtaaataactttggcggtttcaaaacaaaagggattaatcagaaggcatcacatgtgtctaaaaaggcgagaaagtcggcgtccaagccgccaccgatttctaaaccccctgctggacccccaagcagcaacgggaccgccgcacaccctcacgcccacgcagctagcgaggtgctcgaaaaaagtgggtctactagctgtggtgcacagctgaaccactcgagttacggcaacgggatttctagcgccaaccatgaagatctagtggagggacagattcacaaactaagactgaaactgagaaagaaattgaaggccgagaaaaaaaaactcgcggcacttatgagctctcctcagtcaagaactgtccggtctgagaatcttgaacaggtgccccaggacggctcccccaatgattgtgaaagcattgaagatctgttgaatgaacttccatatccaatagacatcgcctccgaatcggcttgtacaaccgtccccggagtcagtctctactcttcccaaactcatgaggagatcctcgctgaactgctgtccccgacccccgtttctaccgagctgtccgaaaatggagagggagacttccggtacctcggaatgggtgacagccatatcccaccccctgtgcctagcgagtttaatgacgtgtcccagaacacccaccttcggcaggaccacaattactgctcacctaccaaaaaaaacccgtgtgaggtccaacctgatagcttaacaaacaacgcgtgcgttcggacccttaatttggagtcacccatgaagaccgacatattcgatgagttttttagttcatctgccttgaacgccttggcaaatgataccctcgacctgccacactttgacgaatacttgttcgagaattactag

SEQ ID NO: 60638 - DNA, 357 bp, Artificial Sequence
  Description of Artificial Sequence: Synthetic coding sequence
atgttccactggcaggccacgattatgggcccaaacgactccccctaccagggaggcgtttttttcctgacaatccattttcctactgattatcctttcaagcctccgaaggtcgccttcaccacgaggatttaccacccaaacatcaatagtaacggcagcatctgcctggatatcctgcgatctcaatggtctccagctctgacaatatcgaaagtgcttctgtctatttgttcccttttgtgcgaccccaatccagatgaccccttggttcccgagatcgctcgaatctataaaaccgaccgcgagaaatataaccgtattgctcgcgagtggacacagaaatatgcgatgtag

SEQ ID NO: 60639 - DNA, 444 bp, Artificial Sequence
  Description of Artificial Sequence: Synthetic coding sequence
atggccttaaagcgtattcataaagagcttaatgacctcgcaagagatcccccagcgcaatgctctgctggccctgtgggggatgacatgttccactggcaggctactatcatgggtccaaatgactcgccataccaggggggagtgtttttcctgaccattcatttccctaccgactatccctttaagccccctaaggttgcttttactacacggatctaccaccccaacattaattcgaatggcagtatttgtctggatatcctgagatcacagtggtcacccgcacttaccatctccaaagtcttgctgagtatttgtagccttctgtgcgatccgaaccctgacgacccattggttccagaaattgctcggatctataaaacagatcgcgaaaagtacaatcgcatagcacgcgaatggacacagaaatatgctatgtag

SEQ ID NO: 60640 - DNA, 444 bp, Artificial Sequence
  Description of Artificial Sequence: Synthetic coding sequence
atggcattgaaacggattcacaaggaactgaatgatctggctcgggaccctccagcccagtgtagcgcaggtccggtgggggacgacatgttccattggcaggcaactattatgggacccaacgactccccatatcagggaggtgtgttctttcttacaatacacttcccaactgattatcctttcaagcctcctaaggtcgccttcaccactaggatttatcaccctaacattaattctaatggctccatctgtctcgacattctgagatctcaatggagcccagccctgacgattagtaaggtattgttatcaatctgcagcctcctctgtgaccctaaccccgacgatcccttggtaccggaaatagcacgaatttacaaaaccgaccgggagaagtataatcgtatcgctcgcgaatggactcaaaaatatgccatgtag

SEQ ID NO: 60641 - DNA, 357 bp, Artificial Sequence
  Description of Artificial Sequence: Synthetic coding sequence
atgtttcactggcaggcgacaatcatggggccaaacgacagcccttatcaggggggagtcttctttctgaccattcattttccaactgattatccctttaaaccacccaaagtggcctttacaactcgaatctaccatcctaatattaatagcaatggctccatctgcctggatattctgagatcccagtggtcgcccgcactcacgatcagcaaagtgctgctgagtatctgtagcctgctgtgcgatccgaaccccgatgatcccctggttcctgaaatagcacgtatctacaaaacagacagagagaaatacaacaggattgcccgagagtggacacagaagtacgccatgtag

SEQ ID NO: 60642 - DNA, 5360 bp, Artificial Sequence
  Description of Artificial Sequence: Synthetic coding sequence
atggggctcctgcagctgttagctttcagttttttagccctctgcagggcaagagtcagagcccaggagccggagttctcttacggctgcgctgagggctcctgttaccctgccaccggagacctgctgatcggaagggcacagaaactgtcagtgaccagtacctgtggacttcacaagcctgaaccttactgtattgtgtcccacttgcaggaggataagaagtgcttcatttgcaactctcaagatccttatcacgaaaccctcaacccagattcacaccttatcgaaaacgtggttacaacatttgccccaaataggctcaagatttggtggcagtcagaaaatggcgttgagaacgtgaccatccagctggacctggaggctgaattccattttacacatctaatcatgacctttaagacttttagaccagcagcgatgcttattgagcgcagttcagactttggaaagacctggggcgtgtaccggtacttcgcctacgactgcgaggcctccttcccgggaatctctactgggccaatgaaaaaagtcgacgatattatatgtgattcccgctattcggacatcgaacccagcaccgagggggaggttatatttcgggcactggatccggctttcaagattgaggacccttactctccacgcatccaaaacttgctaaaaattacgaatctacgcatcaaatttgtcaagctgcacaccttgggagataacctccttgactcacggatggagataagggaaaagtactactacgccgtgtatgatatggtagtccggggaaactgtttttgctatggacatgcatctgaatgtgcaccagtggacgggtttaacgaagaggttgaagggatggtacatggacactgtatgtgtcgccataatactaaagggctgaactgtgaactctgcatggatttttaccatgacctgccatggagacccgcagagggaagaaacagtaacgcttgcaagaagtgtaattgtaacgaacacagcatctcttgtcatttcgatatggccgtgtacttagccactggtaacgtgtccggcggagtgtgcgatgactgtcaacacaacacaatggggcgaaactgtgaacagtgcaagccgttctactatcagcacccagaacgggacattagagaccccaatttttgcgaaagatgtacatgtgaccccgctggctcacagaacgagggcatatgtgattcatacaccgattttagtaccggtcttatcgctggccagtgccgctgcaagttgaatgttgagggggagcattgcgacgtgtgtaaggagggattttatgatcttagctcagaggacccatttggatgcaagagctgcgcctgtaacccactgggaacaattcccggtggcaatccctgtgactccgagacaggtcattgctactgtaagcggttggtgaccggtcagcactgtgaccaatgcctgcctgagcattggggtctcagcaacgacctcgatgggtgtagaccctgtgattgtgatctgggaggtgccttgaataactcatgttttgccgagtctggtcagtgcagctgtcggccacacatgataggacgtcagtgtaatgaggtggagcccggatactactttgcaacactggaccattatctgtacgaggctgaggaagctaacttgggtccaggggtttctatcgtggagagacagtatatccaagataggatacccagctggacgggcgcaggctttgtgagagtgcctgagggtgcttacttggagttctttatcgataatattccctactctatggaatatgacatactcatcaggtacgaaccccagctgcccgaccactgggaaaaagccgtgattacagtgcagcggccagggagaatcccgacctcttcccgatgtgggaacactatccccgatgatgataaccaggtcgtatctttgagtcctggaagccgatatgttgtccttccccgaccagtctgcttcgagaaaggcacaaattacacggttcgcctagagctgccgcagtatacttcatccgactcggacgttgagagcccgtacactctcatcgatagccttgtgctgatgccttactgcaagtccctggacatttttaccgtcggaggctctggagatggcgtcgtcacaaattcagcttgggagacattccaaaggtatcggtgcttggagaatagtaggagcgtggtgaaaacccctatgacggatgtgtgtcgcaatataatcttcagcatctccgccctgctccaccagaccggattagcgtgcgagtgcgacccccaaggatcactgtccagcgtttgtgaccccaacggaggccagtgtcaatgccgccctaacgtcgtcgggcgtacttgtaaccgttgtgccccaggcaccttcgggtttggtccaagcgggtgtaagccctgtgagtgccaccttcagggctctgtaaacgccttttgtaaccctgtgacaggccagtgccactgttttcagggggtctacgccagacagtgcgaccgttgcctgcctggacattggggcttcccctcgtgtcagccctgccagtgcaatggtcatgccgatgactgtgacccagttacaggagaatgcctgaactgccaggattacacgatgggccacaattgcgaacgctgccttgcagggtactacggagatccaatcatcggatctggagaccactgcagaccctgtccatgtcccgacggacctgatagcgggagacagttcgcacgaagctgctatcaggatcccgtgacactgcagctcgcctgtgtctgcgatcctggctacattggctcaagatgcgacgactgcgcctccggctacttcgggaatccgtctgaggtgggtggctcgtgtcagccatgccaatgccacaataacatcgatactactgatccagaagcctgtgataaagagaccggacggtgcctgaaatgtctataccataccgagggagaacactgtcagttttgtaggtttggctactatggggatgccctgcagcaagactgccgtaagtgcgtgtgtaattacctgggcactgtgcaggaacactgcaacggtagtgattgccaatgtgataaggccaccggacagtgcctttgtcttccaaacgttataggtcagaactgcgatcgatgcgcgcctaacacatggcaactggcctctgggacaggatgcgatccgtgtaattgtaacgctgctcatagctttggccctagttgcaacgaattcacaggacagtgtcagtgcatgccaggctttggcggaagaacatgtagcgaatgccaagagttattctggggagaccctgatgtggaatgccgagcgtgcgattgcgatccgaggggaattgagacccctcaatgcgatcagtcaaccggccagtgtgtgtgcgtggagggggtggagggacctaggtgtgacaagtgcaccagaggctacagcggggtgttcccagactgcacgccatgccatcagtgcttcgctttatgggatgtgatcatagcagaacttacaaatcgaacccatcgattcttggaaaaggctaaagccctgaaaatcagcggagtgatcggcccatatagggagaccgtggacagcgtcgaacgtaaagtctctgagattaaagatatcctggctcagtcaccagccgctgagcctctcaagaatatcggcaatcttttcgaagaggccgaaaaactgatcaaagatgtcacagaaatgatggcccaagttgaagtcaagctttccgacacaacgtctcagagtaatagcacagctaaggagttggattccctgcagacggaagcagagtctctggacaacaccgtgaaagaacttgctgaacagcttgaattcattaagaattctgacataaggggcgctctggatagcatcacaaaatacttccagatgtctctggaagccgaagagcgtgtcaacgcatccaccactgaacctaattccacagtagagcagtcagctctgatgagagaccgagtcgaggacgttatgatggagcgggagtcacaattcaaggaaaagcaagaagagcaggcgcgactgcttgatgagctggcgggaaaactgcagagcctggatctctccgccgcagccgagatgacttgtggcactccaccaggagcttcctgcagcgaaacggagtgcggaggccctaactgtcgtaccgacgaaggagagcgtaaatgtggcggtcctggctgcgggggactcgtgaccgtggctcacaatgcctggcagaaagcaatggacctcgaccaggatgtactctccgcgctggccgaggtcgaacaactttccaagatggtgtccgaagccaaactgcgggctgacgaagcaaagcagagtgctgaggacatactcctgaagacgaacgcgaccaaggagaaaatggacaagagcaatgaggagttgcggaacctcatcaagcagattcggaatttcctcactcaggactcagcagatctggatagcattgaggccgtggcaaacgaggtgcttaagatggagatgccttccacccctcaacagctgcagaacctcacagaggacatccgggagcgtgtggaatctctgtcccaagtcgaagtcatcttgcagcatagtgccgcagacattgccagagccgaaatgctgcttgaggaggccaagagagcctccaaatccgcaacagacgtaaaggtcacagccgatatggtgaaggaggcattagaagaagcagaaaaagctcaggtggctgccgaaaaagcaattaaacaagcagacgaggacattcagggcacacagaacctgctgacttccattgagagtgagactgcagcctctgaagagacactcttcaatgcatcccagcgaattagtgagctggagcgcaatgtcgaagagctgaagagaaaggccgctcaaaactcgggggaagccgaatacatagagaaagtggtatacactgtgaagcaatccgccgaagatgtaaagaaaacactggacggcgaactagacgaaaaatacaaaaaagttgaaaatctgatcgctaagaagacggaggaatcagcggatgcacgacgaaaagccgagatgctgcagaacgaggccaagaccctcctagctcaggccaacagtaaacttcaattgttgaaagacctggagagaaaatatgaggataatcaaagatacctggaggacaaagcccaagagctggcgcgattggaaggggaggtgcgtagtctactgaaggacatatctcaaaaggtggctgtgtattctacttgtctgta

SEQ ID NO: 60643 - DNA, 330 bp, Artificial Sequence
  Description of Artificial Sequence: Synthetic coding sequence
atgaccaacgactccccctatcagggcggtgtgtttttcctgactatacatttcccaaccgactacccctttaaaccccctaaagtggcttttacgaccaagatataccaccccaacatcaattccaacggaagtatctgcctcgatattctgcggagccagtggtccccggcacttaccgtgtcaaaagtcctcctttcaatctgtagcctcctgtgcgatccaaacccagacgaccctttggtccccgagatcgcccatacttataaggccgatcgggaaaagtataatagacttgcaagagagtggacgcagaagtatgctatgtag

SEQ ID NO: 60644 - DNA, 558 bp, Artificial Sequence
  Description of Artificial Sequence: Synthetic coding sequence
atgttaaccttggcaagcaaactcaagcgagatgacggactcaaaggttctcggacagctgctaccgcctcagattctacaagacgcgtgagcgtgcgtgataaactgctggtcaaagaggtggctgaactcgaggccaatctgccctgcacctgcaaagtgcacttccctgatcccaataagctgcattgtttccagctcactgttacacccgatgagggttactaccaaggtggcaagttccaattcgaaacagaagtgccagacgcctacaatatggtaccacccaaagtcaagtgtttgacaaaaatatggcacccaaatatcacagaaacaggagagatttgtttgagtttactgcgtgagcactcaatcgatggaaccggatgggccccaaccagaacgttaaaggacgtggtctggggcttaaactcactttttaccgacctgttgaattttgatgaccccttaaatatcgaagctgctgaacaccacctcagggacaaggaggatttcaggaacaaagtcgatgactacatcaagaggtacgcacgatag

SEQ ID NO: 60645 - DNA, 462 bp, Artificial Sequence
  Description of Artificial Sequence: Synthetic coding sequence
atgttaacactggccagcaaattaaaaagagatgatggcttgaaagggtcccgcactgctgctaccgcctcggacagtacccgcagagtgtccgtgcgagataaactcctggttaaagacgaaggttactaccaaggaggcaaattccagttcgagacggaagttccagatgcttacaatatggtgccacctaaggtgaaatgtttgacgaagatctggcacccaaatataacagagacgggcgagatttgtctctcccttctgagggagcactctatcgatgggactggatgggccccaacacggacactcaaggacgtggtatggggactcaactcactgttcaccgatctcctgaattttgatgacccactgaatattgaagcagcggagcatcatctgcgggacaaggaagattttaggaataaggtcgatgactacattaaacggtatgcccgatag

SEQ ID NO: 60646 - DNA, 516 bp, Artificial Sequence
  Description of Artificial Sequence: Synthetic coding sequence
atgctgacactggcctccaaactcaagagagatgacgggctgaagggctctagaaccgcggctacagcttcagacagtacgcggagggtgagcgtccgtgacaaactgttggttaaagaagtggccgaactggaagccaacctcccatgtacgtgcaaggtccatttcccagatccaaacaagctgcattgcttccagctgaccgtgactccagacgagggctactatcagggcggtaagtttcaattcgaaaccgaggttccagacgcatataacatggttccacctaaagtgaaatgtcttacaaagatctggcacccgaatataaccgaaactggcgagatatgcctatccctgctgagagagcatagcattgacggaacagggtgggcccctaccagaaccttaaaagacgtggtctggggacttaacagcctgtttaccgatttactgaattttgacgaccctctaaacatcgaagcagccgaacatcaccttagggataaagaggattag

SEQ ID NO: 60647 - DNA, 513 bp, Artificial Sequence
  Description of Artificial Sequence: Synthetic coding sequence
atgacggaactgcagtccgccttgctgttgcgtagacagctggcagaactcaataagaaccccgtggaaggcttttcagccggactcattgatgacaacgacttatataggtgggaggtgctaatcataggcccacctgacaccctttatgagggtggggtgtttaaggcccacctgaccttcccgaaagattatccgctgagaccaccgaagatgaaattcatcacagagatctggcaccccaatgtggacaaaaacggagacgtttgtataagcatcctccacgagccaggcgaagacaaatacgggtatgagaagcctgaggaaagatggttgcctatccacacagtggagacaatcatgatttctgtgatctcaatgctagcagaccctaatggcgactccccagccaacgtcgacgctgctaaagagtggcgggaggatcgtaacggtgagttcaagcgcaaagtcgcgaggtgtgttcggaagtctcaggagacagctttcgaatag

SEQ ID NO: 60648 - DNA, 552 bp, Artificial Sequence
  Description of Artificial Sequence: Synthetic coding sequence
atgattaaactgtttagcttaaagcagcagaaaaaagaagaggaaagtgccggaggcaccaaaggctcgtccaagaaggcaagcgctgctcagcttaggatccagaaggacattaacgagctaaacctacctaagacttgcgatatttcatttagtgaccccgatgatttactgaacttcaagctcgtgatatgcccagacgagggattctacaagtccggcaaatttgtatttagctttaaggtgggtcaggggtatccacatgacccacccaaggtgaaatgtgaaacgatggtttaccaccctaatatagacttagaaggtaatgtctgcctgaacatactgcgggaagattggaagcccgtgctcacaatcaactccatcatttatggactgcagtacttgttccttgagccaaacccggaggatcctctgaacaaagaggctgccgaggtcctgcagaataataggcgcctgtttgaacagaacgtgcagcgatccatgagaggaggctatatcggcagcacttatttcgaacgatgcttgaagtag

SEQ ID NO: 60649 - DNA, 3879 bp, Artificial Sequence
  Description of Artificial Sequence: Synthetic coding sequence
atggctgaccccgctgccccaacaccagctgcgcctgctccggcacaggccccagcacccgctcccgaggcagtccctgcgccagccgctgccccagttccagcgcctgccccagccagcgatagcgcctctgggccttcgagtgacagtgggcctgaggctggcagccagagactgctattttcccatgatctcgtgagcgggcgatacagagggagcgttcactttggtcttgtccgtctgatccatggtgaggattccgacagcgagggagaggaggagggacggggttcttctggatgcagtgaagccggtggcgcagggcatgaggaggggagagcctctcctcttaggaggggctatgttcgcgtccagtggtaccctgaaggtgtcaaacagcatgttaaagagactaaattgaagctggaagatcgctccgtcgtgccacgggacgtagtgcggcacatgagaagcacagactcgcagtgtggaaccgtcatcgacgtgaacattgactgtgctgtgaagctgataggcactaattgcattatctatcctgtaaacagcaaggacctgcagcatatctggccgttcatgtatggagactatattgcatacgactgttggcttggtaaggtctacgatttaaagaatcaaattatcctgaagctctcaaacggcgctcgctgctccatgaacactgaagatggcgcaaagctgtatgacgtctgcccccacgtgtctgacagtgggcttttttttgacgactcgtatggcttctatcccggtcaggttttgatcggacccgcaaagatcttttcctcagttcagtggctcagcggcgtaaagccagtgctgtctactaagagcaagtttcgggtagtggtcgaggaagtacaggtggtggagttgaaagtgacatggatcactaagtcattttgccctggcggtaccgatagcgtcagcccaccgccttccgtgataacccaggagaatctgggcagagtcaagcggctgggctgttttgatcacgcccagaggcagctgggggaaagatgcctgtacgtcttcccggcaaaggttgaacctgctaagatcgcttgggagtgtccagaaaagaactgcgcccagggagagggcagcatggcgaagaaggtgaaacggttactgaagaagcaggtcgtgcgcataatgtcctgctcccccgacactcagtgcagtcgtgatcattccatggaggatcctgacaaaaagggcgagtccaagactaagtcagaggccgagtctgcctcacccgaggaaacccctgatggtagcgctagcccagtcgaaatgcaagatgaaggcgctgaggaaccacatgaggccggtgagcaattaccacccttccttttgaaagagggacgagacgaccgactgcactccgctgagcaagacgctgacgacgaggcggctgatgacaccgatgatactagttctgtaaccagcagtgcctcctctaccacctcgagtcagtctgggtccggaacatcccgcaagaaatctattccactcagtatcaaaaacctgaagcggaagcacaagaggaaaaaaaataaaattaccagggattttaagccgggagatcgcgtggctgtggaggtcgtcactacaatgacttccgccgacgtcatgtggcaggatggaagcgtcgaatgcaacattagaagcaacgacttgttcccagtccatcaccttgataataacgagttttgtccgggagactttgtcgtcgacaagcgcgttcagtcatgtcctgatcccgcagtttacggcgtggtccagagtggagaccacattggcagaacttgcatggtgaaatggtttaagttgcggccttcaggcgacgatgtcgagttaataggagaagaagaagatgtgtccgtgtatgatattgccgatcatccggactttaggttccggactacggatattgttatccgaattggcaatacggaagacggcgctcctcataaggaggacgaaccctctgtgggacaagtcgctcgcgtagacgtgagttcaaaggtggaggttgtctgggccgacaattctaaaaccataatcctgcctcaacatctgtacaacatcgagagtgagatcgaggagtccgattatgacagcgtcgagggcagcacttctggcgctagttcagacgaatgggaggacgattctgacagctgggaaacagataacggccttgtcgaggacgagcatcctaaaatcgaagaaccaccaatccccccactggagcagccagtggccccagaagacaaaggcgtagtaatttctgaggaagccgcaactgccgcagttcagggcgctgtggcaatggccgctcccatggctggcctgatggaaaaagccggtaaagacgggccacctaagtccttccgggaattgaaggaagccatcaaaatcctcgaatccctgaagaacatgacagtggaacagctgttaacaggctccccaacttcccccacagtggagcccgagaaacctaccagagaaaagaagtttctcgatgatatcaagaagctgcaggagaatttgaaaaagaccctggacaatgtggccatcgttgaggaagaaaagatggaggccgtgcctgacgtggaacgtaaagaggataaaccagaagggcagtcgcctgtgaaggccgaatggccttccgaaactcccgtgctatgccagcagtgcggagggaaaccgggagtaacattcacctcagccaagggcgaagtcttcagcgttctggagttcgctccgtcgaaccacagtttcaaaaagattgagttccagccgccagaagccaagaaattcttctccaccgtcagaaaggaaatggccctcctggcgacatcactaccagagggaatcatggtgaagacctttgaagaccgcatggaccttttcagcgccctgattaaaggtccaacccggaccccatatgaagatggactgtatctctttgacatccagttgcctaacatttatccagcagtgcctcctcacttttgttatctgagtcagtgctccggcaggctgaacccgaacctgtacgacaacggcaaggtgtgtgtcagtctgttgggaacctggattggaaaaggcaccgagcggtggacctccaaaagtagcttgcttcaagtgctgatctctatccagggactgatacttgtgaatgagccttattataacgaggcagggtttgattccgatcggggtctgcaggaaggttacgaaaattctcgttgctataatgaaatggccctcatccgagtcgtccagtccatgactcagctggtccgacggccacccgaggtcttcgagcaggagatccgccagcacttcagcactggaggttggagattggtcaaccgcatagagagttggctcgagacccatgctctgctggagaaggcccaagcccttcccaacggtgtaccaaaagcctcttcgtccccagaacctcctgccgtggctgaactctcagacagcggccagcaggagccggaggacggtggacccgctccaggcgaagcctcgcagggatcagactcagaagggggtgcccaaggactcgcctcagcgtcacgagatcacacggatcaaacctctgaaacagccccagatgcgtccgtcccccctagtgttaagccaaaaaaacggagaaagtcatacagatcgttcttgcccgagaagtctggatacccagacatcggctttccactgttccctcttagcaagggttttatcaagtccattcgaggcgtgctcacacagtttcgcgctgcactgcttgaagccggaatgcctgagtgtacagaggataaatag

SEQ ID NO: 60650 - DNA, 1269 bp, Artificial Sequence
  Description of Artificial Sequence: Synthetic coding sequence
atgcagcaaccacagccacagggacagcaacagcccggtcctggacagcagctgggtggacaaggcgcagcccctggagccggtggcggacccggtggtggcccaggcccagggccttgtctgcgcagagagctgaaattactcgagagtatctttcaccggggacatgagcggtttcggatcgcgtccgcttgtttagacgagctgtcttgtgaatttcttcttgctggggcagggggagcaggcgctggagcggcaccaggccctcatctgccccctagaggcagtgttccaggggacccagtcaggattcattgtaacatcaccgagtcgtatcccgcagttcctcccatttggagcgtggaatctgatgatcccaaccttgccgctgtgctggagcggctggtcgacataaaaaagggcaacaccctactgctgcagcacctcaagcggattatttccgacctgtgtaagctctacaatctcccacagcaccctgatgttgagatgctagaccaacctctccccgctgaacagtgcactcaggaagacgtctcgagcgaggatgaggatgaggagatgcctgaagatacagaagatttagatcactacgagatgaaggaggaggaacccgcagaggggaagaagagcgaagacgacggtatcgggaaagagaatctcgcaattttagaaaagatcaaaaaaaatcagcgccaggactacctgaatggagcggtgtctgggtcagtccaggctaccgatagactgatgaaggagctccgggacatctaccgaagtcaatctttcaaagggggtaactacgcagtggagctggtcaatgacagcctttatgattggaacgttaaacttctgaaggtggaccaggactcagccctgcacaacgacttgcagattcttaaggagaaggagggcgctgattttatactgttaaacttttcattcaaagacaattttccattcgaccccccattcgtgcgggtcgtaagcccagttttgtccggcggttatgtactggggggaggcgctatttgcatggaactgttgaccaagcagggttggagttcggcctatagcatcgagtccgtcatcatgcaaataagtgctaccctcgtaaaaggtaaagcccgagtacagtttggcgcaaacaagagtcagtactcactgacccgtgcacagcagtcctacaagtccctggtacaaattcacgagaagaacgggtggtacacaccccctaaagaggacggatag

SEQ ID NO: 60651 - DNA, 486 bp, Artificial Sequence
  Description of Artificial Sequence: Synthetic coding sequence
atgaaagaactccaggacattgcgcgactctcggacagatttatcagtgtcgaactagtagatgagagtctttttgactggaatgttaagcttcatcaggtcgacaaagactctgtgctgtggcaggatatgaaggaaactaatacagagtttatcctgctcaatttaaccttccctgataatttcccattcagcccaccttttatgcgggtgctgtcccctcgattagaaaatgggtacgtgctagacggtggagccatttgcatggagctgctgactccgagaggctggagtagtgcctacacagtcgaggcagttatgcgtcagttcgccgcttctttggtcaagggccaggggaggatttgtaggaaggctggaaagtcaaaaaagtctttcagccgtaaggaggccgaagctacttttaagtccctggtgaaaactcatgaaaaatacggctgggtgactccacctgtatcggatggatag

SEQ ID NO: 60652 - DNA, 681 bp, Artificial Sequence
  Description of Artificial Sequence: Synthetic coding sequence
atgcacggaagggcatatctcttattacatagggacttttgcgatcttaaggaaaacaattataaagggatcacagctaagccggtgtctgaggatatgatggagtgggaggtcgaaatcgagggcctccaaaactcagtgtggcaaggtctcgtgtttcagttgaccatacatttcacaagcgagtataactacgctccccctgtcgtgaaattcatcactattcccttccaccccaatgtcgacccacacacaggccagccttgcatcgatttcttagataatcccgagaagtggaacacaaactacacactgtcatccattctgttggccttacaggtgatgttgtcaaacccggtgctggagaatccagtgaatctggaggccgctagaatcctagttaaagacgagtctctataccgaactattttgagactgtttaaccgtcccttacagatgaaagacgattcacaggaattgccaaaagatccgagaaagtgtattagacccataaaaactactagctttagcgattactaccagacatggtctagaatcgctacatctaaggctaccgagtattaccgaaccccactcctcaaagtccccaattttattggacagtattataaatggaagaaaatggatttgcagcaccagaaagagtggaacctcaaatag

SEQ ID NO: 60653 - DNA, 966 bp, Artificial Sequence
  Description of Artificial Sequence: Synthetic coding sequence
atgcacggacgtgcctatttactgctccacagggacttctgtgacttgaaggaaaacaactataaagggataactgccaagcccgtttcagaagacatgatggagtgggaagtggagatcgagggcctgcaaaattcagtgtggcagggacttgtgttccagctcacaatccactttacctctgagtacaactacgcccctcctgtggttaagtttataacgattccttttcaccccaacgtggacccccacaccggccagccatgtatcgactttctcgacaacccggaaaaatggaacaccaattatactctgtctagcatcttgttggcactccaggtcatgctaagtaaccctgtcctggagaatccagtgaatcttgaggccgcaagaattctggtaaaggatgagtctctgtaccgcaccattctgcgactgtttaaccgtccgctgcagatgaaagacgattcacaggagctcccaaaagatcctcggaagtgcataagacctatcaagacaaccagtttttcagactactatcagacgtggtccaggattgctacttcaaaagcaactgaatactataggacccctctgttgaaagtcccgaacttcattggtcaatattataaatggaagaaaatggatctccagcatcagaaggaatggaacttgaagtactcagtgatcaaatgttggctggcacggaaacgcatgccccatgaggtgacccattccatggaggagattaagctttgtccaactctcattcccaccacggacgaaatctttttggagagccccaccgccattaattctattaccgatatttacgaaacagaggaggaggggtggaagagcgatacttcactgtatgaaaatgataccgacgaacccagagaagaggaagtggaagacctgataagctggactaataccctgaacacgaataccagcgaagattag

SEQ ID NO: 60654 - DNA, 504 bp, Artificial Sequence
  Description of Artificial Sequence: Synthetic coding sequence
atggccgatgaggctactcgacgggtcgtttccgagatccctgtcttgaaaacaaatgcgggtccccgagaccgggagctgtgggtgcaaaggctgaaggaagagtatcagtcgctcatccggtatgtcgagaataataaaaacgctgataacgattggttccgacttgagtcaaataaggaaggtacccgatggttcgggaagtgttggtacatccacgacttactcaagtacgaattcgacatcgaattcgatatacccatcacataccctaccaccgctccagagattgccgtgccagaactcgatggcaagactgccaagatgtatcgcggaggcaaaatttgcctgactgatcattttaagcccttatgggcacgtaacgtgcccaaatttggtttagcgcacctcatggctctgggccttgggccatggctggcagtggagattcccgatttgatccaaaagggcgtgatccagcacaaagagaaatgtaatcagtag

SEQ ID NO: 60655 - DNA, 3177 bp, Artificial Sequence
  Description of Artificial Sequence: Synthetic coding sequence
atgagcagctcccctctgagcaaaaagaggcgcgtatccggcccagaccccaagcccggttcaaactgctcaccagcccagtcagtgctgagcgaggtaccctccgtaccaactaacggaatggctaaaaatggatctgaagctgacatcgatgagggcctctattcccgccagctatacgtgctgggccacgaggcgatgaaaaggctacagaccagcagcgtcctcgtatccggtctccgtgggttgggtgtcgagatagcaaaaaacataatcctcggtggggtgaaggctgtaaccctgcatgatcagggaacagcacagtgggcagacctgagcagtcagttctaccttcgagaagaagacatcgggaaaaaccgggctgaagtcagtcagccgcgattggccgagctgaatagctatgtgccagttaccgcctatactgggccactcgtggaagatttcctgagtggcttccaggtggttgtcctcacaaacactccactggaagaccagctaagagtgggggaattctgccataacaggggtatcaaactggtggtggctgatacaagaggactgtttggacagttgttttgcgattttggggaagagatgattcttacagatagcaacggtgagcagcccctctcagctatggtctccatggtcaccaaggataaccctggggtcgttacctgcctcgatgaggcccgacacggattcgaatctggggactttgtgtcctttagtgaggtccaggggatggtagaactgaacggcaaccagcctatggagattaaggttctcggcccttacacatttagcatttgcgatacctcaaacttcagtgattatatccgagggggaatagttagtcaggtcaaggtgcccaagaaaatttcgttcaaatctctcgtggcctccttagccgagcctgatttcgtcgttaccgattttgccaaattttcaaggccggctcagctgcacataggctttcaggctctacaccagttctgcgcacagcatgggaggccgcctcggcctcgcaatgaagaagatgcagctgaattggtggccctggcgcaggcggtgaatgccagagccctgcccgctgtgcagcagaacaacttagatgaggatcttatcagaaagcttgcttatgttgctgccggagatctggcacctatcaacgcctttataggaggcctcgccgctcaggaggtcatgaaggcgtgctcaggtaagttcatgccaattatgcaatggctgtactttgatgcgctggaatgccttccagaggacaaagaggtcctcactgaggacaaatgcctgcaaagacagaatcgctacgacgggcaggtggcagtgttcggcagtgacttgcaagaaaaactcggtaaacagaagtatttcctcgttggcgctggagccatcggatgcgaactgcttaagaactttgcaatgatcggcctgggttgtggcgagggaggagaaattattgttacagatatggacactattgaaaaaagcaacctgaataggcagtttctgttccgcccatgggacgttacgaagctgaagagtgacaccgcagccgcagctgttaggcagatgaatcctcatatccgtgtgacctcccatcagaaccgggtaggtcctgacaccgagaggatctacgacgacgattttttccagaaccttgacggagttgccaatgcgttggacaacgtggacgccagaatgtacatggataggcggtgcgtttattataggaaacccctcctcgagtcgggtaccctcggaacaaaaggaaatgtccaggtggtaataccctttctgacagagtcctatagctcaagccaggaccccccagaaaagagtatacctatctgcaccttgaagaacttccctaatgctattgaacatacactccagtgggccagagacgagttcgagggtttgtttaaacagcccgcagagaatgttaaccagtacctgaccgacccaaagttcgtagagaggacgcttagactggcaggcacccagcctctggaagtgctcgaggctgtgcagagatcccttgtccttcagcggccacagacttgggccgattgtgtaacatgggcgtgccatcactggcacacacagtacagcaacaacattcgccagctcctccacaacttcccaccggatcagttaacctctagtggagcccctttttggagtgggcctaagcgctgcccacatccacttacctttgatgtgaacaatccccttcatcttgactacgtcatggccgctgccaacctgtttgctcaaacgtatggtcttacaggaagccaggatcgggctgccgtcgcaacattcctgcagtcagtgcaggtgcccgaatttactcctaagtcaggggtcaagattcacgtgagcgaccaggaactgcagtccgcaaatgctagcgtggatgattctaggctggaagagctcaaagccactttgccttcaccggacaagctcccgggatttaaaatgtacccaattgacttcgaaaaggatgatgattccaatttccatatggattttatcgtggccgcaagtaatctacgtgcagagaactatgacatccccagcgccgatcgccacaaatctaagttgatagccggtaagatcattcctgctatcgcaacgaccacagctgcggtcgtgggtctcgtctgcctcgaactgtataaggttgttcagggtcatcgccagctggattcgtataagaatgggtttctgaatttggctcttccattcttcggcttttctgagcccctggccgctccaaggcatcagtactacaatcaagagtggaccctttgggaccgttttgaggtacagggacttcagcctaatggtgaagagatgactttgaaacagtttcttgactacttcaaaacagagcataagctcgaaatcactatgttgtcccagggggtgtctatgctctatagcttctttatgcccgcagcaaaactgaaagagcgtctggaccagcctatgaccgagatcgtgtcacgagtttccaagagaaaactgggcaggcatgtgagagcccttgtcctggagttgtgttgcaacgacgaatctggcgaggacgttgaggtcccctacgttcggtacaccatccgatag

SEQ ID NO: 60656 - DNA, 1521 bp, Artificial Sequence
  Description of Artificial Sequence: Synthetic coding sequence
atgggctttcatcacgtgggccaggccggtctggagccactgacatcaggcgatccttccgcgctggcctcacaatctgccggtatcactggggtctcctactgcgcctggcctggcttcagcattgaggtgggtgagtggggtaggttagaaggttttcccacaagtagggtagcagtccgacttgttttggctctctttacagacgggccttctaacaatgcttgtgggaaccctttctgccagctgtggccacatgtgatctgcctgctttgcctccaatgggcccgtgatgagtttgagggactcttcaaacagcccgctgagaacgtgaaccagtatcttacggaccccaagtttgtcgaacgtacgcttcgactcgccggaacacagccccttgaggtgctggaagccgtgcagcgcagcctggtgctgcaaagacctcagacatgggctgattgcgtaacctgggcgtgtcaccattggcatactcagtacagcaataacatacgccaattactgcacaatttccccccagaccagctgacatcctctggagcaccattttggtccggcccaaagcgctgccctcatcctctcactttcgatgtgaataatcccctccatctggactacgtcatggccgctgccaacctattcgctcagacatacggccttacagggagccaggatcgggcagccgtggcgactttcttgcagtccgtacaagtgcccgaattcacacccaagtccggcgtgaagatccacgtttctgatcaagaactccagtctgctaacgctagtgtggatgattctcggctcgaagagctgaaagctaccctcccctcacctgacaagttgcctggcttcaagatgtaccccatcgactttgagaaagatgacgacagcaacttccatatggatttcattgtcgccgcaagtaacctgcgcgctgagaactacgatattcccagtgcagacagacacaagtctaagctaattgccggaaagattattcctgccattgcaaccacaaccgcagccgtggttggattagtatgcctggagctgtataaggtggtgcagggccataggcagctcgatagctacaaaaacggcttcctgaacctggctctacccttttttggcttttccgaaccactggccgctccaaggcaccagtactacaatcaggagtggactttatgggatcggtttgaggtgcagggcctacaaccaaatggcgaagagatgacgttgaaacaattcttggattatttcaaaactgagcacaagctggaaataaccatgctcagccagggtgtctccatgctgtatagtttctttatgccggctgccaagctcaaggagcgcttagaccagccaatgacggagatcgtcagcagagtcagtaagagaaagctgggtaggcatgtgcgggctctggtcctagagctgtgctgcaacgacgagtcaggggaggatgttgaggttccctacgtccggtacaccattcgatag

SEQ ID NO: 60657 - DNA, 3177 bp, Artificial Sequence
  Description of Artificial Sequence: Synthetic coding sequence
atgagcagttcccccttgtccaaaaagcggagggtgtcaggtcccgatccaaaacctggctccaactgttcacctgcacagtcggtgttaagcgaggtcccttccgtacctaccaacggaatggctaagaatgggtctgaagctgacatcgacgagggcctttactccagacagttgtatgtgttgggacatgaggccatgaagaggttacagacgagttcagtgctcgtgtctggtcttcgaggcctcggagttgagattgctaagaacatcatactgggcggagtaaaggcagtgaccttacacgaccagggaaccgctcagtgggccgatctatcttctcaattctacctgagagaagaagatatagggaagaaccgggcagaggtgagccagccccgtctcgccgaattgaacagctacgtgcccgtgaccgcgtacacaggcccactagtggaagactttttgagcgggttccaagtggttgtgttaacaaacactcccctcgaagatcaactgcgagtgggtgaattctgtcataacagaggcattaagctggtcgtagccgacacacggggactgttcgggcaactcttctgcgattttggtgaagaaatgatactcacggattctaacggagaacaacctctgtcagcaatggtctcaatggtcactaaagataaccccggtgtagtaacttgtctcgacgaggctcgacacggtttcgaatctggagattttgtctccttctccgaggtgcaaggaatggttgagctgaatggtaatcagcccatggaaattaaggtgctaggtccttatacattttccatttgcgacacatctaatttcagcgactacatccgcggtggaatagtctctcaggtcaaagtgccaaagaaaatttccttcaagagtctggtagcatcacttgccgaacccgatttcgtagtcacagactttgctaagttttctcgcccagctcagctccatataggctttcaggctctgcatcaattttgcgcccagcatggaagaccccctcgccctcggaatgaagaagacgctgccgaattggtggcactggcacaggccgtgaacgcgagagctttgcccgctgtgcagcagaataacttggatgaggatttgatacggaaactggcatacgtggcagcaggcgacttggccccaattaatgctttcattggagggctggctgctcaggaagtgatgaaggcctgttcaggcaaatttatgcccattatgcagtggctgtactttgatgccttagaatgcctgccagaggataaggaggtgcttaccgaggacaaatgtctccagaggcagaaccggtacgatggccaggtggccgttttcggctcagatttgcaggagaagcttggaaaacagaaatactttttggtgggcgcaggcgcaatcggttgcgagctgttgaagaattttgcaatgatcggcctgggttgcggggagggcggagaaatcatcgtgacagatatggataccattgagaagagcaatctgaataggcagtttttgttccgaccgtgggacgttacaaagctgaagagcgacacggctgcggcagcggtccggcagatgaatcctcacattagggttacatcacaccaaaacagagtcggcccagacacagagagaatctacgacgacgacttctttcaaaacctggatggggtggctaacgctctagataatgttgatgcgaggatgtatatggatagaaggtgtgtgtactataggaagcctctgctcgaatccggtactcttggtactaaggggaacgttcaggtggtcatccccttcttaactgagtcttattcctcatctcaggacccgccagagaagagcattcccatttgtacactcaagaatttccccaacgcgatcgagcatactctgcaatgggctcgggatgaatttgaaggtctgttcaagcagcctgctgagaatgtgaatcaatacctcaccgacccaaagtttgttgagagaaccttgcgtttggcaggaacacagcccctcgaggtgttggaagcagtgcaaaggtcccttgtactccagcgccctcagacctgggcggactgcgttacctgggcttgccatcactggcatacacagtattccaacaacatccgccagctactccacaattttcctcccgatcagctgacaagctcaggggcacctttctggagtggcccaaaaagatgtccccatcctctcacttttgatgtcaacaatccattgcatctggactatgtgatggccgcagcgaatcttttcgctcagacatatggactgacaggtagccaggacagggccgctgtcgccacgttcctgcagagcgtccaggtaccggaatttacaccaaaatcaggcgttaagatccacgtgagtgaccaggaacttcaaagcgccaacgcatccgtggatgacagccggcttgaggagctcaaggctactcttcctagccccgacaagttacccggatttaagatgtacccaatcgacttcgagaaggatgacgattccaattttcacatggacttcatcgtcgccgcaagcaatctgagagctgaaaattacgatattcccagcgcagatcggcataaaagtaagctcatcgcaggaaagattattccagctatcgcaacaaccacagcagcagtggtagggctcgtgtgcctggagctctacaaagtggtacaaggacatagacagctcgacagctataagaatggattcctgaaccttgcactccccttctttggcttctctgagcccctggccgctccacgccatcagtattacaatcaggaatggacactgtgggatcgatttgaggtgcagggcctgcagcccaatggcgaggagatgacactgaagcaattcttagactatttcaagactgagcacaagctggagataacaatgctgagccagggcgtgtctatgctgtactcattcttcatgccggctgccaaactcaaagagcggctagaccaaccaatgactgagatcgtgagtagagtgtccaagcggaaactgggacggcacgtgcgagcactcgtcctggagttatgttgcaacgacgaatccggagaggacgttgaggtgccttatgtgagatatacgatccggtag

SEQ ID NO: 60658 - DNA, 816 bp, Artificial Sequence
  Description of Artificial Sequence: Synthetic coding sequence
atgtcctcgagtccactatccaagaagcgcagggtgtccggaccagaccctaagccaggaagcaattgtagcccagcccaaagtgttctgagcgaggttccgagtgttcctaccaatggcatggcaaagaacgggagtgaggcagatatcgacgaagggctgtacagccgacagctctatgtgctggggcacgaagcgatgaaaagactgcagacttcttcggttcttgtgtccggcctccgaggattgggagtcgaaattgccaagaacataattctgggaggagtaaaggccgtgaccttacacgaccaggggacagcccagtgggcagacctgtcttcgcagttctatctgcgtgaggaagacatcggcaaaaatcgagccgaggtcagtcagccaagactggccgagctgaactcttatgtgcccgttaccgcgtacacagggccactggtggaggacttcctgtccggctttcaggttgtggtcctcactaacactcccctcgaggatcagctgagggtcggagaattctgtcataaccgcggtattaaacttgtggtcgccgataccagaggactttttggccagcttttctgcgatttcggagaggagatgatcctgaccgatagtaacggggagcaaccgttatccgccatggtttccatggtcacaaaggataatcccggagtggtaacctgtttagatgaggcacgtcatggattcgagagcggtgatttcgtgagctttagcgaagttcagggaatggttgaactgaacggcaatcaacctatggagatcaaggtgctagggtag

SEQ ID NO: 60659 - DNA, 522 bp, Artificial Sequence
  Description of Artificial Sequence: Synthetic coding sequence
atgctctgcgtcatttatcatcttgacaatcccgtcggcaaaatgagctccagtccgctgtccaaaaagcgacgggtatctggccctgatccaaagcctggcagcaattgtagtcctgcccagtcggtgttatccgaggttccgtctgttcccaccaacggaatggcgaagaacgggtctgaggctgatattgacgagggtctgtacagccgccagttatacgtcctggggcatgaggccatgaaacgtctccagacctcgagtgtcctagtctctgggttaagagggttgggcgtcgagatcgcgaaaaacattatactaggcggtgtgaaggccgtcacccttcacgaccaaggtacggcccagtgggcagacctaagctcccaattctacttgcgcgaggaagacattggcaaaaacagggcagaagtgtcacaacctaggctagctgagctgaactcctacgtgccagtgacggcctacaccgggcctctggttgaggacttcctgtcaggcttttag

SEQ ID NO: 60660 - DNA, 855 bp, Artificial Sequence
  Description of Artificial Sequence: Synthetic coding sequence
atgctgtgtgtgatataccaccttgacaacccagtgggaaaaatgtctagttcccccctgtcgaagaagaggagggtgtctggtccggatcctaagcccggttcaaattgtagccccgcacagagtgtgctttccgaggtaccctccgtgcctacaaatggcatggcgaaaaatggaagcgaggccgacattgacgaagggctctactcacgccagctgtacgtcctgggccatgaggccatgaagaggcttcagacatcctccgtcctagtgtctggtctgcgtggcctgggagtagaaatcgcgaaaaatattatccttggcggagtgaaagcggttactttacatgatcaaggcacggcacagtgggctgacctatctagtcagttttacctacgggaagaggatattggcaagaacagagctgaggtgtcgcagcccagactcgccgaactcaatagttatgtgcctgtgactgcctataccgggccattagtggaagactttctgtcaggattccaggtagtggtgctgacaaacacaccgctggaagaccagctgcgcgttggagagttctgtcataacaggggaatcaagctcgtggttgcagacaccagaggcctgttcggccagctgttctgtgacttcggggaagagatgatcctgactgactccaacggcgaacaacctttatcagctatggtgtctatggtcaccaaggataatcccggagtcgttacctgcctcgacgaagctcgccacggctttgaatcaggcgacttcgtgtctttctccgaagtgcaggggatggtggaactaaacggcaatcagccaatggagattaaagtgttatag

SEQ ID NO: 60661 - DNA, 705 bp, Artificial Sequence
  Description of Artificial Sequence: Synthetic coding sequence
atgagtaagcctcacttccccccagccctcccagcccctgctgcaatccccggaataaaaggcgaagagaatgggtgtctgctactccccacttactctgtccccggttctatgctctgcgtgatatatcacctggacaatcccgttggcaaaatgtcttcatctcctctcagtaaaaagcggagagtgagcggtccagaccctaagcctggctcaaactgttctcccgcacaaagcgtgttgagtgaggtacctagcgttccaaccaacggaatggcaaagaatgggtccgaagccgacatcgatgagggcctctattctcgtcagctctacgtcctcggacacgaagcaatgaaacgcctgcagacctcctccgtgctcgtgagtggcttgcggggattaggagtcgaaattgccaaaaatatcatcctgggcggagttaaggccgtgacactgcacgatcaggggacagcccagtgggccgatttaagctcccagttttacttgagggaggaggacatcggcaaaaacagggcagaggtgtctcagcctaggctggctgagctgaatagttacgttcccgtaaccgcttatactgggcctctcgtcgaggatttcctgtcaggctttcaggtggtggtgctgaccaatactccgctagaggatcaactgcgtgtgggagagttttgtcacaaccgcggttag

SEQ ID NO: 60662 - DNA, 588 bp, Artificial Sequence
  Description of Artificial Sequence: Synthetic coding sequence
atgagcaagccccactttccgccagctctgcccgctccggctgccatccctgggatcaagggagaggagaatggatgcttactacttccaacatactcggtcccaggctccatgctatgtgtgatttatcatctcgacaatccagtcgggaaaatgagtagcagccctttatcaaagaagagaagagtcagcgggccagacccaaaacccggttctaactgctcgccagctcaatctgtgctgagcgaagtcccttcagttcccaccaacggaatggctaagaatggctccgaagcagacattgatgaagggttgtactcgaggcagctctatgtgctgggtcacgaagcaatgaagcgcctacagacctcttctgtgctagtgtctggtctgcgcggattgggcgtggagattgccaagaatattatcttggggggagtcaaagcagtcacgttgcacgatcaagggacggcacaatgggctgacttatcaagtcagttctacctccgcgaagaagatatcgggaaaaacagggccgaggtttcgcaacctaggttagctgagctgaatagttatgttccagtgtag

SEQ ID NO: 60663 - DNA, 843 bp, Artificial Sequence
  Description of Artificial Sequence: Synthetic coding sequence
atggcgactgaggcacccgtgaacatcgcacctcctgagtgcagcacagtggtctctacagccgtagattcactgatctggcagccaaactcacttaacatgcacatgatcagacccaagtccgccaaaggcagaaccagaccctcactgcagaagagtcagggggtcgaagtgtgcgcccatcacataccctcccccccaccagccattccttacgaattgcccagcagtcagaaacccggtgcatgtgcccctaagtctcctaaccaaggagcatccgacgagataccagaactgcagcagcaagttcctacaggggcttcatcctccttgaacaaatatcccgtgctcccttcgatcaatcggaagaatctggaggaggaggccgtggagactgtggcgaagaaggcttcttccctgcagctgtcctcaattagagctctttatcaggacgagacgggcactatgaagacctctgaggaggatagtcgggctcgagcatgcgcagtcgagagaaaatttatagtccgtactaagaaacagggcagctccagagccggaaaccttgaggaaccttctgaccaagaacctcggcttctcctcgccgtgagaagtccaacaggccagcggtttgtgaggcatttcaggcctactgatgatcttcaaacaattgtggcagtggcagaacaaaaaaacaaaacatcgtatcggcattgtagcatagagacaatggaggtgcctcggagaagattctcagacctgacaaagtcccttcaagagtgccggatccctcataaaagcgtcttgggcatctctcttgaagatggagagggatggccttag

SEQ ID NO: 60664 - DNA, 1155 bp, Artificial Sequence
  Description of Artificial Sequence: Synthetic coding sequence
atggcgttcccgtgtaggagatccttgactgctaaaaccttggcatgcctgctggtcggcgtgagttttttggccctacagcagtggttcttgcaagcaccccgtagtccccgtgaagagagatccccgcaggaggagactccagagggtcctacagatgcacccgcagccgacgagccacctagtgagctggttcccggaccaccttgtgtggccaatgcctctgccaatgcaaccgcggacttcgagcagctccccgctaggatccaggacttcctaaggtataggcattgcaggcacttcccactgctgtgggacgctccggcaaaatgcgcaggtggtaggggggtcttcctgcttctcgcagtcaagtcagctcctgaacattacgagcggagggagctcatacggaggacctggggccaggagcggagctacggaggtcgccctgtgcggaggctctttctccttggcacaccaggcccagaagacgaggccagagctgaacggcttgcagagcttgtggccctggaagcccgagaacatggtgacgtcctgcagtgggctttcgcagacacatttttaaaccttacacttaaacatctgcatcttctggattggttggcagcgagatgcccccatgccaggtttctcctgtcaggggacgatgatgtctttgtgcataccgctaacgtggtgcggttcttacaggcacagcctcctggacggcacctcttctcaggccaactgatggaaggaagcgtgcccattcgcgattcatggagcaagtacttcgtcccccctcaactatttccaggtagcgcttatcctgtgtactgctcagggggaggttttttgttatcaggccctacggcacgagcactgcgcgcagcggctcgacatactcccttgtttcccattgatgatgcctatatgggcatgtgcctcgaacgggctggattggcaccctcgggccatgagggcatctggccatttggggtccagctcccaggggcacagcagagtagcttcgacccgtgtatgtacagagagctgctgctcgttcacagatttgccccatatgagatgcttctgatgtggaaagcgttgcacagtccagccctgtcatgcgaccgagggcatagagtgtcttag

SEQ ID NO: 60665 - DNA, 792 bp, Artificial Sequence
  Description of Artificial Sequence: Synthetic coding sequence
atggcctttccctgtaggaggtctcttaccgcgaagactctcgcctgccttcttgtgggggtgtcatttcttgctctgcagcaacgcagaaggcaaagagtgccgccaaccctgcctcgccctgcccgagcccaccctggcctgcccgcagtcccccaggagcgtagttatggtgggagacctgtacggagactgttcctgcttggcacaccagggcctgaggacgaggcccgtgctgaacgactggccgaacttgtagccttggaagcgagggaacacggcgatgtgctgcagtgggcctttgcggacacttttctgaacttgacactgaagcacctgcacctgctcgattggctggccgctcgatgcccccatgctagatttttactgagcggcgacgacgatgtgttcgtacatacagccaatgtggtgcgatttctgcaggcccaacctccaggcagacacctgttctcaggccagctcatggaggggtctgtgcctattcgggattcttggtctaagtatttcgtcccaccccagcttttcccgggtagtgcttacccggtctattgttccgggggaggctttctcctctctgggcttgccccttctggccacgagggcataccgagtgcctgctctctgcctggcgcacagcagtcgagtttcgatccttgcatgtatagggagctcctgctggtgcatcgatttgcaccatatgaaatgctcctgatgtggaaggctcttcacagtccagctctttcttgcgatagaggccatcgagtgtcctag

SEQ ID NO: 60666 - DNA, 366 bp, Artificial Sequence
  Description of Artificial Sequence: Synthetic coding sequence
atggcatttccctgccgcaggtcactgactgccaagacactggcctgccttttggtgggagtgtcattcctggccctgcagcagtggttcctacaggcaccgaggtctcctcgagaggaaagatcacctcaagaggaaactcctgagggacccaccgatgcccctgcagccgacgagcccccaagcgagctggtccctggccctccttgtgtggccaacgcctccgctaacgccacagctgatttcgagcaattgcccgctcggattcaggactttctgcgttaccgacactgccgccatttcccccttctgtgggatgcccctgcaaaatgcgccggagggaggggtgtgttcctgttgctgtag

SEQ ID NO: 60667 - DNA, 1158 bp, Artificial Sequence
  Description of Artificial Sequence: Synthetic coding sequence
atggctttcccctgtcggaggagcttgactgccaagaccctcgcatgtttgctggtgggtgtgtcatttctggcacttcagcagtggttcctgcaggcccctaggtctccacgggaggaacgcagccctcaggaagagacacctgagggacctaccgatgccccagctgcagatgaacccccaagcgagttggtgcctggacctccatgtgttgcaaacgcctctgctaatgccacggccgactttgaacagctgcctgcccgaattcaggactttttgagataccggcactgcaggcacttcccccttctgtgggacgcacctgctaaatgcgcgggtggccgaggagtgttcctgctgctagccgtgaagtcagcacccgagcactacgaacgcagggagctcattaggcgcacttgggggcaagaaagaagctatggtggaagacctgtgaggcggctttttctcctgggcacaccagggccagaggacgaggctcgggcagaacgcctggccgagctggtcgcactagaggctcgcgaacacggtgacgtcctccagtgggcatttgcagacacttttctcaatctcacactgaagcacctccatctgttagactggctggctgcacgctgcccgcacgctcgattcctgttgagcggcgatgacgatgtgttcgtacacaccgccaacgtggtacgattcctgcaagcccaacctccaggcagacatctcttctccggacaacttatggaaggtagcgtgccaatcagagactcctggtccaagtattttgtaccgcctcagcttttcccgggttcggcctatcctgtctactgcagcggcggaggctttctgcttagcggacctaccgcccgagctctgcgggcagctgcaaggcatactcctctgttccccatcgatgacgcgtatatgggcatgtgcctgggagcccgtcgacctggcgctcaacgaccaagaggccatcctggtccttcagcctgttcattgcctggagcccagcagagtagctttgatccatgtatgtatagagaactcctgcttgtacacagatttgccccatatgagatgctcctgatgtggaaggccctccatagcccagcattatcttgcgatcggggtcatagggtttcctag

SEQ ID NO: 60668 - DNA, 1086 bp, Artificial Sequence
  Description of Artificial Sequence: Synthetic coding sequence
atgtccggcgctggcgtggggggagcctccgaagagagccaggctatgcaagcacacgtatctataatcttgcctgtacacaacgctgaaccttggctcgatgagtgcctaagaagcgtgctgcagcaggatttcgaggggaccatggagctgagcgtgttcaacgacgccagcaaagataaatctggcgcaatcatcgaaaaatggagggttaagctcgaagattcaggtgtccacgttatcattggcggacacgacagtccctcaccccgaggcgtgggatatgcaaagaaccaggccgtcgctcaatccagtggatcttatctgtgttttttggactcagacgatgtaatgatgccacagagagtcaggctgcagcacgaagcagccgtacaacatccttcctcaatcatcgggtgccgggtgagaagagacccacccaactccaccgaaagatacacccgctggattaatcaattgactccggagcagctgttgactcaggtattcacaagtaacggccctaccgtgatcatgcctacatggttttgttctagagcctggttcagccacgtcggcccattcaatgaggggggtcagggagtgcctgaagacctcctctttttctacgagcaccttcgcaaaggtggaggcgttatccgcgtggaccaaagccttcttctctaccgccaccaccctcaagcagcaactcattgtgtgcttgaaacaacgatctggacccatcgagtgcggtttctggaggagcaggcgctgcctcggtgggccgcatttaccatctggaatgctggaaagcagggacgaagactataccgcagtctgactgctggctcccagagaaaagtggttgctttctgcgacgtcgatgagaataagatcaggaagggtttctattgccatgaggacagccaggagaggcccaagcccaggattcctatactgcatttccgggcagctcgtccaccttttgtgatttgtgtcaagctcgatctgaccggcggagcattcgaagacaatcttcgctctctacacctgcaggaggggcaggattttttacacttcagttag

SEQ ID NO: 60669 - DNA, 1812 bp, Artificial Sequence
  Description of Artificial Sequence: Synthetic coding sequence
atggccgtggcgaggaaaattcggactctgctgacggtaaatatcctcgtttttgtggggatcgtgctcttctctgtgtactgtcggctgcaaggacgtagccaggagctcgtgagaatcgtgagtggagatcgacgggtccgaagtaggcacgctaaagtgggcacactgggagatcgggaggcgatcctacagagactggaccacttggaagaagtggtgtataaccagctcaatggcttagccaagccaatcggactggtggagggcccaggcggactcggacaaggcggactggccgctacgcttagggatgacggccaggaggcagaagggaagtatgaggagtacggttacaatgctcagctgtccgaccgcatttccctcgataggagtataccagattatcgccctcgcaagtgtcggcagatgtcatacgcccaggatctcccgcaagtctctgttgtcttcatctttgtcaacgaggcactgagcgtgattttgcgttctgtgcattctgtggtgaatcacacgccttctcagctgcttaaagaggttatattggtggatgacaacagtgacaacgtggaattgaaattcaacctggatcagtacgtgaataaacgttaccctgggttggtgaaaattgtccggaatagcagaagggagggtctcattagggccagattgcagggttggaaagccgctaccgcacctgtcgtcggcttcttcgatgctcatgtggagtttaatacaggctgggcagagccagcattatcaaggataagagaggataggcgtcggatcgtcctgccagctatcgacaatattaaatactctactttcgaggtccagcagtacgctaatgcggctcatgggtacaattggggcttatggtgcatgtatattattccgccacaagattggttagatagaggcgatgagagcgctccaatcaggacccccgctatgattgggtgctcgttcgttgtagacagagaatattttggcgacatcgggctgctggatcccggaatggaggtttatgggggagaaaatgttgagttgggtatgcgggtatggcagtgcggagggtccatggaagtgctaccctgctctagagttgcccacattgaaagaacacgcaaaccttacaataacgatatcgattattatgcaaaacggaatgccttaagggccgcagaagtgtggatggacgactttaaaagtcacgtgtatatggcctggaacattcccatgtccaaccctggcgtcgattttggggacgtaagtgagcgtttagccttgcgtcagcgacttaaatgtagatcttttaaatggtatcttgagaacgtgtacccagaaatgcgagtatataacaacacgttgacgtatggggaggtgcgaaacagcaaggcctccgcctattgcctggatcagggagcggaggacggcgatcgggctatcctatacccttgccacggaatgagctcccaactagtacgatacagtgctgacgggctgctgcagctgggtcctctaggttccaccgcctttttacctgatagtaagtgccttgtggacgacgggacagggagaatgcctactctcaagaaatgtgaagacgtggcgaggccgactcagaggctttgggacttcactcagagcggacctatcgtgtccagagcaacgggcaggtgtctggaagttgagatgagcaaagatgcaaatttcggacttcggctcgttgtccaacgctgttccggacaaaagtggatgataaggaactggatcaaacatgctcgccattag

SEQ ID NO: 60670 - DNA, 714 bp, Artificial Sequence
  Description of Artificial Sequence: Synthetic coding sequence
atggaggtcctaccatgcagccgagtggctcatattgaaaggactaggaagccctacaacaatgatatcgattattatgctaagcgcaatgctctccgggctgcagaggtctggatggatgatttcaaatctcacgtgtatatggcctggaacatccctatgtccaacccgggagtggacttcggggacgtgagcgagaggcttgccctgcgccagagattaaaatgtaggtctttcaaatggtatctggagaacgtgtacccagaaatgagagtttataacaataccctgacatacggagaagtacggaattcgaaggcatccgcgtactgcctcgaccagggcgctgaagacggcgaccgggctatcttatacccgtgccacggaatgtccagtcaactggttaggtattctgcggatgggctgttgcagctaggtcctttgggatctactgcattcctgcccgattctaaatgccttgtcgacgacggcacagggaggatgcctaccctaaaaaagtgcgaggatgttgccagacctacccagcggctgtgggatttcacacaatccgggcctatcgtttcaagagcaaccggaaggtgtctggaggtggagatgagcaaggatgctaacttcggcctcaggctggtggtgcaaaggtgcagcggtcagaagtggatgattaggaattggatcaaacatgctcgacactag

SEQ ID NO: 60671 - DNA, 1065 bp, Artificial Sequence
  Description of Artificial Sequence: Synthetic coding sequence
atgataggatgcagcttcgtggtggatcgggagtattttggcgatattgggctccttgacccagggatggaagtctatggtggcgaaaacgtggagctcggtatgagggaaacggaaggcttccagcaggataaggtgaattacaaacagaataagcggggaaggaaaacgagacagcgcgttaagcgctccaggtcagaggcccaccgcgcacagccctcccccggagcaacacacggtgcacattctagagcacctggacctcgaaccgagcctacagcagagccgtgggggcacgcacggccaacggctgcgctgccagccaccggagtgtggcagtgtggcggttccatggaagtcctcccgtgtagcagggttgcgcacatcgagcgaacacgaaagccctacaataacgacattgactactacgcaaagagaaatgcgctgagggccgctgaggtgtggatggacgatttcaaatctcatgtgtatatggcttggaatatccccatgtccaaccctggggtcgatttcggcgacgtttccgagaggctagccctacgccagaggctcaaatgcagatcattcaagtggtaccttgagaatgtttatccagaaatgcgcgtttacaataacactttgacttatggcgaggtcaggaattcgaaggcctcagcttattgcttggatcagggggcagaagatggcgacagagcgatcttgtatccatgtcacggaatgagctcccaacttgtccgctatagcgccgatggcctgctccagctcggacccctggggtccacagcctttctccctgactctaaatgtctggtggacgacggcaccggcaggatgccaacactgaaaaaatgcgaagatgtagctaggccaacgcaacggttgtgggacttcacacagtccggaccaatcgtgtccagagccaccggacggtgcttggaagtggaaatgagtaaggatgctaactttggattacgcctggtggtgcagcggtgttctggacaaaaatggatgatacggaactggatcaaacacgcacgacactag

SEQ ID NO: 60672 - DNA, 294 bp, Artificial Sequence
  Description of Artificial Sequence: Synthetic coding sequence
atggaggttctaccgtgtagtagagtcgcgcatatagaacgcacccggaaaccctataacaatgatatagactactacgctaagcgaaacgccctaagggctgccgaagtgtggatggacgatttcaaatcccacgtttacatggcttggaatatccccatgtcgaatcccggagtagatttcggcgatgtgtctgagagacttgccctgagacaacgccttaagtgccggagcttcaaatggtacctagagaacgtgtatcccgaaatgcgcgtatataacaatacattgtag

SEQ ID NO: 60673 - DNA, 714 bp, Artificial Sequence
  Description of Artificial Sequence: Synthetic coding sequence
atggaggttctaccttgttctcgggtggcgcatattgagagaactcggaagccctacaataatgacatcgattactatgccaagcggaatgcattgcgcgctgcagaagtttggatggatgatttcaaaagccacgtctacatggcctggaatatccccatgtccaaccccggagtggattttggagacgtgtcagagagactcgcactgcgacaacggctgaagtgtcgaagcttcaagtggtacctggagaacgtgtatccggagatgagagtttataacaacaccctaacctatggggaagtccgaaactccaaggcttcagcatactgcctggatcagggcgctgaagacggtgaccgggctattctgtatccatgccacggcatgtccagccagttagtgcgatactccgcagacggacttttacaactcgggcctcttggcagcacggcgtttcttcctgactctaagtgtttggttgatgatggcacagggcgaatgcctacactgaagaaatgcgaagacgtcgccagaccaacgcaaaggctgtgggactttactcagagcggtcctatagtctcccgggcaaccggtcggtgtctggaggtggaaatgtccaaagacgctaactttggcctgagactcgtggtgcagcgctgcagcgggcagaaatggatgatcaggaactggattaaacacgcaagacattag

SEQ ID NO: 60674 - DNA, 165 bp, Artificial Sequence
  Description of Artificial Sequence: Synthetic coding sequence
atggaagtcctgccttgctcaagggtggcacatatagaacgcaccagaaaaccctataacaatgacatagactattatgcgaagaggaacgccctgcgggcagcggaggtctggatggatgattttaagagtcacgtctatatggcctggaatattccaatgtag

SEQ ID NO: 60675 - DNA, 714 bp, Artificial Sequence
  Description of Artificial Sequence: Synthetic coding sequence
atggaagtgctgccttgcagtagagtcgcccatatagagcgaaccagaaaaccatacaataatgacatcgattactacgccaagcgcaatgccctgagggccgctgaagtgtggatggatgacttcaagtctcacgtgtacatggcctggaacattccgatgtctaaccctggtgtggactttggagatgtgtccgaaaggcttgccttgcgccaaaggctcaagtgcaggagtttcaagtggtacctggaaaatgtttatccggagatgcgggtttataacaatacgctgacgtacggcgaagtgagaaatagtaaggctagcgcttactgtttagatcagggcgcagaagacggagatagagccatcctctacccatgtcacggtatgtcttctcagttggttcggtacagcgccgatggtctgttacagcttggcccactgggttccactgcctttctccccgactctaaatgtctggtggacgatggaactggcagaatgcccacattgaaaaaatgtgaagacgtcgctcgtcctacccagagattgtgggactttactcagtcaggacctattgtctccagggctacaggaaggtgcctggaggtcgagatgtctaaggacgccaatttcgggcttaggctcgtagtgcagaggtgtagcgggcagaagtggatgattcggaattggataaagcacgctagacattag

SEQ ID NO: 60676 - DNA, 1812 bp, Artificial Sequence
  Description of Artificial Sequence: Synthetic coding sequence
atggccgtcgctcgcaaaattcgcaccctacttactgtcaacattcttgtcttcgtgggcatagttctgttcagcgtttactgccgacttcagggccgttcacaagaattagtgagaattgtttccggagaccgcagggtgaggagcagacacgctaaagtcggcacccttggtgacagggaagcaattttacaaaggctcgatcacctggaagaggtggtgtacaaccaactcaatggcctcgccaaacccattggcctggtcgaaggacctgggggactgggccagggcggattagccgcaactctgcgggacgatggccaggaagccgagggaaaatatgaggagtacggctataacgcgcaacttagcgaccgcatatccttggataggagcattcccgattaccgacccagaaagtgtcggcaaatgagctacgcgcaggacctcccacaggtgtctgtggtgtttatattcgtcaacgaagccctgtctgttattttgcgatccgtacactccgttgtcaatcataccccatcccaactgctcaaggaagtcattctggtcgatgataatagtgataacgtggagctcaaattcaaccttgaccagtatgtcaataagcggtaccctggccttgtgaaaatcgttcggaacagccggagagaaggccttattcgtgcaagactgcaggggtggaaagccgctacggccccagttgtcggattttttgatgcccatgtagagttcaacacaggttgggctgagcccgctctctcacgcatccgcgaggatcgtaggcgtatcgtacttcccgctattgataacattaaatacagtactttcgaggttcagcagtacgccaacgctgcacacggatacaactggggcctctggtgtatgtacattatccctccccaggattggcttgacaggggggacgaaagcgcacccatccgaacgcctgcgatgattggctgttccttcgtcgtggatcgggaatacttcggggatatagggctcttggatccaggcatggaagtgtacggcggagagaatgtcgagcttgggatgagagtctggcagtgcgggggtagcatggaggtcctgccttgttcccgtgtggcccacattgaacgtactagaaagccgtataataatgacatcgactattacgctaagcgcaacgctctgcgcgcagccgaggtttggatggacgactttaaatcccatgtttacatggcttggaacatacctatgagtaatccaggagtcgactttggagatgttagcgagagactggccttgcgccagagactcaaatgtagaagcttcaaatggtatctcgagaatgtgtatccagagatgcgtgtgtacaacaatactttgacgtacggcgaggtacgcaacagcaaagcttccgcctactgtctggaccaaggcgcagaggacggagaccgcgcaatcttgtacccatgccatggtatgtccagccagctggtgcgctactcagctgatggtctgctccaactcgggcctctcgggagcacagcattccttccggactccaagtgtctcgtggacgatggaacagggcgtatgcccacactaaaaaaatgcgaggatgtggccaggcctactcagcgactttgggattttacccagtcaggacctatcgtgtctcgcgctacgggcaggtgcctggaagtggagatgagtaaagatgccaactttggacttcggctggtcgttcagaggtgttcaggccagaagtggatgattcggaactggatcaaacatgcgaggcactag

SEQ ID NO: 60677 - DNA, 1155 bp, Artificial Sequence
  Description of Artificial Sequence: Synthetic coding sequence
atggggcctggccctagcccaaattggaccctggaccctgagccccgatgtcgcctctggtcggagccccgacttccagctgggccaggcgtacttgcagctgggtcccctcgattaccgtgtagatacgtcatgacgtcagaattcactcttggacctactgcagagttctttcgggaacacaattttttccacttggacccagctaacgtggtgatgtttgagcagcgactcctgcccgctgtgactttcgatgggaaagtcatcctggaacgtaaagacaaggtggccatggcacccgacgggaatggcggactttactgcgccttagaagatcataagattctggaggatatggagcggaggggggtggagttcgtgcatgtgtattgtgtggacaatatcctggttcggcttgccgatcctgtatttatagggttctgcgtgcttcagggcgctgactgtggcgctaaggtcgttgagaaagcttatcctgaagagccagtaggcgtggtctgtcaggtggacggcgtgccccaggttgtggagtattccgaaatcagccctgagactgcacagctgcgggctagcgacggctcactcttgtacaatgctggcaacatttgcaaccacttctttactcggggtttcctcaaagccgtaacccgcgaattcgagccactcttgaaaccacatgtcgccgtgaaaaaagtgccgtatgtcgacgaggagggcaacttagtgaaacctttaaaacctaatggaatcaaaatggagaaattcgtgttcgacgttttccgatttgccaaaaacttcgcggctcttgaagtcctgcgggaagaagagttcagcccactcaaaaacgctgagcctgccgaccgtgattcaccgaggactgctagacaggcccttctgacccagcattacagatgggctcttcgcgctggtgccagattcctcgacgcccacggagcctggctccctgagctgccatctctgcctccaaatggcgacccaccagctatctgcgagatcagtcccttggtgtcttactcaggggagggccttgaggtctacctacaagggagggaattccagagcccgctgatcctggacgaagatcaggcgcgtgagcctcagctacaggagtcttag

SEQ ID NO: 60678 - DNA, 1524 bp, Artificial Sequence
  Description of Artificial Sequence: Synthetic coding sequence
atggcatccgagcaggacgtccgagcacgtctgcagagagccggacaagaacacctgctccggttttgggccgaactggcccctgagcccagagccgcactcctagctgaattagcactgttagaaccagaggctttacgggagcattgccgccgagctgccgaagcctgtgctcgcccacacggccctccgccagaccttgcggctcgtctcaggcctctcccccctgaacgggtgggcagggccagcaggtcagatcccgaaactcgccgacgctgggaagaagaggggttccgtcaaatctccctgaataaggtggccgtgctgctgcttgcagggggacagggcacccgactcggcgttacctaccccaaaggaatgtaccgagttggactgccctcccgaaagacactttaccaattacaggcagaacgcattcgcagggtggagcagttagctggcgagcgccatggtaccaggtgcacagtaccgtggtatgtgatgacttccgaatttacgttggggccaaccgccgaattttttcgggaacacaattttttccaccttgatccagccaacgtggttatgtttgaacagaggctcctccccgcagttacttttgacggcaaggtaatcttggaaaggaaggataaggtagccatggctccagatggcaatggcggtttatactgtgccttggaagatcacaagatcctggaagacatggagaggagaggcgtggagttcgtgcatgtctattgtgttgataatattttagtgcgcctggccgatcccgtgtttatcggcttctgcgtgcttcagggggcagattgcggagctaaggtggtggagaaggcatatcctgaagagcccgtgggcgtggtgtgccaggtggatggggtgccacaggtggtggagtattctgaaatcagccccgagaccgctcagctgagagccagcgatggctccttgctatataatgccggaaacatatgtaaccacttctttacgcggggattcctcaaggctgtaacccgagagttcgaacccctcctaaaacctcatgtggccgttaagaaagtcccctacgtcgacgaagaaggtaacctcgttaaaccccttaagcctaatgggataaagatggagaagtttgtgttcgatgtattccgatttgcaaagaatttcgcggctcttgaggtgttgcgtgaagaggaattctctcctctcaagaacgccgaacctgccgacagagacagcccacggactgcaaggcaagccctcctcactcaacattatagatgggcactgcgggctggagccagattcctggatgctcacggagcgtggttaccagagttgccgtcgctcccaccaaatggtgatccgcctgcaatctgcgagatctctcccctggtgtcatattctggcgaaggtttagaggtgtatctccaaggtcgggaattccagtccccccttatcctggacgaagatcaggcacgggagccccaacttcaagagagctag

SEQ ID NO: 60679 - DNA, 4323 bp, Artificial Sequence
  Description of Artificial Sequence: Synthetic coding sequence
atggcgggtatcataaagaagcagatactgaagcatctgtcacgctttactaagaatctcagccccgataaaattaacctaagtacactaaagggtgaaggtcagctcacaaacctggagcttgacgaggaagtcctgcagaatgtgctggagctccctacctggctagccataacacgggtctactgcaacagggccagcatccgcatccagtggaccaaacttaagacacaccccatctgtctgtgccttgacaaagtcgaggtcgaaatgaagacctgcgaagacccgcgacccccaaatggccagagcccaatagcccttgcgtctgggcagtccgagtacggatttgctgaaaaggtggtcgagggcatgtttatcatagtaaactcaatcacaataaaaatacattctaaggctttccacgcgagcttcgaattgtggcagcttcagggatatagcgtgaaccctaattggcagcagtcagacttgaggcttaccaggataaccgacccgtgtcggggagaagttctgactttcaaggaaatcacttggcagacactccggattgaagcggatgcaaccgataacggagaccaggacccggtcactacacccctgcgactgatcacgaaccagggtagaatccagatcgcgctaaaacgacgtacgaaagactgcaatgttatatcctctaaacttatgtttctccttgatgatttgttgtgggttttaactgactcacaactcaaagcgatgatgaagtatgcggagagtctgagcgaggccatggagaagtccgctcatcaacggaagtccctggcccctgagccagttcagataacaccacccgcaccctctgcccaacagagttgggcccaagcttttgggggaagccagggcaactcaaactcctcctcttcccggctttcacaatacttcgagaaattcgacgtgaaggaaagtagctatcatctcctcataagccgcctggacctgcatatttgcgatgatagtcagtctcgggaacctggtgtatcggccaacagacttatgggcggagctatgcagcttactttccggaagatggctttcgattactaccctttccactgggcaggggattcgtgcaaacactgggttcgacactgcgaggccatggaaacgcggggacagtgggcccagaaactcgtcatggagtttcagtctaagatggagaagtggcacgaagagacgggcctgaaacccccatggcacttaggcgtggactccttgtttcggaggaaggccgatagccttagtagtccaaggaaaaatcccctggaacggagtccgtcacagggtaggcagccggcattccaaccacccgcatggaataggcttcggagcagctgtatggtagttagggtggacgacctggatattcatcaggtgtccaccgcaggacagccctcaaaaaaaccttcaacattgctatcatgcagcagaaaactgcacaatctgcccactcaagtgtccgccattcatatcgaattcaccgagtactactttcctgataaccaagagctgccagtcccttgtcctaatctgtatatccaacttaacggccttactttcactatggacccggtctcgctgctctgggggaatctcttttgtctcgatctgtaccgttctctggaacagttcaaggctatctacaagctggaggattcaagccagaaggacgagcatctggatatacggcttgacgcattctggctgaaggttagttttcccctggaaaagcgggagcgggcagagttgcacaggccccaggccctggtatttagcgcctctggcatgatcgctacaaatacccggcacgccccacactgctcctgtagtgatctgcagagcctgttccgtgggttcgccgctgccgaatttttccactccaactacgaccacttccctaaagttcctgggggattctcactcttacacatgctgtttctgcaccacgcttttcagatggattcatgtctgccccagccaaataccttgcctcctcagcgacccaaggctagttgggatctttggagtgttcactttacccagatcagcttagatttcgaaggcacggagaactttaagggtcatacgttaaactttgttgcaccattccctttatctatatgggcctgcctaccgctgagatggcagcaggcacaggcaagaaaactgcttctggcttctgagggacgattgaaacccagcgcttcctttgggtcacccgtacagtccgaagccctcgcacctgattcaatgagtcatcctaggtctaagacagagcatgacctaaagtccctgagtgggttaactgaggtcatggaaattctcaaagagggcagcagcggaatggacaacaagggacccctgacagagctcgaagacgtcgccgacgtgcacatgttagtgcattcccctgcgcacgtaagagtgcggctggaccactaccaatacctggccctattgcggctaaaggaggtcctgcagcggctgcaggagcaactcactaaagacaccgagagcatgacggggtcgcccttgcagaatcaaaccgcttgtataggagtgttgtttccctccgcagaagttgctcttcttatgcacccagctcccggtgccgtcgatgctgattccgctggttcagacagcacatctttggtcgactccgaactgtcacccagtgaagaccgggaactgaagtccgacgctagcagtgaccaggggcctgcctccccagagaaagtcctcgaggagtcaagcatagagaaccaagacgtgtctcaggagaggccccactccaacggggaactgcaggactctggtcccctggcccagcaactggctgggaaaggccatgaagcggttgaaagcctacaggccaagaagctgagccgcacgcaggcctcctcttcccccgctgcattgaaacccccagccggacgagaaacagccgtgaacggtcagggggagcttattccccttaagaatatcgagggggagcttagttccgctatacatatgacaaaggatgccaccaaggaagctctgcacgcaaccatggaccttaccaaagaggcggtgtctctgaccaaagacgccttttctcttggaagggatagaatgactagcactatgcacaagatgctgtctctgcctcccgctaaggagccgatggcaaagacagacgagggtgtggccgctcccgttagcgggggtgccgctcgcctgcgcttcttcagcatgaaaagaaccgtttctcagcaatcttttgacggcgtctcgctggattcatcaggtcctgaggatagaatttctgtggatagtgatgggtcggattcatttgtaatgttattggaatcagaaagtggtccagaaagcgttccacccggatctctttcaaatgtgtcagataatgccggtgtccagggcagccctttggtaaataattatggacagggatctccggcagccaactcttctgtgtcaccaagcggggaagacctgatcttccacccggtcagtgtgttggttttgaaagtaaacgaggtgagtttcggcattgaagtgaggggtgaggacctcactgtcgctctacaggccgaggaattaaccttgcaacaactgggtactgtgggcctgtggcagtttctgcacggccagtgtccaggtacgtgtttccaggaaagctccaccttgaaaacaggacacatcaggcccgctgtaggccttcgattcgaggtggggcctggcgctgccgtccactctccgctggcctcccagaatggtttcctgcatttactactccacggttgcgatctcgagctactcactagtgtgctcagcgggttgggaccctttctagaagacgaggagattccagtggtggtgcccatgcagattgagctcttgaattcttctattaccttaaaggatgacatcccccctatatatcccacatcacctggccctatccctatcaccctcgcaatggagcatgtggtgctaaagagatccgatgatggcgtattccatatcggcgctgctgcccaagacaagcccagcgcagaagtgctgaaaagtgaaaaacgccaaccacccaaagaacaggtctttctggtccctaccggggaagtattcgagcagcaagtcaaagagttgcccattctccaaaaggagctgattgagactaagcaggccttagctaacgcgaatcaagacaaggagaagctcttacaggaaattcgcaagtataatccttttttcgagctctag

SEQ ID NO: 60680 - DNA, 4203 bp, Artificial Sequence
  Description of Artificial Sequence: Synthetic coding sequence
atggccggaatcatcaagaaacaaatcctgaagcatctgagcaggttcacaaagaatctgtctccagataagattaacctgagtacactcaagggtgagggacagctcacaaacttagagcttgatgaagaagtgcttcagaacgtgctcgagctccccacatggctggccatcactagagtgtattgtaatagagctagtatacgtatacagtggactaaactcaagacccacccgatctgcctctgcctggacaaggtcgaggtggaaatgaagacctgcgaagacccaaggcccccaaacggccagtccccaatcgccctggcatccgggcaaagcgaatacggctttgccgaaaaggtcgtggaggggatgtttatcatcgtaaattcgattaccatcaagatccactccaaggcttttcacgcctccttcgagctgtggcaactccagggttacagcgttaacccaaattggcagcaaagcgacctgcggctgacaagaatcacagacccttgtaggggcgaggtgctgaccttcaaggagataacctggcaaaccttgagaatcgaggcagacgccacagacaacggtgaccaggaccctgtgacaactccccttagactgattactaaccagggtagaatccaaatagccctcaaacgccgtaccaaagactgcaacgtgatttcaagcaaactgatgttcctactcgatgatcttctgtgggtcctgaccgactcccaactcaaggctatgatgaagtacgccgagtcactgtcggaggccatggagaagagtgcacaccaacggaagagcctggctcccgagccggtgcagattaccccgccagctccctccgcgcagcagtcctgggctcaggcattcgggggttctcagggcaatagcaactcctcatcctctaggctgagccagtactttgagaagtttgatgtcaaggaatccagttatcacctgctgatctccaggcttgacctgcacatatgcgacgactcccagtcccgtgagcccggagtcagcgcaaatcgcctcatgggaggggctatgcaactcaccttccgcaagatggccttcgactattaccccttccactgggcaggggacagctgcaaacattgggtgcgacactgcgaagcaatggagacccgtggacagtgggcacaaaaattggtgatggaattccagtccaaaatggagaaatggcacgaagaaactgggctgaagcctccgtggcatctgggcgtggatagtctgttccggagaaaagcagattctttgagcagcccaaggaaaaatccgctggaaaggtccccaagccagggcaggcagccagcctttcagcccccagcttggaaccgactcaggagcagctgcatggtggtaagggtggatgatttagacatacatcaggtcagtaccgccggtcagcccagtaaaaagccttctacgctcctttcctgttcacgtaaactgcataacctacccacccaagtcagcgccattcatattgagttcacagaatattatttccccgacaatcaagaactgcccgttccttgtcccaatctgtacatccagttaaacgggcttacgtttacaatggaccctgtgagtctgctgtggggcaatctgttttgcctagacctgtacaggagccttgaacagtttaaggcgatttacaagctcgaagacagttctcaaaaagacgaacacctcgatattaggctcgacgccttctggctgaaggtgagcttccctctagagaagagggagcgagctgagctccacaggccacaggcactagtgttcagcgcatccgggatgatcgctacaaacactcggcacgctccccactgttcatgctccgacctgcagtcattattccgaggattcgccgcagctgaattttttcattccaattacgatcacttccctaaggtgccaggagggttttccctgctgcatatgttgtttttgcatcacgccttccaaatggactcttgcttgccacagcctaacaccctccccccacagaggccaaaggccagttgggatctttggtcggtgcatttcacgcagatttctctggacttcgagggcaccgagaacttcaagggacacaccctaaacttcgtggcaccttttcctctgtctatctgggcctgcctgcctctcagatggcaacaggcccaggcgagaaaactattgctggcgagcgagggacgcctgaaaccctctgcatccttcgggtcacctgtgcagagcgaggcattagcgccagatagcatgtcccatccgaggtctaagacggagcatgacctgaaatccctctcaggtctgactgaagtaatggagatccttaaggagggaagcagcggcatggacaacaagggcccactgacagagctagaagatgtcgctgatgttcacatgttggtgcattctccggcacacgtccgcgttcgcctagaccattatcagtacttggcgctgttaaggctcaaagaggtgctacagcgactgcaggagcagttgaccaaggacaccgagagtatgactggcagtccgcttcagaatcagacagcttgtatcggcgtcttgtttccgtcagcagaggtggctttgctaatgcacccggcacccggagctgtggatgccgactccgccggttcagacagcacaagcctggtagattccgagctttctccaagtgaggaccgggagctgaagagtgacgcctccagcgaccaaggacctgcctcccccgaaaaggttctagaggagagctccattgagaatcaggacgtgagccaagaaaggccccactcaaatggcgaactgcaggactccggacccctggcccagcagctcgcgggaaaaggacacgaagccgtagaatctctgcaggcaaagaagcttagtcggacacaagcatctagtagcccggctgccttgaagcctcccgctggaagggagactgcggtaaatggtcagggcgaactgatccccttaaagaacattgaaggcgagctgtcatctgccatacatatgaccaaggatgcaactaaggaagcactccacgcgactatggatctgactaaggaagcagtgagtctgactaaagatgccttttcattgggtcgggatcgcatgactagtacaatgcacaagatgctctcactgcctcccgcaaaagagcctatggcaaagactgatgaaggcgtggcagctcccgttagcggcggagccgcacgtcttaggttttttagcatgaagcgtacagtgtcacagcagtcattcgacggcgtgagcctggattcttctgggccagaggaccggatatctgtcgactcggacgggtccgactcgtttgtgatgctgctcgagtccgagtccggacccgaatccgtccctccaggctcactttcaaatgtgtcagacaatgccggagtccagggttcaccactggtcaacaactacggtcaaggatctcccgctgctaatagtagtgtgagtccgtctggagaagatttgattttccaccccgtcagcgtgctggtgcttaaagtaaatgaggtaagcttcggaatagaagtgcggggtgaggatttaaccgtggccctgcaggccgaagagctaactctgcagcaactgggaaccgtgggcctgtggcagtttttgcatggccagtgccccggtacatgcttccaggagagcagcactcttaaaacgggccacattcgtccagccgtgggcctgcggtttgaggttggtcccggtgcagcagtgcatagcccgctggcctcgcagaatggcttcctccatctgcttctgcatggttgcgaccttgaactgttgacctctgtactctcagggttgggaccctttctggaagatgaggagatcccggtggtagtgccgatgcagattgagcttcttaattccagtattactcttaaggatgatattccacctatatatccgacaagtccgggacctatccccataacgctggccatggagcacgtggtgctcaaacggtccgatgatggggtattccacataggagcggctgcgcaagataaaccttccgctgaggtactgaagtccgagaaacggcaacctcctaaggagcaggtcttcttagtgcccacgggcgaagtctttgaacagcagacctag

SEQ ID NO: 60681 - DNA, 4395 bp, Artificial Sequence
  Description of Artificial Sequence: Synthetic coding sequence
atggccggaattatcaagaagcagatattgaagcacctgtcacggtttacaaagaacctgagcccagataagataaacctttccacactcaagggggagggcgaactgaaaaaccttgagctcgacgaggaggtgctgcagaacatgctggatctgcctacatggcttgctattaataaggtgttctgcaacaaggcctccatacgtattccctggaccaagctgaaaacccaccccatctgcctgagcctcgacaaggttatcatggagatgagtacatgtgaagaaccgaggtctccgaacggcccaagcccaatcgccaccgcaagtggccagagcgaatatggtttcgcagagaaggtggtcgaagggatctccgtgtccgttaattcaatcgtcattcgcattggagcaaaggcattcaacgccagcttcgagctcagtcagttgagaatctactccgtgaacgcccattgggagcacggagatctgcggttcacccggatccaagatccacagagaggtgaggttcttaccttcaaagagatcaactggcagatgatccggattgaggccgacgcaacccagtctagccacctggagatcatgtgcgcaccagtcagattaataactaaccaaagcaagattagagtcaccctgaaaaggaggttgaaggactgtaacgttatagcgaccaagcttgtcctgatcctagatgatctactctgggtgctcaccgactctcagctaaaagctatggtgcagtatgccaagagtctatcagaagcaatcgaaaaatcgactgagcagcggaagtccatggctcctgagcccactcagagctcaaccgtcgtcgctagtgcacagcaggtcaaaacaacgcagacgagcaatgctccagatgtaaacgatgctatcgtcaaactctttaatgattttgacgtcaaggaaactagccaccatctggtgatctcccacttggatctgcatatatgtgatgacatccacgcaaaggaaaaagagtctaaccggaggattaccgggggtgccatgcagctaagtttcactcagctgacgattgattactatccctaccataaggcaggtgattcctgtaaccattggatgtattttagcgacgctactaagaccaaaaatgggtgggcaaacgagttactgcatgagttcgaatgcaacgtggagatgctaaagcaggcggtgaaagaccacaacgtcgggtcacccccaaaaagcccaacacatgccagccctcagcacacccagaccgagaaggactatcccctgaaggggacctgccgtacgccttcagtgctgtctcagcagagcaaggccaaactaatgagctcgagcgtcgttgtgcggcttgccgacttcaacatctaccaagtgtcaacagcagaacagtgccgaagcagcccgaaatctatgatctgctgtaacaagaagagcctgtacctaccccaggaaatgtccgccgtgtacatcgagtttacagagtactactaccccgacggcaaggactttcctataccaagccccaatctgtactcacagctcaacgccctacagtttaccgttgacgagcggtcaattctctggctgaaccaattcctactcgacttgaagcagagccttaaccagttcatggctgtgtacaaactgaatgacaattctaagtctgacgagcacgtggacgtcagggtggatggcctgatgttgaaattcgtgatcccctccgaagttaaatctgaatgtcaccaggaccagccaagagctataagcattcaaagttcagagatgatcgctactaacacccggcactgtcccaattgcagacattcagacctcgaagctctgtttcaagactttaaagattgtgactttttctctaaaacctatacgagtttcccgaagtcatgcgataattttaacctgctgcacccaatcttccagcgccacgcccacgagcaggacacgaaaatgcatgagatctacaagggcaacatcaccccccaattgaataaaaatacgctcaagaccagcgccgctaccgacgtctgggctgtgtacttctctcagttctggattgactacgaaggcatgaaaagtgggaaagggaggccaatttccttcgttgactcctttcccctgagcatatggatctgtcagcctacaaggtacgccgagagccagaaggagccacaaacgtgtaaccaagtgtcactaaatactagtcagagcgagagcagcgatctagctggcaggctgaaaagaaagaaactgctgaaagagtactattccacagagtcagagcccctcaccaatggaggccagaagccaagcagctctgacacatttttccgtttcagcccttctagcagcgaggccgacatccacctccttgtgcacgtgcacaagcacgtctccatgcagataaaccattatcaatacctgctgctgctgtttttacatgagtcactgatcctactgtccgagaatctgaggaaggatgttgaggctgtgactgggtctcctgcaagccagaccagcatatgtataggaatcctgctccgatcggccgagttagcgttgctcctccatccggtggatcaggcaaacacattgaagtcaccggtcagcgaatctgtgtcgccggtcgtgccagattacctgcccacagaaaacggggatttcttgtcctctaagaggaaacaaatctcccgcgacataaaccgtatcaggtccgtcaccgtgaatcatatgagtgataacaggtccatgtctgtggacctctcgcacattcccctaaaagaccctctgctattcaaaagcgcctccgacaccaacctgcagaaagggatcagttttatggactacctatcggacaagcatctgggcaagatcagcgaggatgaatccagcgggctcgtgtacaaaagcggcagtggagaaatcgggtccgaaaccagcgataagaaagatagcttctacacggactccagctccattctgaattatagggaggactcgaatatcctgtcttttgattcagatggtaatcagaacattctgtcttctaccctaacctctaaaggaaatgagacaatagaatcaatttttaaggcagaggacttactgcctgaggccgcaagcttaagcgagaatcttgatatcagcaaggaggaaaccccacccgtgaggactctgaagagccagtcctcactctccggcaagcccaaagagagatgcccccctaacctcgctccattatgtgtctcatataaaaacatgaagcgatccagctcccagatgtccctggataccatatccctcgattctatgattctggaggagcaattgctcgaatccgatggatccgactcccacatgtttctggaaaagggcaacaaaaaaaatagtaccacgaattataggggcacagctgagtcagtgaatgcaggcgcaaacctgcagaattacggcgagacaagtcctgacgccattagtacaaacagtgagggggctcaggagaatcatgacgacctaatgtccgtggtggtatttaaaataaccggcgtcaatggggaaatcgatataaggggggaggataccgagatctgtctacaagtgaatcaagtcacccctgaccagctggggaatatcagtctccgacactacctatgtaaccggcctgttggcagcgaccagaaggcagtgatacacagtaagagctctcccgagatatccctccggttcgaatccggccctggggctgtgatccattcactattggcggaaaaaaacgggtttctgcaatgtcacatcgagaattttagtactgagttcctcacctctagcttgatgaacattcaacactttctggaagatgaaaccgtcgctacagtcatgcccatgaagatccaggttagcaataccaagattaaccttaaagacgacagcccaaggagttctaccgtgagtctcgaacctgcacctgttacggtgcacatagaccacttggtcgtggaaagatcagacgatggcagctttcacatccgggactctcacatgctgaatacaggaaatgatctgaaggagaatgttaagtcagacagcgtcttgctgactagcgggaaatatgacttgaagaaacagcggagtgtcacccaggctactcaaaccagtccaggggtcccttggccttcacagtccgccaactttcccgaattcagctttgacttcactagggaacaactgatggaggaaaacgaatccctcaaacaggagcttgcaaaagccaaaatggcgcttgcagaggcccacctggagaaggacgcactcctgcatcatattaagaagatgactgtcgagtag

SEQ ID NO: 60682 - DNA, 1569 bp, Artificial Sequence
  Description of Artificial Sequence: Synthetic coding sequence
atggctgggattataaagaagcaaattttgaagcacctcagcagatttactaagaatctctccccagataaaatcaacctgtcaacactgaagggtgaaggcgagctgaagaatttggagcttgacgaggaggtgctgcaaaatatgctcgatttacccacgtggctggcaatcaataaagtgttttgtaacaaagcatccatcagaattccttggacaaaattaaaaacccaccccatctgtctcagcctcgacaaagtgataatggaaatgtccacctgtgaggagcccaggtctcccaatggacccagcccgattgccacagcatccggacagagcgaatacggattcgcggaaaaagttgtggagggtatctctgtcagcgtgaattccatagtgatcagaatcggcgcaaaagcctttaacgccagctttgagctttcccagctgagaatttatagcgtcaatgctcactgggaacacggagatctcaggttcactagaattcaggacccccagcggggtgaagtgttgaccttcaaggagataaattggcaaatgattcgcatcgaggccgatgcgacacaatccagccacttggagatcatgtgcgctcctgtccgtttgataaccaaccaaagcaaaatccgtgtgacccttaagcgacgcctgaaggattgtaacgtaatagcgacgaagctagtcctaatcttggatgatcttttgtgggtgctgacagactcccagctaaaagctatggtgcagtacgctaagagtctttctgaagctatcgagaaaagcacggaacagaggaaatctatggctcccgagcccactcagagttccaccgtcgttgcttcagcgcagcaagtgaagactacccagacgtccaacgcaccagatgtcaacgacgcgattgtcaagctcttcaacgactttgacgttaaagagacctctcatcacctggttatttctcatctggatctacatatctgtgacgacattcacgccaaggagaaggagtctaaccggagaatcaccggcggagccatgcagctgtcctttacccagctcaccatcgattactatccttatcataaggccggtgactcctgcaaccactggatgtacttctccgacgctaccaagaccaagaatggctgggccaatgaactgctgcacgaattcgaatgtaacgtagaaatgcttaagcaggcagtgaaggatcacaacgtagggtctccccctaagtctcccactcacgcatcccctcagcacacccaaaccgagaaggactatccacttaaaggcacttgcagaacgccatccgttctgtctcaacagtcaaaggctaagctcatgtcttctagcgtggtggtgcgcctggctgatttcaatatctaccaagtgagcacagcagagcagtgccggtctagccccaaatccatgatttgctgtaataaaaaatccctgtacctgccgcaggagatgtccgctgtgtatatagagttcaccgagtactactaccccgacggaaaggacttccccacggcttttctatctcgctag

SEQ ID NO: 60683 - DNA, 756 bp, Artificial Sequence
  Description of Artificial Sequence: Synthetic coding sequence
atgtctggcagcaatccaaaggccgcagccgctgcgtctgctgccggtccaggaggactggttgcaggaaaggaggagaaaaaaaaggccggaggcggagtcctgaaccgcctgaaagctcgcagacaagctcctcaccatgccgcagatgacggcgtcggagccgctgttaccgagcaagaactgttagccctagatacaatccggcctgagcacgtgctgagactgtcgcgagtgactgagaactatctctgcaaaccggaagacaatatttactctatcgacttcactcgctttaaaattagagacctagagaccggcaccgtcctgtttgagatcgccaaaccctgcgtgtcagatcaagaggaagacgaggaggagggtggaggggatgtcgatatcagcgcgggtcgcttcgtcagataccagttcacccctgctttcttgcggttgagaacagtgggagcaaccgtcgagtttactgtcggggacaagcccgtcagcaattttcgcatgatcgaacgtcactactttagagagcatcttctgaagaattttgacttcgatttcggattttgcatcccgtcgtctcggaatacttgcgaacacatctacgagttccctcagctttctgaagacgtgataagattaatgatcgaaaacccgtatgagactcggtctgattctttttactttgtagacaataagcttattatgcacaataaggcagattacgcttataatggcggtcagtag

SEQ ID NO: 60684 - DNA, 756 bp, Artificial Sequence
  Description of Artificial Sequence: Synthetic coding sequence
atgagtggatcaaacccgaaagcagcggctgccgcttccgcagctggacctggcggattggttgccggaaaggaggaaaaaaagaaggccggaggaggtgtgctcaaccgactgaaagccaggagacaggcacctcaccacgccgcagacgacggcgttggagcggcagtaacagaacaggagttgctagccctagacactatacggcctgaacacgtgctgaggttgagtagggtcacagagaattacctgtgtaaaccagaagacaatatctacagcatcgactttacacggtttaaaatcagggatctggagaccggaaccgtcttattcgagatcgctaagccatgcgtatctgaccaggaagaagacgaggaggaaggaggtggcgacgtggatatctcagctggcaggtttgttagataccagttcacgcctgccttcctgagactgcggaccgtgggggctaccgtagagtttaccgttggagataagccggtgtctaactttaggatgatcgagaggcattactttagagagcacctcctgaaaaatttcgactttgactttggtttttgtataccaagcagcagaaacacatgtgagcacatatatgagtttccacagttgtccgaagacgtgatccggcttatgatcgaaaatccctatgaaacccgctcagatagcttttactttgtggacaacaagctgatcatgcataataaggctgactatgcttacaatggaggccagtag

SEQ ID NO: 60685 - DNA, 3828 bp, Artificial Sequence
  Description of Artificial Sequence: Synthetic coding sequence
atggagaattttattctgtacgaagaaattggccgaggaagtaaaactgtcgtgtataagggccgtagaaaaggaactatcaatttcgtggccattctgtgcacggataaatgtaagcggccagaaattacaaactgggtgcggctgacaagagagattaaacacaagaacatcgttaccttccatgagtggtatgagacatctaatcacctgtggctggtcgtagaactgtgtactggtggcagcctcaagacagtgatcgcacaggacgaaaatctacccgaagacgtggttagagagtttgggatcgatctgatctcgggccttcaccatttgcacaaattaggaatcctgttctgtgatattagtccgaggaagattctcctggaaggtcctggtaccttgaaattctctaatttctgtctggcgaaggtggagggagagaatctcgaggaattctttgccctggtggctgcagaggaaggtggtggcgataatggagagaatgtgttgaagaaatcgatgaaaagccgagtgaaagggtctccagtatatacggcacccgaagtggtacgaggtgccgacttctcaatctcctccgacctgtggtccctgggctgtctgctttatgagatgttcagcggtaagccgcctttcttttcagaatcaattagtgaactcacggagaagatcctctgcgaagaccctctcccgcctatccctaaggattctagccgcccaaaagcttcctcggatttcattaacttgttggatgggctgctgcagcgagatccacagaagcggcttacttggacgcgactcctgcaacactctttctggaaaaaggcgttcgctggcgctgatcaagagtctagcgtggaagacctgtccttgtctcgtaacactatggagtgctcaggtccacaggattcaaaggagctcctacaaaacagtcagtctaggcaggccaagggacataaatccgggcaaccacttggacactcctttcgccttgagaacccaaccgaatttcggcctaaatctacattggaaggacagctgaacgaatccatgtttctgttatcctcccggccaacaccaaggacctcaactgccgtggaggtttcccccggagaagatatgacccactgcagtcctcagaagacaagcccccttacgaagatcacatctgggcaccttagtcaacaggacctggagtcccagatgagagagctgatctacactgactccgatttagttgtaacacctataatagacaatccaaaaattatgaagcagcccccagtgaagttcgatgctaagatcctgcatctgcccacctattctgtcgacaagctgctattcctcaaagatcaggattggaatgacttcctccagcaagtgtgttcccagattgattcaactgagaagtcaatgggagctagtagggctaaattaaatctgctgtgttacctgtgtgtggtggctggtcaccaggaggtagcgactaggttgctccactccccactctttcagctcctaattcaacacctgagaatagcccctaattgggacattagggcaaaggtcgcccacgtcattgggcttcttgcatctcatactgcagagttacaagaaaatacacccgtcgtcgaggccattgtcctcttgacagaactgattagggagaactttcgcaattccaaactcaaacagtgtctcttaccaaccctaggagaacttatctatctcgtggccacccaggaagaaaaaaagaaaaatcctagagaatgctgggctgtaccactggcagcatataccgttctgatgagatgcctgcgcgaaggggaagagagggtggttaaccacatggcggctaagatcattgaaaacgtgtgcaccacattttccgcacaatctcaaggctttattaccggggagataggccctattctttggtacctgtttagacactccacagccgatagcttgagaataacagcggtctcggccttatgcagaattacaaggcattccccaactgccttccagaacgtcattgaaaaagtcggtctcaacagtgtaattaacagtctggcttccgcgatttgcaaagtgcagcagtatatgttgacactgtttgccgctatgctgagctgcggaattcatcttcaaagactcattcaggagaaaggcttcgtgtcaactattatcaggctacttgattcaccgtcaacgtgtataagggccaaggcattcttggtcctcctctatattctaatttataacagggaaatgctgctactctcgtgtcaggccaggctggtaatgtatatcgagagagatagtcgcaaaactacacctggcaaggaacaacagagcgggaatgagtacctgagcaagtgtctagaccttcttatttgccatattgttcaggagttaccaaggattcttggcgacatcctgaatagcctggcgaacgtctctggcaggaagcatccatccacagtgcaggtgaagcaattgaaactttgtctgcccctgatgccggtcgtactgcacctggttacctcacaagtttttagaccccaggttgtcactgaagagttcctcttctcctatggcaccatcctgagccatatcaagtctgtggactcaggcgagactaacatagatggcgcaatcggcctaacggctagcgaagagttcataaaaattaccctgtctgcctttgaggccatcattcagtatccaattctcttgaaggattaccgctcaaccgtggtggactatattctgccacccttggtgtcactggttcaaagccagaacgtcgaatggcgcctgttcagcctgaggctgttgtccgagactaccagtcttttagtgaaccaggagtttggagacgggaaagagaaagcaagtgtggacagcgattccaatctacttgcactcatccgagatgtcctcctgccccagtacgagcacattctgctggaacccgacccggtgccagcctacgcccttaagctcttggttgctatgactgaacacaaccctactttcactcgactggtggaggagtccaaactaatacctctgatcttcgaagtgaccctagagcaccaggaatccattcttggcaatacaatgcagagtgtgatcgcactgctgagcaaccttgtcgcgtgcaaggacagtaacatggagctcctgtatgaacagggtctcgtctcccacatctgtaaccttctcactgaaacagccactctgtgcctggacgtcgataacaaaaataacaatgaaatggccgctccattgttattttctttgctggatattttgcacagtatgctgacttatacatctggaattgtccgactggctcttcaggcacagaaatcgggatctggggaggacccacaggctgctgaggatctgctgttgttgaatcgtcccctgacagacctgataagtctgctgatcccactcctacccaatgaggatccagaaatttttgatgtgtcatctaaatgcctatctatcctggtgcagctgtatggtggcgaaaacccagattcgctcagtcctgaaaatgtcgaaatattcgcacatctactgacttccaaagaggaccccaaagagcagaaacttcttctgagaattctgaggcggatgatcacctcaaatgaaaagcacctggaatccctaaagaacgccggaagcttactgcgcgcacttgaaagacttgccccaggttccggcagtttcgctgattctgctgttgcacctctggcattagaaattctccaggctgtgggccactag

SEQ ID NO: 60686 - DNA, 210 bp, Artificial Sequence
  Description of Artificial Sequence: Synthetic coding sequence
atgcagaaatactgtatttatcagcattttcagttccagttgctgatccagcatctgtggatcgccgctaattgtgacatctgggcgaaagttgctagggttattggacttctcgcttctcacaagactgacctgcaggaaaacacccctgtggtcgaagcctttccgaactcaccacgtactccaactcttcccggagtcttaacatag

SEQ ID NO: 60687 - DNA, 210 bp, Artificial Sequence
  Description of Artificial Sequence: Synthetic coding sequence
atgcagaagtactgcatctatcagcactttcagtttcagctgctgattcagcacctgtggatcgccgcaaattgcgacatctgggcaaaggtggcgcgagtgatcgggctactcgcgtcccataaaaccgatttgcaggaaaatacccctgtcgtagaggctttcccaaacagccccagaacaccgacgttaccaggtgttctgacctag

SEQ ID NO: 60688 - DNA, 7377 bp, Artificial Sequence
  Description of Artificial Sequence: Synthetic coding sequence
atgatcagtactctggcgacctttcccccattccttcataaggacattatcgagtatctctcaacatccttcctccccatggctatcttgggatcaagtcggagagaaggcgtgccagcgcacgtcaacctgtcagcgtcaagtatgcttatgatcgctatgcagtacaccagcaatccggtataccactgccagctgctcgagtgtttaatgaagtacaaacaggaggtttggaaagacctgttatacgtgatcgcttatgggccttcacaagtgaaaccccctgccgtgcaaatgcttttccactactggcctaacttaaaacctccaggcgcaatcagtgagtacagagggctgcaatacactgcttggaaccccatccattgtcagcacattgagtgtcacaacgcaatcaataagcccgcagtcaagatgtgtatcgatcccagcctgtccgtcgctcttggagataagcccccacccctttacttatgtgaggaatgttccgagcgcatagccggagatcactctgagtggctgatcgacgtgctgcttccccaggccgagatcagtgcaatttgccagaaaaagaactgctcctcacatgttcggagagctgtggtcacatgtttctctgccggttgctgcggaagacacgggaacagaccagtccggtattgtaagcgatgtcactcaaatcatcatagcaacgaggtcggcgcagcagctgaaacccacttgtaccagacatcgcccccaccgatcaacacgagggagtgcggggctgaggaattggtctgcgccgtcgaagcagtgatatctctgctcaaagaagctgaatttcatgctgaacaaagagagcacgaattgaataggcggaggcagttaggcctgagcagctcgcatcattctctggataacgcggactttgacaacaaggatgatgacaaacacgatcagcggctgttgtcccagttcggtatttggtttttggttagcctgtgtacgccttccgaaaacacaccaaccgagtctctggcgagactcgtcgcaatggtcttccagtggtttcacagcaccgcgtacatgatggatgacgaggtcggcagcctagtggaaaaactaaagccccagtttgtgactaaatggcttaaaacggtttgtgacgtcaggttcgacgtcatggtcatgtgcctgcttcccaaacccatggagttcgctcgggtgggcggatattgggataagtcttgttccacagtcacacagttgaaggagggactaaatcgcattctatgtctgataccttacaatgtcattaaccagtcagtatgggagtgtattatgccggaatggctcgaagcaatccgaaccgaagtccccgataaccaactgaaagaattccgggaagttctcagtaagatgttcgacatcgaactttgtcccctacctttcagcatggaagagatgttcggatttatctcatgtagattcacgggttacccatccagcgtgcaggaacaggctcttctttggctccatgtgctgtccgaactggatattatggtgccattgcagttgctgatctcaatgttcagcgacggcgttaattccgtcaaagaactggcaaatcagaggaagtctcgtgtgtctgagcttgctggaaatttagccagccgacgtgtctctgtggcatcagacccagggagacgcgttcaacacaacatgctgagtcctttccactcaccatttcagagccctttcaggtcacctcttcgatcgcccttcaggagtcctttcaaaaacttcggccaccctggcggtaggaccatcgactttgattgcgaggacgatgagatgaacttgaactgttttattttaatgttcgacctactgctgaaacagatggagctgcaagacgatggcataacaatgggcctcgaacactccctgtcaaaggatatcattagcatcatcaataacgtgttccaggccccatggggaggaagtcatacgtgtcagaaagacgaaaaagcaatcgaatgcaacctctgccagtcgagcatcctctgctaccagcttgcctgcgagttactggaaaggctcgctcctaaggaggagagtcgcctggtagagcctaccgactccctggaggactcactcctgagtagtcgccctgaatttattatcggacccgaaggcgaagaggaggagaacccggctagcaaacacggcgagaatcccggaaactgtacggagcctgtggagcatgcagccgtcaagaatgacaccgagcggaagttttgttatcagcagcttccggtgactctcagactaatctacacaatctttcaggagatggcgaaattcgaggaaccggatattctctttaatatgttgaactgcctcaagatcctgtgcctccatggcgaatgtctgtatatcgccagaaaggaccacccccaattcttagcctatatccaagaccacatgctgattgcatccctttggcgcgtggtcaaatccgagttctcccagctttcttccttggcagtcccacttctgttgcacgccctttctctgccccacggggcagatattttctggacgataattaacggcaacttcaattcgaaagactggaaaatgaggttcgaggcagtggagaaagtggctgtcatatgtaggtttctagacatccattccgtgaccaaaaatcatttgttgaagtattcattggcccatgctttctgttgtttcctgactgctgttgaggatgtgaacccagctgtcgccacacgagcaggtctcctgttggacacaattaagagaccagcactgcagggactctgcttgtgcctggactttcagttcgatacagtagtcaaggatcggccaaccatcctgagtaaactgctgttgctccacttcctgaagcaggatattccagccctgtcctgggaattctttgtgaatcgcttcgaaacgctttcactcgaagctcagctgcacctggattgcaataaagaattcccctttcccaccactatcacagccgtcagaaccaatgtcgctaacctgtctgacgctgccctctggaagatcaagcgcgcacgctttgccagaaacagacagaagtccgtccgatctttaagggactcagtgaagggccctgtagagtccaaacgagcattaagcttgccagaaactcttacttcaaaaatacgtcagcagtccccagaaaacgataatacaatcaaggaccttctgcccgaggacgccggtatcgaccatcagaccgtgcaccagctaataacagtcctgatgaagttcatggctaaagacgaatctagcgcagaaagcgacatctcatcagcaaaagcatttaacactgtgaaacgccatttatacgttctgctagggtatgatcagcaggaggggtgttttatgatcgcccctcagaagatgcggctgagcacctgttttaacgcatttattgccggtatcgcccaggtcatggattataacattaatctgggcaagcacctcttgcccctggtagtgcaagtcctcaaatattgcagctgcccccagctgcgacactactttcagcagccgcctagatgttccctgtggagtctcaaaccacatatacggcagatgtggctgaaagccttattggtaattctgtacaaatatccataccgagattgcgatataagcaagatcttacttcacttaatacacattacagttaacacactcaatgctcagtatcattcctgcaaaccacacgcaactgcaggtcctctgtattccgataatagcaatatcagtaggtattccgagaaggaaaagggcgaaatcgagcttgccgagtaccgagagaccggggctcttcaggactcccttctgcactgcgtacgggaggagtctattccaaagaagaaactgcgctcgtttaagcagaagtccctggatattgggaacgccgattccctcttatttacccttgacgaacatcgtcggaagagttgcatagatcgctgcgacattgagaaacccccaacccaggctgcgtatattgcacagcgacctaatgacccgggacgttcaaggcagaattctgcaactcggcctgacaactccgaaattcccgagaatccggctatggaagggtttcctgatgccagacgacctgtgattccggaggtgagactgaactgtatggagacattcgaggtgaaggtggatagcccggtcaaacccgcaccaaaagaggacctcgatctgattgacctctccagtgattcaacctctggtccggagaagcactcaatcttgtcgactagtgacagcgattctctcgttttcgaacccctccctccattgcgtattgtcgagagtgacgaggaggaggagactatgaaccagggagacgacggcccatccggtaagaacgcagcaagttcacctagcgtcccctcccatcctagcgtgttgagcctgtcaactgcccctctggttcaggtgagcgttgaggactgcagtaaggatttctcatcaaaagacagtggtaacaaccaaagtgctggaaacaccgattcagcattaatcaccttggaggatccgatggacgcggaggggtccagtaagcccgaagagttgccggagttttcttgtgggagccctctcaccctcaagcagaaaagggacctattacaaaagagctttgcccttccagagatgtccctggacgatcacccagacccaggcaccgagggcgaaaagcctggagagttaatgccatcctccggggctaaaaccgttctgctgaaggttcccgaagatgctgagaatcccacagagagtgaaaagccagacacgagtgccgagtccgacaccgaacaaaaccctgagcggaaggtcgaagaggatggagccgaggagtcggagttcaaaatccagattgtgcctagacagcggaaacagagaaagatcgcagtgagcgccatccagagagagtacctcgatatttccttcaatatcctggataaattgggagagcagaaggaccccgatccttccacgaaaggcttgtccacactcgagatgccccgtgaaagcagtagcgctcctacactcgacgcgggagttccggaaaccagctcccattcaagcatcagtacacaatatagacagatgaaacgcggatccttgggagttctcacaatgtcccagcttatgaagcgccaactcgaacaccagagcagcgcgccacacaatatcagcaattgggataccgagcaaattcaacccggaaaacgccagtgtaatgtccccacctgccttaaccccgatctcgagggacagccactgaggatgcgaggggcaacaaaatccagtctgctgtcagctccaagtatcgtgtctatgttcgtgcctgcacccgaggagttcaccgatgagcagccgacagtcatgaccgataaatgccacgactgtggcgctattcttgaggagtatgacgaggagaccttaggcttggccatcgtggtgctgagcaccttcatccacctatctcccgacttggctgcaccgctacttcttgatatcatgcaatcggtgggaaggcttgccagctccaccacttttagcaaccaggccgagtccatgatggtgcccggaaatgctgcaggcgtggcgaaacagttcttacggtgcatatttcaccagctggcgccaaatgggatattccctcagctcttccaaagcacaattaaagatggtacttttctgaggaccctggcaagctcgctaatggacttcaacgagctgtcatcaatcgctgcactgagtcagctgctcgaaggtctcaacaataagaaaaacctccctgccggtggcgcaatgatccgctgtctggaaaacatcgccacattcatggaggctttacccatggattccccttctagtctgtggactaccatatccaatcaattccagacattcttcgcgaagttgccctgcgtgcttccactgaaatgtagcttggactcatccctgcgcattatgatttgtctccttaaaattccttcgaccaatgccacgcggtctctgcttgagccattcagtaagttactgtctttcgtcatccagaatgccgtgtttactcttgcatatctggttgaactgtgcgggctctgctatagagctttcacaaaagagcgcgataagttttatctcagtagatcggtagttttggaactcctgcaagccctgaagctgaaaagccccctgcccgacacaaatctcctacttctggtgcagttcatttgcgcggacgccggaacgaaactggctgaatctaccatcctgagcaagcagatgattgcctccgttccaggctgtgggaccgccgctatggaatgcgtccgccagtacatcaacgaggttttggactttatggcggatatgcacacactcaccaagctcaagtcacacatgaaaacttgttcacagccgttgcacgaggatacctttggaggacatctgaaagtggggctggctcagatcgcggctatggacatttcgcgtgggaatcaccgagacaataaagcggttattcgttacttgccatggctctatcaccctccttccgccatgcaacaaggacccaaagagttcatagagtgtgtgagccacattcgcctcctctcatggcttctactgggcagtctcacgcataatgctgtttgccccaacgcctcttctccatgtttaccgatcccgcttgacgcagggtcccatgtggcagaccacctgatcgtaattctcattgggtttccagagcagagcaaaacttccgtgttgcacatgtgttcactgtttcacgcattcatctttgcacaactgtggacagtctattgtgagcagagcgccgttgccaccaaccttcagaaccagaacgaattctctttcacagcaattctaacagctctcgagttttggtctagagtgactccgtcaatcctgcagctgatggctcacaacaaggtgatggtagagatggtttgcctacatgtgatttcactgatggaggcgcttcaggaatgcaacagtaccatatttgtcaagctaatcccaatgtggctgcccatgattcagtcgaacatcaaacatctcagcgcaggactgcaactgcgacttcaggccatccagaatcacgtgaaccaccactccctccggacactcccagggtctggacaatcatcagccggtctggccgctcttaggaagtggctgcagtgtacccagtttaagatggctcaggtcgaaattcagtcttcggaagctgctagccagttctacccactgtaa

SEQ ID NO: 60689 - DNA, 7907 bp, Artificial Sequence
  Description of Artificial Sequence: Synthetic coding sequence
atgagtacaaaagccgagcaattcgcatctaagatccgctatcttcaggaatatcacaacagagtcctgcacaatatttatcccgtgccatcagggacagacatagcgaatacccttaagtacttctcacagaccctgctaagcattttgtctcggacgggcaaaaaggagaatcaggatgcctctaatcttaccgtgcccatgacaatgtgtttattccctgtgccattccccctaacgccttccctccggccacaggtgtcttccattaatcccactgtaactcgtagtttgctttactccgtcttgcgcgatgccccaagcgagagaggaccccaaagccgggacgcacagctgagtgactatccctcccttgattaccaggggctttacgtcacgttggtgacccttctggacctggtcccactgttgcagcacggccagcatgacctgggtcagtctattttttacacaacgacatgtcttctcccgttcctgaatgacgacattctttccacccttccctatacaatgattagcaccctggcaacatttccgccatttttgcataaagatataatagagtacttgagtacctcctttctaccgatggccattcttggaagctcccgacgagagggagtacctgcacatgttaatttgtcagccagcagtatgctgatgattgctatgcagtatacctcgaaccccgtctatcattgtcagctgctggagtgtcttatgaagtataagcaggaagtttggaaggaccttctgtacgtcattgcttacggtccatcccaggtcaagcccccagctgtccaaatgctctttcattattggcctaatttgaagccaccaggcgctatctccgagtatagaggactgcagtacacagcatggaaccccatccactgtcagcacatcgaatgccacaatgcgatcaacaaacctgccgtgaagatgtgcatcgacccgagcctgtccgtcgccctgggggataaaccgcctcctctgtatttgtgcgaggagtgctctgagagaatagcaggagaccactccgaatggttaatcgacgtgctgttaccccaggcagaaataagcgcaatctgtcagaaaaagaattgcagctcccacgtaagacgcgctgtagtgacctgctttagcgcgggttgttgtggacggcatgggaatagacccgtgagatactgcaagaggtgtcattccaaccaccactcaaatgaggtaggagctgcagcagagactcatctataccaaaccagcccacctcctattaacacacgtgaatgtggcgcagaggagcttgtgtgtgcagtggaagctgtcatctccctcttgaaagaggccgagtttcacgcagagcagagagagcacgaacttaacagaagacgccagctgggcctcagtagttctcaccattcactggacaacgcagacttcgacaacaaggacgatgacaaacatgaccagagactgctgtctcaatttgggatttggttcctggtgagcctctgcacaccttcggagaatacacccactgagtccttggcccgattggtggcaatggtgtttcagtggttccatagcaccgcctacatgatggacgatgaggtggggtcactcgtggagaagcttaagccgcaattcgtgacgaaatggcttaagaccgtctgtgatgtccgcttcgacgtgatggttatgtgccttctcccaaagccaatggagttcgcccgtgtgggcggttactgggacaaatcttgctccactgttactcagttgaaggagggactgaaccgaattttgtgcctcatcccatataacgttattaaccagtcggtgtgggaatgcattatgccagaatggttggaggcaattcgaaccgaagtcccggacaatcaactcaaggaattccgagaggtgctgtctaagatgttcgatattgagttatgcccattgccgtttagcatggaggagatgttcggctttatcagctgtagatttaccgggtaccccagctccgttcaggagcaggcactgctgtggctccatgtactgtcagaactggacatcatggtcccgctgcagctccttatttctatgttctcagacggagtgaactctgttaaggaacttgctaatcagagaaagagcagagtaagtgaacttgctggaaacctcgcctccagacgcgttagcgtggccagcgatccgggaaggagagtgcagcataatatgctgtccccattccatagcccatttcaatctccattccgctccccactccgttctcccttccgaagccctttcaagaactttggtcaccccggagggaggacgatagattttgattgcgaagatgacgaaatgaatctgaactgtttcattttgatgtttgacctgctgctaaaacagatggagcttcaggatgatggaataactatggggctggaacactcactgagcaaggacatcatttctataattaacaacgtttttcaggccccatggggaggctcccatacctgccagaaggacgaaaaagccattgagtgcaatctttgccagtcatcaatcctatgctaccagctggcgtgcgagttgctcgagaggctcgccccaaaagaagagtctcgcctggtggaacctacagactcgctggaagattcactgctgtcctctagaccggagttcatcataggacctgaaggggaggaagaggagaatcctgctagcaaacacggcgaaaaccccggaaactgcactgagcctgtagaacacgcagctgtgaagaacgataccgaacgtaagttctgttaccagcagctcccggtcacacttcgtttaatatatacaattttccaggagatggctaaatttgaagagcccgatatcctcttcaacatgcttaattgtcttaagattctctgcctccatggtgaatgtctgtatatcgccagaaaggatcacccccagtttttagcttatattcaagatcacatgttgatcgccagtttatggcgtgtcgtcaaaagcgagttttctcagctaagctctctggctgtccccctcctcttgcacgctctcagcctgccacatggagctgacatattttggactattattaatggaaacttcaactcaaaggattggaagatgcggtttgaggccgtggaaaaggtagcagtaatttgccggtttctagacatccactccgtgaccaaaaaccatctgctgaagtactcgctggcgcacgctttctgctgcttcctgacagccgtagaggatgtcaatcctgcggtggccacacgagcgggtcttctcctggataccataaagcgccctgcactgcagggcctctgcctttgtctggattttcagtttgatactgtcgtgaaagaccggccaaccatcctttccaaactgcttctgctgcattttcttaaacaggatattcctgccctctcgtgggaattctttgtgaacagattcgagacgctgtccttagaagctcagctgcacttagattgtaataaggagttcccatttcccacgacgatcactgcggtgcggacaaacgtggcaaatttgagtgacgcggctctgtggaaaatcaagcgggcacggttcgccaggaatcgccaaaagtctgtcaggtcattgcgggactcagttaaagggccagtggaaagtaagcgggctctgagcctgccagagactctcacttcaaaaatccgccagcagtctcccgaaaatgacaataccattaaggacttgctgcccgaggatgctggaatcgaccaccagactgttcatcaattgattaccgtgcttatgaagtttatggctaaggatgagagctctgccgaaagcgacatcagctctgctaaagcatttaatacagtgaaacggcatctttacgttctattaggctatgatcaacaagaaggctgttttatgattgcaccacagaagatgagattgagcacctgctttaatgcatttatcgctggcatagctcaggttatggactataatattaatctcggaaaacatctgctgcctctggtggtgcaggtgctcaagtactgttcttgcccacaactgcggcactactttcaacagccgcctaggtgcagtctctggagcctcaaacctcatatccgccagatgtggttgaaggcattgctcgtgatcctgtataagtacccctatagagactgcgacatcagcaaaattttgctccacttgatccacatcaccgtgaacactctgaatgctcaataccacagctgcaagccacatgcaaccgccggtcctctttacagtgataattccaatataagccgctattctgagaaagagaaaggggagatcgaacttgctgagtaccgggagaccggggctctgcaggacagtttattgcactgcgtcagagaggagtcaatccccaaaaaaaaactgagaagtttcaagcaaaagagcttggatatcgggaacgctgacagtctattgtttacacttgacgaacatcgcaggaaatcctgcatcgacaggtgcgatattgagaaaccccctacccaagcggcatatattgctcagcgcccaaacgacccaggaaggtcccgtcaaaattccgccacacgacccgataattcggaaatacctgagaatccggcaatggaaggatttcctgatgctagacggcctgtgatacctgaggtgcgtctgaattgcatggaaacattcgaagtgaaggtcgatagcccggtgaagccagccccaaaggaagacctggacctgatcgatctgtctagcgactcgaccagtgggcctgagaagcactctatcctatctacgtcagattcagacagcctggtctttgagcctctacccccactcagaattgtcgagtcggacgaggaggaagagactatgaatcagggcgacgatggtccttccgggaagaacgccgcatcttcaccttccgtgcccagccatccatctgtgctgtcgttgagcacagctccactagtgcaagtatccgtcgaagattgttctaaggacttttcatctaaagactccggcaataatcagtctgctggcaataccgattctgcccttataactttggaggaccctatggacgccgaaggttcatcaaagcctgaggagctgcctgagtttagctgcggtagcccgttgacattgaagcagaagcgggatctgttacagaagagtttcgctctgcccgagatgtccctcgatgatcaccccgacccaggtaccgagggtgagaaaccaggcgagctaatgccaagcagcggagcgaagacagtgctgctgaaggtgccagaggacgcagagaatcctacggagtccgagaagccggatacatccgcagaaagcgataccgagcagaatcctgaacgaaaggtagaggaagacggcgctgaggagtctgaattcaagatccagattgtgccacggcaacgcaaacagcgcaagattgccgtttccgccattcagcgggagtatttagatatttccttcaacattctggataaactcggggagcaaaaggaccctgaccccagcacaaaaggcctcagcacactcgagatgccccgagagagttctagtgcgccaaccctggacgcaggcgttcccgagactagctcacacagttctattagtacccagtacagacagatgaagcgtgggtctcttggtgtccttacaatgtctcagcttatgaagcggcagttggagcatcaatcttctgccccacataatataagcaattgggacaccgagcaaatccagcctgggaaacggcagtgtaacgtgcctacatgcttgaatcccgatcttgagggccaaccactgaggatgcgcggagcgacaaagagtagtcttttgagtgccccttcaatcgtctcaatgttcgtgcctgctcccgaagagtttacagacgaacagccgaccgtcatgactgataaatgtcatgactgtggggctatacttgaggaatatgatgaagaaaccctaggcctggctattgtggtcctgtccacatttatccacctgagccccgatctagccgcaccactcctcctggatatcatgcagagcgtcggtaggctggccagcagcaccacattctctaatcaggcggagtccatgatggtccctggcaacgcagcaggagtggccaagcagttccttcgctgcatcttccaccagttagcccctaatggaatcttcccgcagctgtttcagtccactatcaaagacgggacattcctgcgcaccctggcctccagcttgatggatttcaacgagttgtcctcaatcgccgcactgtctcaattgctggaagggttaaataataagaagaatttgccagctggaggtgcgatgattcgctgtttagaaaatatcgccacattcatggaggcactgccgatggatagcccctcctccctttggaccaccatttcaaaccagttccagacattctttgcaaaactaccttgcgtcctgccactaaagtgttctctggacagctctcttcgcataatgatctgcctgcttaagataccctctacaaacgccacaagaagtctgctcgaacctttcagcaaattgctcagctttgttatccaaaatgcagtctttaccctagcgtacttggtcgaactgtgtggactctgttacagggcattcaccaaggagcgggataaattctacctgagtcgttccgtggtactggagttgttgcaagccctgaaacttaaaagccccttgccagataccaacctgctgctgttggtgcagtttatttgtgcggacgccggtaccaaactcgcagaatccacaatcttgtctaaacaaatgattgcgagcgtacccggatgtggcactgccgcaatggagtgcgtgcgacagtacattaatgaggtactggatttcatggcggacatgcacactctcaccaaactgaagtctcacatgaagacttgctcacaaccgctacacgaggatacatttggcggacatctcaaagtgggattggctcaaattgcggctatggacatctcaaggggaaatcatagggataacaaagcggtcattagatatcttccctggttataccacccccctagcgccatgcagcaggggcctaaagaattcatcgagtgtgtgagccacattagactgctgagctggctgctgctcggctccctaacccataatgctgtctgtcccaatgcttcgtcaccctgtcttcccattccactggacgcaggatcccatgtcgccgatcatctgatagtcattttaatcggatttcctgaacaaagcaagacatccgtacttcacatgtgttccttgttccacgcttttatttttgcccagctgtggacagtatattgcgagcagagcgcggttgcgaccaacttgcagaaccaaaatgaattctcctttacagctatactaacagccttagagttttggtctagagtgacccccagcatactccaactgatggcccacaataaggttatggtggagatggtttgtcttcatgtgatctccttgatggaggcgctgcaggagtgtaattccaccatctttgtgaaattaatcccaatgtggctgcccatgatccagtctaatattaagcacctgagtgccggactccagctgcggctgcaggccatccagaaccacgtgaatcaccattcacttcgtacacttccaggcagcggccagtcaagcgctgggctcgcagcactgcgcaaatggcttcagtgcacccagttcaagatggctcaggtggaaattcaaagcagtgaggctgcgtcccagttttatcctctgta

SEQ ID NO: 60690 - DNA, 7973 bp, Artificial Sequence
  Description of Artificial Sequence: Synthetic coding sequence
atgaactcaaagagacacaaaatcgcaagcaaaattagatacctgcaggagtaccataaccgggtgttgcacaatatatatcctgtaccttcaggcactgacatcgccaacactttgaagtacttttcccagacgctgctgagtattctgagtcgcacagggaaaaaagagaatcaggacgcttccaacctcactgtgccgatgaccatgtgtcttttccctgtccctttcccgctaactccgagcctgagacctcaggtgtccagcatcaatccaactgttacccgttcactgctgtacagcgtacttagggacgctccctccgagagaggcccacagtcacgggatgcgcagctctctgattacccaagcctcgactaccaggggttgtacgtgacgctcgtcactctcctagacctcgttccgctgcttcagcacggacagcacgacctgggccagagtatcttctataccactacatgcctactcccatttctgaacgatgacattctgtctacactgccttacacaatgatctcaactctggccaccttcccacccttcctgcacaaagacatcatcgagtacttatcaactagcttcttgccaatggcaatcctgggcagttcccggagggagggtgtcccagcacatgtgaatctatcagccagtagcatgctgatgattgctatgcaatacacttccaatccagtatatcattgccagcttctggagtgtctgatgaagtataagcaggaggtgtggaaggatctcctttacgttattgcatacggcccatcccaagtgaaaccaccagccgtccagatgctctttcactattggcctaatctgaagcctcctggcgcaatttccgaatacaggggcctgcaatatacagcatggaaccccatccattgtcagcacatcgaatgccataatgccatcaacaagcccgcagtcaaaatgtgtatcgacccctcgctgagcgtggcacttggagataagccgcctccattatatctgtgcgaggagtgcagcgagcgaatcgctggagaccatagcgagtggctcattgatgtgctgctccctcaggcggagatttcggccatctgccagaagaagaactgctcatcccatgtgcgcagggccgtcgtgacatgtttctctgcgggatgttgtggtagacacggaaatcgaccagtgcgttactgcaagcgctgtcattctaatcaccattcgaacgaagtcggagccgcagctgaaacccatctgtatcagacaagtccccctcctattaacacgcgcgagtgcggtgctgaagagttagtgtgtgccgtggaggctgtgattagccttctcaaagaggccgagtttcacgctgagcagcgggagcacgagttaaatagacgcaggcagttaggactaagtagctcccaccacagcctggataatgccgactttgataacaaagatgatgacaaacacgatcagcggctgctcagtcaattcggtatctggttccttgtgagtctgtgtactccaagtgaaaatacacccactgagtcgctggctagactggtagcaatggtctttcagtggtttcattcaacggcttatatgatggatgacgaagtggggagcctggtcgagaagctgaaaccacaattcgtgaccaagtggcttaagactgtttgtgatgttcgctttgacgtgatggtaatgtgtctcctgccgaagcccatggagttcgcgagagtggggggatattgggataagtcctgttccactgtgacccagctgaaggaaggtctgaatcgaatcctgtgcctgattccctacaatgtgatcaaccaaagcgtctgggaatgcattatgcccgagtggctggaagctatacggacagaggtcccagacaatcaactcaaagagtttcgggaggtgcttagcaaaatgttcgatattgagctgtgtccgcttcctttcagtatggaggagatgtttggtttcatatcctgtcgttttactggataccccagctctgtgcaggagcaagcattactgtggctgcatgttctcagcgaactggatatcatggtccctctccagttactgattagtatgttctccgacggcgttaacagtgtcaaggagttggctaatcagcgaaaaagccgggtgtcggagctagcaggaaacctggccagcaggagggtgtctgtggcctccgatccgggaagaagagtgcaacataatatgctgtccccatttcattcgccctttcagagcccatttaggagtccactgcggtcacctttccggtccccctttaagaacttcggccatccaggcggtcgcacaattgattttgattgcgaggatgacgaaatgaacctgaattgctttattctcatgtttgatttgctactgaagcagatggagctccaagacgatggaatcacaatgggactcgaacactcactgtctaaagacattatctctattatcaataatgtatttcaggctccttgggggggatctcatacctgccagaaagatgagaaggccatagaatgtaatctgtgtcagtcgagtattctctgctaccagcttgcctgcgagttgctagagcggctggctccaaaggaagagtccaggctagtggaacccactgacagtttagaggactccttgctatcgtcccgaccggagttcattatcggcccagaaggagaggaggaagaaaatccagccagtaagcatggcgaaaaccctggcaattgcacggagccagttgaacacgccgcagtgaagaatgacaccgagcggaagttctgctatcagcaactacccgtgaccttgcgattgatctacaccatctttcaggagatggctaaatttgaagagcctgatattctctttaacatgctgaactgccttaaaatcctgtgcctccatggcgaatgcttgtacatcgccagaaaagaccacccgcagttcctggcatatatccaagatcacatgctcatcgccagtctttggagggtagtgaagtcagagttctcacagttgagctccctagccgtccctcttctgctgcatgctctctctcttcctcacggcgctgacatcttctggacgatcatcaacggcaatttcaacagtaaggattggaagatgagattcgaggcagtcgagaaagtcgccgtaatatgccggttcctcgacatacactccgtaaccaaaaatcacctgctaaagtacagcctggctcatgccttttgttgcttcttaactgccgtagaggatgttaatccggctgtggccacacgcgctggacttctgctggacacaattaagcggccagcattgcaggggctgtgtctgtgtcttgatttccaattcgatacagttgttaaagaccgccctaccatactttccaagctcctgctccttcattttcttaaacaggatatccccgctctgtcgtgggagttttttgtgaaccggtttgaaacactgtcactggaggcgcaacttcacctggactgcaacaaagaattcccttttccaacaacaataaccgctgtgcgcaccaacgtcgccaatctgtccgacgccgctctttggaaaattaagagagccaggtttgcccgaaacagacaaaaatcagttagatcactccgggacagcgttaagggacccgtggagtctaagagggccctgtcacttccagagacactcacttccaagatacctatgaggcttaccaggcacgaacagagcgctcctgctctgggaggcacaccggagcagacccccggacaacagagccctgaaaatgacaacaccattaaagacctgctgcccgaagacgcaggtattgatcaccagacagttcatcagttgattaccgtgctcatgaaattcatggctaaagatgagtccagcgccgaaagcgacatatcgtccgcaaaggctttcaacaccgtcaagagacacctttacgttctcctgggttatgaccagcaggagggctgcttcatgatcgcacctcagaagatgcgcctgagcacttgttttaatgcctttatagctggaatcgcccaggtgatggattacaacatcaacttgggcaagcatctgctgcccttggtggtgcaggtgctgaagtactgcagttgcccccagttaagacactactttcagcagccacctcgatgcagcctgtggtctctgaaaccccacataaggcaaatgtggcttaaagcgctcctcgtcatcctctacaaatacccttacagggattgcgacattagcaagattttactgcatttaatccacataacagtcaacaccttaaatgcacagtaccattcctgcaagccccacgcaacggcagggcctctgtactcagacaacagcaacattagtagatattccgaaaaagaaaagggggagatcgaactggcagagtaccgcgagaccggggcacttcaggactctctattgcactgtgtcagggaagagagcatcccaaaaaaaaaactgagatcctttaaacaaaaatctctggacatcggaaacgccgattctctgctattcaccttagacgaacaccgcaggaagtcttgcattgaccgatgcgacatcgaaaaacctcccacacaggctgcttacatcgcgcaacgacccaacgatcccggacgcagtagacaaaactcagctacccggccagataattccgagattccggagaaccccgctatggagggtttccctgacgcacgtaggcctgtgattccagaggttcgactgaactgcatggaaacctttgaagttaaggtagatagcccagttaagccagctcccaaggaggatctggacttgattgacctgtcgtccgacagtacctccgggcctgagaaacatagtattttaagtacaagcgactcggacagtctcgtgttcgaacctcttccacccctgcgcattgtggagtctgacgaggaggaagagactatgaaccaaggcgacgatgggccttccggaaagaatgctgcctcttcgccttcagtaccttctcatccttcagtgctgtctttgagcaccgctcctcttgtgcaggtgtcagtggaggattgctccaaggacttctcttccaaagatagcggcaataatcagagcgctgggaacacagatagcgcactcattactctcgaggatcccatggatgccgagggttccagtaaacctgaggaactgcctgagttcagctgtggaagtcccctgactctgaagcagaagcgagacctgctgcagaagtctttcgctctgccagaaatgtctctggatgatcaccctgaccccggtacagagggagagaagcctggtgaactgatgccctccagcggcgctaaaactgtactgctcaaagtgccggaagatgccgagaatcctaccgagtcagagaagcctgatacctctgccgagagcgacactgagcagaatcctgaaaggaaagtagaagaggacggagcagaggagagcgagttcaagattcagattgtgcctaggcagcgtaagcaacgcaagattgccgtgtccgcaattcagagagaatacctggatatctcctttaacattttggataagctgggggaacagaaggatccagatccatccacaaaaggcctgtcgacgctggaaatgccaagggaaagttcctcagctccgacactggatgcaggagtccccgagacttcttcacacagttctatctcaactcagtacagacagatgaagaggggctctctgggcgtattgaccatgtctcagttaatgaaaaggcagctggagcaccagtcttccgcgcctcacaacatctctaactgggacaccgagcagattcaacctgggaagagacaatgcaacgtaccgacttgtttgaacccagacttggagggtcagccactgcggatgcgaggcgctactaaatccagcctgcttagcgctccgagcatcgtgtccatgtttgtgcccgcaccagaggaatttacggatgagcagcctaccgtgatgactgataaatgtcatgactgtggcgctatcctcgaagagtacgatgaagaaacacttggtctcgcaattgtggtcctgtcaacctttattcatctctctcccgacttggctgctccgctcctgctggatataatgcagagcgtcgggagactggcctcctctacgacatttagcaatcaagctgagagcatgatggtgcctgggaatgctgctggagtggcaaagcaatttctgcgctgtatttttcaccaacttgccccaaatgggatattcccacagctgtttcagtcaactatcaaggacgggactttcctgcgtacccttgcttcctcattgatggactttaatgagcttagctcgatagctgcactgtcacagctcttggagggccttaataataaaaagaatctccctgcaggcggtgctatgattcgctgtctagagaatattgctacgtttatggaagctctccctatggatagcccctcatcattgtggacgacaattagtaatcaattccagacattttttgccaagctaccctgcgtgctgcccctgaaatgctcattggactcctcattgcggatcatgatttgcctgttgaaaattccatccacaaatgcaacacggtcgctgctcgagcccttttccaaacttctaagcttcgtaattcagaacgcagtgtttaccctggcctatctcgtggagctttgtggcctgtgctatcgcgcttttacgaaggaacgtgacaagttctatctaagcaggagtgtggtactggagctcttacaggcactgaagctgaaaagtcccctgcccgacacaaatcttctgctcctggtgcagtttatttgcgctgacgcgggaaccaaactcgcagagagcacaatactgagcaaacagatgatcgcaagcgtccccggatgcggcaccgcagccatggagtgtgttcggcagtacattaacgaggtgttagactttatggcagacatgcataccctgaccaagttgaagagccacatgaagacgtgtagtcagcctctccatgaagatactttcggcggacatctgaaggtcggcctggctcagattgcagcaatggatatcagtagagggaatcaccgggataacaaagccgtgattcgttacctgccttggctgtatcaccccccttccgcgatgcagcaggggcctaaagagttcattgaatgtgttagccatatcagactgttgagctggctgttactgggatccctgacacataacgcagtatgtccgaacgcaagctcaccgtgtctgccgatccctttagacgctggatcacatgtggccgaccacctaatcgtgatcctaattggattcccagagcagtctaaaaccagcgtgctgcatatgtgctcactcttccatgcgtttatcttcgcacagctttggacagtttattgtgagcagtcagcagtcgcaactaatctacaaaatcagaatgagtttagtttcacggccatcctgacagctctcgagttctggagtcgagtcactccctccatcctgcagttaatggcacacaataaagtgatggtcgaaatggtgtgcctgcacgtgatctctctgatggaggccctgcaggagtgcaactccacgatcttcgtgaaattgatccctatgtggctgcctatgattcagtctaatattaagcacctgtctgctggactccagcttcgacttcaagctattcagaaccatgtaaaccaccactccctgcgtaccctgccaggttcgggccagtcttcggccggactggccgctctgagaaagtggttgcagtgcacccaattcaagatggctcaggtggagatccagagcagcgaggccgcatctcagttttaccctctcta

SEQ ID NO: 60691 - DNA, 7973 bp, Artificial Sequence
  Description of Artificial Sequence: Synthetic coding sequence
atgtccaccaaggctgagcagtttgcaagcaaaattcgctacttacaggaataccacaacagagttctgcacaacatatatccggtcccctctgggactgacattgcaaacactctgaagtattttagtcagacgctcctaagtattttgagccgtactggcaagaaggagaatcaggatgccagtaacctgactgtccccatgaccatgtgcctgtttcctgttccgttcccgctgacacctagtctgagaccccaggtgagctccatcaaccccactgtgacccggtcactactgtactctgtgctccgggatgctccaagcgaaaggggaccccaatcccgggacgcccagctgtcagactaccccagcctggattaccaggggctgtacgttaccttggttacactgctggatcttgtgcccctgttgcagcacggccaacacgaccttggtcagtccattttctacaccaccacatgtctgctccctttcctaaacgacgacatcctctccactctgccgtatactatgatttctacattagccacgttccccccattccttcataaggacatcatcgaatacctttccacctcctttctgccaatggctatcctaggctccagcagaagagagggtgtcccagcacacgtgaatctgtcagctagctccatgctcatgattgcaatgcagtacacctcgaatccagtctatcattgccagcttttggagtgtttgatgaagtacaaacaggaggtctggaaagacttgctttacgtaattgcctacggtccgtcacaggttaaaccccctgccgtgcagatgctttttcactattggcctaatctgaagccgccaggggctattagtgagtacagaggcctccaatataccgcatggaatcctatacactgccagcacatcgaatgccacaatgcaattaataagcctgccgtgaaaatgtgtattgatccgtccttaagcgtggctttgggagacaagccaccacccctttacctgtgtgaagagtgtagcgagagaatcgccggagaccattcagagtggttaatcgacgtgctgctgccccaggcagaaatctctgccatttgccagaaaaaaaattgttcctcacatgtccggcgtgctgtcgtgacgtgtttttcagccggttgttgtggcagacacggcaacagacctgttagatactgtaaacggtgtcactcaaaccaccatagtaatgaagttggggctgccgctgaaacccatctgtatcagacatcaccacctccgattaacacccgggaatgcggagccgaggaactagtctgcgcggtggaagcggtcatttcactgctgaaggaagctgaattccacgcagaacagcgggagcacgagctgaaccggaggcgccagcttgggctgtctagcagtcatcatagtctggacaatgccgatttcgacaacaaggacgacgataagcatgatcagagacttctttcacagttcggcatttggttcctcgtctcgctgtgtaccccctccgaaaatacgcctactgagagcttggctaggttagttgccatggtgtttcagtggttccactcaaccgcctatatgatggacgatgaggtcggttccctcgtggagaagctcaagccccagtttgttacgaagtggcttaaaactgtttgtgacgtaagattcgacgtgatggttatgtgccttcttcctaaaccgatggagttcgctcgtgtcgggggatattgggacaagtcttgcagcactgtaactcagctgaaggaggggctcaataggatcctttgtctgatcccctataatgttatcaatcagagcgtatgggagtgtatcatgccagaatggctggaggctatacggactgaggtccctgacaaccagctgaaggaatttcgcgaggtgctgagcaagatgtttgacatcgaactgtgccccttgcctttctccatggaagagatgtttggatttatcagctgtcgatttacaggatacccatcttccgtgcaagagcaggctttattgtggcttcacgtgttgtctgagctcgacattatggttcctcttcaattactaatttcgatgttttccgatggggtcaactctgtaaaggagctggcaaaccaaaggaagtctcgggtcagtgagctggcaggcaatctggcttctcgacgggtcagcgtggcttcagatcccggacggagggtgcagcataacatgctctcacctttccactcccctttccagtcgccatttagatcccccctcagaagtcccttcagatcccctttcaagaatttcggtcacccgggtggtaggacgatagatttcgattgcgaggatgacgagatgaacctaaattgctttatcctaatgttcgacctgctcctgaagcaaatggagctgcaagacgacgggatcactatggggttggagcactccctgagcaaagacatcattagcattattaataacgtgtttcaggcaccctgggggggatcacatacttgtcagaaagacgagaaggcaatcgaatgcaacctttgtcagagcagcatcttgtgttaccagttagcctgtgagctgcttgaaaggctggccccaaaggaggaaagccgtcttgtggaacctacggattcactagaagattctctcctgtcatctcgccctgagtttataatcggcccagagggagaggaggaggaaaatcccgctagtaagcacggagagaaccctgggaattgcaccgagccagtcgagcatgcagcagtcaaaaacgacacagagcgtaaattctgttatcagcagcttcccgtcacactcaggcttatatacaccattttccaagagatggccaagttcgaggaaccggacatactctttaatatgttgaactgcttgaaaatcctgtgccttcatggcgaatgcttatacatcgctcgcaaggatcatcctcaattcctcgcatacattcaagatcatatgcttatcgcctctctttggagagtggtcaaatctgagtttagccagctatcatcgctggcagttccattgttactgcacgcattgagcctgccccacggcgcagatattttctggacaatcatcaacggaaacttcaactccaaggactggaaaatgagatttgaggctgtggaaaaggtcgcggttatttgtagattcctggacatccactcagtgaccaagaaccatctcctgaagtacagtcttgcacacgccttctgctgttttctgaccgccgtggaagacgttaaccccgctgtcgcaactagagctggtcttctgctcgacacaataaaacgtcctgccctccaagggctttgtttgtgtctcgactttcagttcgatactgttgtgaaggatcgacccaccatcctgtcaaagctgctgctgctgcactttctgaagcaggatatacccgctttaagttgggagttcttcgttaatcggttcgaaacactttcattagaggcccaactccacctggactgcaacaaagaattcccgttcccaactacaatcaccgcggtccggaccaacgtggcgaacctgtctgacgcagcactgtggaagataaagagggctcgctttgcgcgtaatcgccaaaaatctgttcggtctttaagggattctgtgaaaggccctgtcgagagtaaacgtgccctgagtctacccgaaaccctcacttcaaaaatccccatgagactcacgagacacgaacaatcagcacccgctctgggtgggacacccgaacagacccccggacagcagagcccggagaacgacaacaccatcaaggatttgctgccagaggacgcagggatcgaccatcagactgtccaccagctgattacagtgttgatgaagttcatggccaaggacgaaagctcagccgaatcggatatttctagcgctaaagcctttaatactgtaaaacgacacctatacgttctgctgggctatgatcagcaagagggctgcttcatgattgccccacaaaagatgcgcctgagtacctgctttaacgcgttcatcgccggtattgcccaggtcatggactataatattaatcttggaaaacatctgctgccattggtagtgcaggtgctgaagtattgtagttgccctcagctgaggcactacttccagcaaccccctcgttgttcactgtggtcactcaaaccccatatacgccagatgtggctgaaagccctcctggtgatcctgtacaaatatccataccgagattgtgacatatcaaagatactgctccacctgatccacatcaccgtgaatactctaaacgcacaataccactcttgtaaaccacatgccactgccggacccttgtacagcgataattccaatatcagccgatactcagagaaagagaagggcgagattgaactggcagagtatagagagacaggagccctccaggactctttgctgcactgcgtcagagaggagtccatccctaagaaaaagctccgctcattcaaacaaaaatctcttgacattggcaatgccgactctctgctttttactctcgacgagcaccgcagaaagtcatgcatcgaccggtgtgacatcgaaaagcctccgactcaggcagcatacattgcccaaagacctaacgacccgggtaggtcacgacagaattctgcgacacggcctgataacagcgagatcccggagaaccctgccatggaaggattccctgacgcacgccgacccgtgatccccgaagtgcgtttgaactgtatggaaaccttcgaagtgaaggtggactcaccagtaaagccggctccgaaggaggacctagatctgatcgatttaagctccgactccacaagtggccctgagaaacactcaatcctgtctacttcggattctgattctctcgtcttcgagcccttgcctccactgcggatcgtggaatcagatgaggaggaggagacgatgaaccagggtgacgacgggccaagtgggaaaaatgctgcctcatctccttccgtcccttcccacccttctgttttgagtttgagtacagcgcctttagtgcaggtgagcgtagaagattgttccaaagatttctcctctaaagatagcggaaacaaccagtccgccggtaataccgactctgcccttatcaccctcgaggatcccatggatgccgaaggctcctcaaaacccgaggagctgccagaattctcctgcggcagccctcttacgctcaagcagaagagggatcttttgcagaagtcattcgccctccctgaaatgtcgcttgacgatcacccagaccctggcacagaaggagagaaaccaggtgagctgatgccttcctccggggctaagactgtactcctgaaagttccagaggatgccgagaaccccactgagtctgaaaagcctgacacaagcgcagagtcagataccgaacagaaccccgagagaaaggtggaggaggacggcgcagaggaatctgaatttaaaatccaaatagtgccaagacagcgcaagcagcgcaagatcgctgtgtcagccatacagagagagtacctggatatttcctttaatatactcgataagctgggcgagcaaaaggatcccgatccttccacaaagggactatctaccctagagatgcctcgggagtcgtcatctgcccctacgttggacgctggtgttccagaaacgagttcccacagtagtatctcgacccaatatcgtcagatgaagcggggtagccttggcgtgctaacaatgtctcagctgatgaagcggcagctggagcatcagtctagtgcaccccacaacatctccaactgggacaccgaacagatccaacccggaaaaagacagtgcaatgtgcccacatgcctgaatcctgacctggagggacagcccctccgaatgcggggagccacaaaatcatcgctcctgagcgcaccttctatagtctcgatgttcgtcccggctcccgaggagttcaccgacgagcagcccacagtaatgacagataagtgtcatgactgcggagctatacttgaggagtacgacgaagagacactgggcttggccatcgtggttctgtctaccttcatccatttgagccctgacctggctgccccactgctgttggatattatgcagagcgtgggcagactcgccagctccacgactttctcgaatcaggccgaatcaatgatggtccccggaaacgccgctggagtcgccaaacagtttctgcgatgtatctttcaccagctagctcctaatggcatatttccccagttgttccagtccaccataaaagacgggacatttcttcgaaccctggcctcgagcctcatggactttaatgagcttagtagcatcgcggctttgtcccagttactggaaggacttaacaacaagaaaaacttgcctgccggaggggctatgatacgctgcctggagaatattgccacttttatggaagccctccctatggacagtccatcgagtctgtggacaacgatctccaatcagttccagacattctttgcaaaactgccttgcgtgttgcctcttaagtgctcgttggactcgtcattacgcattatgatatgtttgctgaagataccaagcacaaacgccacacgctccctgctggagcccttttcaaagctcctctcctttgtcatccagaacgctgtgttcacgctggcatacctcgtcgaactctgcggcctgtgttacagagcctttactaaggagagagacaagttttatttgagtagaagcgtggtgttagagcttctccaggccctgaagctaaagagccctcttccagatacgaatttgctcctgctggttcagttcatctgtgccgatgcaggaacaaagctggctgaaagcaccatcctgagtaaacaaatgattgcctctgtccctggctgtggaaccgccgctatggagtgcgtccgccaatacatcaatgaggtgctggactttatggccgatatgcacactctcaccaagctgaaatcccacatgaagacctgcagtcagcctttacacgaggacactttcgggggacacctgaaagtgggcctggcccagattgccgcaatggacatttcccggggaaatcatagagacaacaaagccgttattaggtacctcccctggctgtatcaccccccatcggctatgcaacaaggtcctaaggagtttatcgagtgtgtaagtcacatccggcttctgtcttggctgttgctgggcagcctgacacacaacgcagtttgtcccaacgctagcagcccctgtctccctattccattggacgccggttctcacgtggccgatcacttgattgtcatcctgataggattcccagaacagtctaagacatcagttcttcatatgtgctccctgtttcacgcctttattttcgctcagttatggaccgtctactgcgagcagtctgctgtcgctaccaatctgcaaaaccaaaatgaattcagctttaccgccattctgaccgccctggaattctggagtcgcgtgacgccttccatcctgcaacttatggcacacaataaagttatggtagagatggtgtgtctccatgtgatatccctaatggaagcactccaggaatgcaactcgacaatcttcgtgaaactgattcctatgtggctgccaatgatccagtccaacataaaacatctgagcgccggacttcagctgcgactacaggccatacagaaccacgtcaaccaccacagtctgagaaccttgcccggttccggccagagcagtgcaggcttagcagccctcagaaaatggctacagtgcacgcaatttaagatggctcaggtcgaaatccagtcatctgaagccgcatcccagttttaccccctgta

SEQ ID NO: 60692 - DNA, 399 bp, Artificial Sequence
  Description of Artificial Sequence: Synthetic coding sequence
atgagggaggggcaggaaatgggcccaacccccgtgccttctaaccctctgctgcatcggtcatttccctgctggcctcggggatggtctcatcccgtcccaacgcgggaattgctccttgaacctgcccagcctgccgatctcttacccccagcccctaccgctggtccatgcagcctcgcctcatggatgctttcccagccaggcaggggctctcaggtcaagacgggtggcacacctacagccacagcgcaagatgcagaggcgccattaccagattgcgatttgtgcctgtcccccgctcccgttgggacttggcagcccagggctaaagccggttgggcaggggacccaagaaacctgtcaggcaatacattctccccagggtgggaacagtag

SEQ ID NO: 60693 - DNA, 1803 bp, Artificial Sequence
  Description of Artificial Sequence: Synthetic coding sequence
atgtttacattatcgctgctctccaggggtcacggcaagctgggccaggataaacagaaactggaagtatattttgagccggaggattacctgaattggcgctcacccgaggactatgttcctgtgagtaaaccacaggataagaacaatgcgagccagcactcgtggtcgttgttcttacctaaaacattttcaacgagaaaaggcgcactgatactgtactcagagggattcgcgatcagcgcttggactccaaaagagagaagaaaagggccatactgcccaagaggaccctggcgcaaactggatttggagttacacacactgcaggatctaaaagaggccattctggcttatgggcgacagcagttgaacctccctatgggagatgccggaaagcgactggagagggagaaaaagagaaagaccacggtcttcctcccttcacattcggcttcttcagaaaagaaacacctgcattacctgtgtgataccgcactcaatcggcaagctcactacgacccgcagctgctgcagggcgagcaggacagggcgtggcaaccatacttacactttaggtcgcagctggaatcacaggcccagaggcagatacagccaggccatagcgccaagcgttacctgagagggctcctcaggacatggccccctgacgctatgtatcgactgtggtgtgccggatacataaaagattctgttctgctacaggattcacagctcaatgtccccaaaaagctccgacctcaacaagacctgagcggcgtcccgcctaagtatcatctgttgccggtgttcccatccttttggattcaacagggtaagagttttgaacagaggcaacagggcctggatgagggtgaggccggagccgcaggacacgtggatcaaggcccacttgctaaaaaccatggctcccagggtacgcgactgcccccaaggaggaaacagccttggcaggaagacgaaactcaggcagaggacactagtatcgagaaccatctgtgtctttacgcatcaaaagaatcttataatgagaagacccaacagacatcacgcaaggctttcggacatgggcgtattgaccattcctggttgccctccgacaagagccatattactttctgcgggggtgccttcccaaatcggaaagcagacctgtcagataagcagcggaatgtcaagctacacaaggcccgaagtagccatctcctgcaggttctgcccgcagagaggtccctgtttccccctgtggcttctgccactggaagccggattatcaccccaggggaggtcaagaaaaaaaaagcacccaaggctctcaagttgcctccaatatccgaggagccacccagggtcctcgagcctctgaagagccaattcaaagcaaatgagccaccaacagagttatttattctgccagtggaaatccattatcacactaagcaacctcctaaggaaaaggcgcatagaaggggggctcctcatccagagtccgaacccgagtcatccgaggaatccacacccgtgtggcgccctcctctgaaacatgcatcccttgagacaccttgggagctgacggtacatctgcctgttgacgcatctcgtgacaccctgagtccccagggctccagcagtctgccaccggcaagtttgggcaatctgacacttaagggaagcaaggcacggcacaccagagtgcatagccaaggtaaaggtgtctggaaaggtgatgacgacgctcctccccacgacgtggctccgcctctggacctgcttcccccatag

SEQ ID NO: 60694 - DNA, 360 bp, Artificial Sequence
  Description of Artificial Sequence: Synthetic coding sequence
atgtcaggctccccccaggcatcctatcctcagactcactcttttacgctcaagcatcaggaaatcagaactttctggaatctcaacatgcgaggactaggtggcgagggcggaacggaagaagagagtagcctggggcaggccggtggcaagctgaagactgcagcgtggccttcatgggtcgctgaagtgggggctgctggcgcattggcggacccagggggacagaagtctggcagtttcctgccaagtcaacagctacagtgtatccccggtcctggcctgtacgccggtgaggcctctaaagacccagtgctgcgcaaacttcccttccagtgtggacgaacacacaacccttag

SEQ ID NO: 60695 - DNA, 405 bp, Artificial Sequence
  Description of Artificial Sequence: Synthetic coding sequence
atgttggtggtaggggcagggccattgggcgctgcggcatggtcacagcggctggactggggaagatgccaactcaagttgctgggccagcacggccaggatgttctccacactaacctcggggaagaaaatgtatgtattgccggacccctgctgctcccatgtcccgattctcaaccttgccttactcccccacatcccgcacaggcacttgtgcagctgtgggtgccttgtccctgtctgtgtcccagagtcggcgcatctacagcttggctggaaggagatactcctgctttgccacagcacctcggtcctagcattacaacaacaggtcggtgggcgacccccaagaagattcccggactgactgtgccgcctgagaatatggactccatgtggggctag

SEQ ID NO: 60696 - DNA, 447 bp, Artificial Sequence
  Description of Artificial Sequence: Synthetic coding sequence
atggattgtgtgccaccaatccagtgcagctgttcaatggggggtcgctaccatcaccccgctggagaagctttttggacgggcgaaaggtgtgagcagttctgtcactgtcaggcatccacgcacgctgtgtgctgctccccttctagctgcggccctggccagcggtgcgaaacattgagaggtattttcggctgccatcctctgtccccaggaatttatcaggctactatgcactcacacgtcgcctcctttgataggaaaagcgtcgaattcccaggtacatgcgctagcgctttcactaagtcttgtgggtctagctcctctctgaggttgtttaaggtggaaattgggaaagagaaacaggtccagcagagccactgtgtccattttaaagacgtgggtagctgggatccgggactgtccgccgagcgggcacctacttag

SEQ ID NO: 60697 - DNA, 615 bp, Artificial Sequence
  Description of Artificial Sequence: Synthetic coding sequence
atgggacctcagcacgggacaggccctgatcccccacctctgtgtcattgcccacacaccgcgggaggcggtgctggaggcacaggtgcgccagctttcggattgcagggaatttgggtgcccctggccgtgggagacagaagaggaccctgtggacaaggcgcttcgatgggcgctcctggacagcccagacaggggggtcgtgggaagggacaagaagcatcggcgcagacccgctatggcggaaactctccacatgggagaggacagaacagattagaagggcctggagtccaggtttgctgtaacagagcacgtagagccagaggatgccctcaccccggtcagagacaccatgtggttttaagtcagtggtccgggtcaggactcgtgggtggtattgaggacactgcagaccttgctcctcctcctggagccggactgagtccactcgcccacagcaaaggcagggatcaacggggaggtggacttcatccgcctagccctcgttgctctcctcctccttatcatcccgttcagcgctgtccaagacgctgggaatcatgtgaaggtagaccacacctggcttgctccggttgccccgcttcttgctag

SEQ ID NO: 60698 - DNA, 543 bp, Artificial Sequence
  Description of Artificial Sequence: Synthetic coding sequence
atgcagcggggacctttatctccctcgccgtctgatgggctcggggctttggggactacatatcccggagttcatagaggacagtcaatggctgggctcagagtgcctgcctttaacgcgggtttgcgcgctataactccttccagagccgagacccagcatccggaaacaacatcctccgggatgcatagagaaccacttagctcaaccccgattgctcactgggagggggcacagagtcctggcgctcagagcgtgttagcaatgttggtgcataggacagctgcttataccttgcaggttttggaaccgaaaaaggatccgggtcgagaactgcctgccacgcccaggtcctgggctccagctcgacagccatcgcctctgcattctatccgccagaccatgccagccaagccctccctggtgaagcgcgagcggcgtaaccaggcattggcaagagaggcaccctggtttccacagagaacacaatggaaaacttctgagggaccaggatccagttctggtcgtagaggccgaagatag

SEQ ID NO: 60699 - DNA, 456 bp, Artificial Sequence
  Description of Artificial Sequence: Synthetic coding sequence
atgccatacgaaacaagaagttggatcaccctgctgcggacacagagacgcgaggaatgcggattgcattgcaccagcctcccatccctcgccagggacctgaagttccacaccaccgagccaaatacgtctcggccaagttcaaacgacttgaggaacagaaaactctgcctggcggctgacaaactgtcccagtgcccctgggacctccaggatgtatggaatgaggagcgccagctcagccaatgtgaattgtccggaggacctcagaagaatgttggacgcagggtattcccgatccgacaaaccgtccttcagcccaggcccccaaaacgctcgaatcccggactgctcttctctggaacagaatgtggatgtatcctcccctttctgtgttttctcagccgatatcttctcaccgtccacatgcggggtctcggcaaattgagcgtctag

SEQ ID NO: 60700 - DNA, 369 bp, Artificial Sequence
  Description of Artificial Sequence: Synthetic coding sequence
atgacctggctggacaaaggtgtgtggacccaagaagatgagaacagttgcagctttagcgagtccgattttcccggatgtcgcgaccagatcaacccctctatcccatcaatttggactgccgtgtccgggatgatgatctctctggaagtgaggtggtggattaaaggtaagcaggggtacgtcatcagcttagggcacgccttgtcccccaggcttgaatgcagcgggacctttagtgcccactgcatcctcgggctgcctgggggaagcagttatcctccggcatcagtgagccaggttgtgggaactacggccctttatcttgtcgaagaagcatgggctgaggctgggaagatgcggagctag

SEQ ID NO: 60701 - DNA, 660 bp, Artificial Sequence
  Description of Artificial Sequence: Synthetic coding sequence
atggccgctagaagcgtcgacgatatttcaatcaaactgctgcatgaaaagggcccagcaactgaccacggggtcaacgtgcttccctctacagtcccagggcgagaggaagggatgaccgacagaaagcactggttctcattcgggactcagccgaatgtccccggactgcaagaaccgctggactatcgggcagctaaccaggcttggcaggcagtgctggccgaggtgcccaggggaggcccaggctgtgcagcattgcgggatctgggccgatgtggcggaccagatgtgtcaacacggaggcagtggagaccactgccattctcttgccccttgagtcacacaacccagcctcctctgggcggacactgcaggggatcctctgccggaaggttccatggccgtgaccagactagccccggtaccgttcagcagttgccttcagctcacgttctgaagcccggatgcactcagcacggagatctctcacccggtcaagcaagcccacccccagcagccgcactgggaccgtcccccaaagcttggactcacactctaggtcgccctcaattatgggcaggtctcggctcacacaggtttggcgttcccggacccggaacacgcaatacccttgctgcctgctgtgtgcaggagtag

SEQ ID NO: 60702 - DNA, 471 bp, Artificial Sequence
  Description of Artificial Sequence: Synthetic coding sequence
atggcaacgccccctgcacccggagctggaaccgctgccccatccgcccctcggccacccccaccaaggcccagctggctgcgcctggatcctgcggctagaggtgctaggctccccttccccggttctccagggactacgaggcgggctcctcgcgagtctgcccctcttgcacctgccctgcggagcgatccgggtcagcccctggccgcttgtaacggacccccaggtgagcctagggcagatcccggagttagtacaaggtgcgctgcgacaatgatcccgcagggaaagctgacgggcggtcgaagctgcggatcgagaccaaggatgggacgcggagaacgcgctgaattgtccttcccagctgctgcgcctcgcttaaaaagaggcttgggcttttggtttttcttttgtggtaactcttcagtcgagattcttcttgcctgccatacaactcatcccttttag

SEQ ID NO: 60703 - DNA, 435 bp, Artificial Sequence
  Description of Artificial Sequence: Synthetic coding sequence
atgtctctaaagtctttgttctgtaactcagaggctaaggacaacaagtgttaccacacgtattccgaaagtagttggtctgaaactaagaaaatcgtgattgctaccaagattcatagtttccagactttttcatcctgctacagtgactgccatggaatactgggggtgttgctgcatcagctggagacgtctgttgcaggcggaaccttctgtttatcaatagcacacgcctggtgggcgagatttgcccattcgtcctggaaagccgctctgggaagttgttaccagcccggtttccacacatgccagggacaagccagattggggtctgttcggggagtctgggccagcgagcacggggtgcaaccacagcgcacaggtcgacatactgggtgttgcgggagggtaggaagctttagacattgttcatag

SEQ ID NO: 60704 - DNA, 750 bp, Artificial Sequence
  Description of Artificial Sequence: Synthetic coding sequence
atgcgtgtcaggtggctgcgcttctggctgctattttggttgctcctcggatttatcagtcatcaacctacaccagtgatcaatactcttgctgaccacagacaccgcgaaacagatttcggcggaagtccatggattatcatcatcattgtcttcttgggacgttacaaattcacaatcctattctgcactatctacctgtgcgttccattcttgaaaacaattttctggtcgcgcaacggccacgatcgaagcagggatgtgcagcaacgcgctaggaggtctaatcgcaggcgccaagagggcatcaagattggcctggaagatatttgcacgttgtggaaacaggctgaaaccaaagttcaagcaaaaattagaaaaatgaaagtcaccaagaaggtgaaccaccactataaaattaacggaaagcgcaagaccgctaaagagcagaaaatgttccaaagggctcaagagctaaggtggagagccgaagactaccacaagtgcaagatcactccatccgctagaaagccactgtgcaattgggtttcattgtttgtctttctggcctttggcagcctcccgggacaagacatggataccttcttttctcttcagttgtgtgctcaggctctgcagcgcgagatggctgagcgcaaggctgcatataaacaccattctcctatccctgtaggcaacagagtggtgcagaagcatcttcacccccaccctgtcgggccactgatctag

SEQ ID NO: 60705 - DNA, 402 bp, Artificial Sequence
  Description of Artificial Sequence: Synthetic coding sequence
atggcctgcgctattcaactcgccagtagcgaggcgagggatagagctaggccaagggacagaacattccttcagaagaggcagctcggggcaggggtttggcttctgggtgagagaacctctaatacaatgctgaactggaatggggaacggggtcatccgtgtcttgtgctcgtctttaagcgtaacatagaggctgacttcaagagttctttcagttctgagcatttctttttcatccccctcgacgattgtaactgtaaggaggaactcgctgtgatatccgacggacggaccatcgtgtgctatcaccattctgtcgacatttcgtatgaacacacaaagcaaacattaaatcagattctttgcatgatcatgaagaaacacatgtttaagtgctag

SEQ ID NO: 60706 - DNA, 1851 bp, Artificial Sequence
  Description of Artificial Sequence: Synthetic coding sequence
atgcctccactggaaacccagtcatcgctagccccaccttcactgcaaacaccacccgcatccttgaccacacctccactggagaatcttccaagcttagccccaccaccgctacagacggcgagcgcaccgttgactacaccacatctcgagaccccaccatgccccgctccctgccccctgcaggccccaccttctcccttaactacaccccctcctgagacaccttccagtatcgcgaccccgccaccacaggcgcctcccgcactggcatccccgcctctacaaggactgccaagccccccactgtctccgctggccaccccacctccccaggctccgcctgccttagctctgcccccactgcaggcccctcctagtcctcctgcatcgccccctctatcgcccctcgccaccccctccccccaggcacccaatgcgctggctgtgcacttgctgcaagccccattctcccctcccccttctcctcccgtgcaggccccattcagtccacccgcttcgcctcccgtctccccatcggcaaccccaccctcgcaggcacccccatcgcttgccgcaccgccactgcaggtacctccctccccgccagcatcacccccaatgtctcctagcgcaactccccctcctcaggcccctccccctctagctgcgccaccacttcaagtcccaccttccccaccagctagtccacccatgtctccctcagccacacctccgccaagggtaccaccgctgctcgccgctcctccgctgcaggtgccccctagcccacctgcaagtctgccaatgagcccgctggcgaagcctcccccacaggctccacctgcactggcgacgcctcccctgcaggccctcccatccccccctgccagctttcccggtcaggctccttttagtccatctgcaagtctgccaatgagtcccctggccacaccgccaccacaagctccccctgtattggcagccccattgcttcaggtgcccccttctcctccagctagccccacgttgcaagccccaaggagaccccctacgcctggccctgacacctcagtgagcggccctcggctgacgttggccctcgctcctgggccacctccgcctccatccagatcgccatctagtaccctgtccggacccgacctagctgggcactcctctagtgccacaagtacaccggaggagctgaggggatacgacagtggtcccgaaggcggagccgctgccagtccacctccggatgccgagctggctgcttgccacccagctgcctggagcaggggccctgcacccccactggccttccgaggggcacccggagctcccctcccttggccccctgccaccgggcctgggagtgcagatgggctgtgtacaatctacgagaccgagggtcccgagagcgcaacccccgctcccggtgcactagaccccggaccctcgcctggtacttccggcggtaaagccgctgcaggggcaggggcaggagcctctagccgatctcctaagcaggctagattaggtgagctaccgttgggggcactgcaggcttcagtggtgcagcacctcctcagcaggaccctgctcctcgcagcggctgaaggcgctgccggaggctctggcggtgggccaggcggtgctgagggaggcggtgtgacaggaggagcccgtgccgctctctcagacgccgaattaggccgatgggcagagctgttgtcccctttggacgaaagtcgggcatctatcacatcggtgacttctttctccccagatgatgtcgctagtccccagggtgactggaccgttgtggaagttgagactttccattag

SEQ ID NO: 60707 - DNA, 549 bp, Artificial Sequence
  Description of Artificial Sequence: Synthetic coding sequence
atgttctgctgcctcgggtacgagtggctttccggcggatgtaaaacctggcactccgcctgggttatcaacactctggccgaccaccggcatcgcggaacagacttcggagggtcaccttggttacttatcattactgtctttctgcgatcctacaagttcgcaatctcactgtgcacttcatacttgtgcgtatcatttctgaaaacgatattcccctcccaaaatggccacgatgggtccaccgacgtccagcagagagccaggaggagtaacaggcggaggcaggaaggtattaagattgtgctggaggatatttttactctttggcgccaggtggagacgaaagtgagagcgaaaatttgcaaaatgaaggtcaccacaaaagtgaacagacatgataaaatcaatgggaagagaaagaccgccaaggagcacttgcgaaagctatctatgaaagagagagagcatggcgagaaggagagacaggtgtctgaggccgaggaaaatggaaagcttgatatgaaggaaatccacacctacatgtag

SEQ ID NO: 60708 - DNA, 1224 bp, Artificial Sequence
  Description of Artificial Sequence: Synthetic coding sequence
atgtataacgcgttctggaatcatctgaaagaacaactgctgtctactcccccagattttacttgcgcactggaacttctgaaggacgtaaaagagaacaggctgaggaatgaaattgaagaggccctcgacacggacctactgaagcaggaagccgagcacggggcactggacgtgccccacttatcaaactatatcctgaaccttatggcgctgctttgcgccccagtgagagatgaggcgatccaaaaattggaaaccatcagggatccggtgcagctactgcgcggaatcctgagggtgttgggattgatgaaaatggatatggtgaactacaccatacagtctttccgtccctacttacaggagcactccatccaatatgagcaggcaaaatttcaggaattgcttgataaacagccttctctcctggactatactacgaagtggcttacaaaagcagcaacagatatcacaacgctttgcccctccagccccgacagcccctcatcatcatgttccatggcctgctccttgcccagtggggcaggaaataacagcgagcctccctctcctacaatggtgctgtaccagggatacctgaacctccttctgtgggatctggagaatgtggagttcccagagaccttactgatggaccggatcaggctacaagagctcgcgttccagctgcaccagctgacagtgctagcctctgtcctgctggtggctcgaagcttttccggcgaggtactctttcggtctcctgaattcgtggacaggctgaagtgtaccaccaaagcactgaccgaagagttcattagccgcccagaagagacaatgctgagcgtttctgagcaggtttctcaagaggtccaccaagggttgaaggacatgggcttgacgaccctgtccagcgagaatacagcgagccttctcggtcagttgcagaatatcaccaagaaagagaattgcattcgttccattgttgaccagtggattaggtttttcctgaaatgttgtctgctgcacggaatgcaagagtcattgctgcacttccctggagggcttatccttatcgaaaaagagttggccgaactcggatggaagttccttaatctgatgcatcacaaccaacaggtgttcggcccatattacgctgagatcctcaagcatatcattcacccggctcaggcccaagagacagatgttgagcctaactag

SEQ ID NO: 60709 - DNA, 432 bp, Artificial Sequence
  Description of Artificial Sequence: Synthetic coding sequence
atgctgcgaaaaacctgcggcggtcagcaagaggattcacgaggtatgggccctcacctacccagggtgcctgacggagttgtactcggagtggaggaacccgagggtaaagcacaagggcgagtgcggggagaactatgtccaggagccctagcacggatccacatgggtcactcttgtacgaggctgtctgcggagggaattgccatgctcctgggaaccgccggtccaagcaggctccccgctgccccagatgcctcacaggctcctttacgatccccttgggcactgtccgtggctgctgccctgtgcagcccggtgagctgtcatccctgcggccgtcatgttgtgacttttggccattgccccgcacaaggcccttggggtcttggcacgttcggtcactccttttttgggtgtttatgtaaatag

SEQ ID NO: 60710 - DNA, 486 bp, Artificial Sequence
  Description of Artificial Sequence: Synthetic coding sequence
atgggacatcggccaaacctggggcagcccccacaccccaacgcagtcgccgctgccctacacgcaagcctctgtcctgcgaactgggggacatgtccactgggaaagccaggctatcctggctgcctctggttccagccactcttgctctttcccggttgtctgtgctcgcccgacggcccatttcccagggcagtgttcaccagtgccggaaagggaccccttcaaaccgacctcggaagggggagagtgcctccgagggaccagcagactcccaaatcgagaccctgtccccgtgccccagttgcttcgaatcggcagtccggtgggtctgccgtgagtgcccctctcagtggcgctcggcgtgcatggaaatccgccttcgctgcaccacctagatctagactgcgcccacagaaaggggtgccctggacggagaagcgagccaggggaggcggtcgtgcaggcccatgcagacggacctag

SEQ ID NO: 60711 - DNA, 690 bp, Artificial Sequence
  Description of Artificial Sequence: Synthetic coding sequence
atggctgcggctccagatgtcgggaacgggggatccaaaaacgttagaaagcccaggcccggaaagtgtcaaccgaagtcccgccactcccttccgcagacccagaaacccgaggaggttcgaaagtgcgggggtatttgcctacccgtctgtctgcaagatccaggggcttgtccgtcctggttacctctggaggaggggcttcgcagaccagcctttggccatcgcacagaagccggaccaagagggaagggctttggcaggcaccgcggaaacagtggtctgcgtgctgcggaggttacccatggtccctgctgggaggcagcagacgttccatgtctgcgtcttacaaaaccccatgggctcagagttacagccggttgttcggagtggagacggaatgtggtcgccaggcaggttccagaggcctctgccgaattgtgtagcagaaaccagccatgggcggctgcaactcccggatctcttcatccaagtccgcaaccaggtgtgctcgagggcactcccaccaatcttaaccggactttgccctccgggatacgcggttctcagcctctgccgcagggccagcctccattgcccggtcggagcagctgggagaccaagaccagagaacctattcctcccccagtgcgcctggaggccagggaagttggaggcgtcagtctttag

SEQ ID NO: 60712 - DNA, 480 bp, Artificial Sequence
  Description of Artificial Sequence: Synthetic coding sequence
atggatgtcgtagaagtggccggtagctggtgggcgcaagagcgcgaggatatcatcatgaaatatgagaagggacatcgtgcaggcctcccagaagacaaggggcctaagcccttcggatcatataacaataacatcgaccattttgggatgcaacatgaaacggagttgcctcctttgactgcacgggaggtgaaacaaattcggcgtgagatcagcaggaagtcgaagtgggttaagatgcttggtgaatgggacacctataagaactcccgtaagctgattgatcgggcataccagggcatacccatgaacatacggggtcctatgtggagcgtgcttctgaacattgaagaaattaagttgaagaatcccggaaggtatcagattatgaaggagaaagggaagagatccagcgagcacatccagcagatggatttggacgccgctggaaccacgctgcatccccctggggtatag

SEQ ID NO: 60713 - DNA, 462 bp, Artificial Sequence
  Description of Artificial Sequence: Synthetic coding sequence
atggcagccgtcgaacacaggcacagctctgggctcccttattggccatatttgaccgccgagactttgaaaaacaggatgggccatcagccacctcccccaacccaacagcatagcattatagacaattcattgtcactgaaaaccccaagcgagtgcgtgctgtatccactgccaccctccgctgacgataacctgaagacaccgcctgagtgcctgctcacaccactccctcccagtgctcttccatccgctgacgataacttgaagactccggctgaatgcctgctttacccgctgccacccagcgccgacgacaacttgaaaactcctcctgaatgcctgctgactccgctcccacctagcgccccaccctcagcggatgacaatctaaaaacaccccctgaatgcgtctgttccttacccttccacccacagcggatgataatcagccgtaattag

SEQ ID NO: 60714 - DNA, 1116 bp, Artificial Sequence
  Description of Artificial Sequence: Synthetic coding sequence
atgggaggccctgtgctcggccactggtggcattcaggcggtatgtccctcgccgtgccatctcttccacctcccggaaagtcatcggttttcctctttttgcaggagaagaaggcaaataacaaaaaacaaaaggctaaacgcgtgctcgaagtgcagctgcagacattgaacatccaaaaggaagaactgaacactgacctttatcacatgaagagatctctccgctattttgaggaaaaaagcaaagatctcgcggtcagactccagcactcactgcagaggaagggcgagcttgagagcgttctgtcagacgtcatggccacacagaagaaaaaagccaatcagctgtcatcaccatctaaggcgggaacagagtggaagcttgagcagtctatgagagaagaggctctccttaaagtgcaactaacacagctcaaagagtcattccaacaagtccagctggagagagatgagtactcagagcacttaaagggtgaacgagccagatggcaacagaggatgcgaaaaatgtctcaggaaatttgcaccctgaagaaggagaaacaacaggatatgcgcagggttgaaaaattggagaggagcctgtccaaactaaagaatcagatggcagagccgcttcctcctgagcctcctgccgtgcctagcgaagtggaactgcagcatctcaggaaggagcttgagcgagtggctggcgagttacaagctcaagtaaaaaacaaccaaagaatctccctgctcaatcagagacaggaagaacgcatccgtgagcaggaggagagactgagaaaacaggaggagcgtatccaggagcagcacaagagcctacagcagctggcgaaaccccaatccgtgttcgaggaaccaaataacgagaataaaagcacactccaacttgaacagcaagtgaaggaactgcaggagaaactgggagaggtgaaagaatcagagacctcaactccaagcaaaaaggggtgggaggctggatcctcactctggggtggggaagtgcctggccaaagacagcttcccgcttggggcctcgtgaccactgcacctcctagagccgtgctcttcctcgcttcatgtctgtag

SEQ ID NO: 60715 - DNA, 384 bp, Artificial Sequence
  Description of Artificial Sequence: Synthetic coding sequence
atggggaacctgtgtggctgtatacagggcgattccaagaagccttctaaaaaaagagtcaagaggaagccatatagcactacaaaggtcacctcgggctcaacgtttaacgagaacacgcgccgttatgccgtgcacacaaaccagtgtcggcgacctcacggctcacgggtgaaaaagaagcgatacccccaggaggatgacttccatcacaccgttttttctaacctggagcgcctagataagctacagcctaccctggaagcgtctgaagagagcctcgttcataaagataggggcgatggtgagcggcctgtgaatgttagggttgtgcaggttgctcctctacgaagggagtcaagggctatagacactggagaatag

SEQ ID NO: 60716 - DNA, 2265 bp, Artificial Sequence
  Description of Artificial Sequence: Synthetic coding sequence
atgaaggtcatcgtgattcatcgaaaaatgttccagagagcccaagaacttaggcggagggccgaggattaccataaatgcaagatacccccatcagccagaaaagctctttgcaattgggtccgcatggccgcagcagaacataggcattcctcaggacttccgtactggccttacttgactgctgagacactcaagaatcgaatgggccatcagccccctcctcctacacagcaacattcaattaccgataattcactttcacttaagacgccaccagagtgcgtgctaaccccgctccccccttctgccgacgacaatcttaaaacccctcctgaatgcgttctcacaccgttgcccccatccgctgatgacaatctgaagaccccgcctgaatgtctgctgacgcccctgcctccgtccgctgatgataatctgaagacccctcctgagtgcttgttaacgccactgcctccatctgcggatgataaccttaagacaccccctgagtgtctgttaactccattaccaccctcggcccctcctagcgcccctccaagcgccgatgacaacctcaaaacaagggccgaatgcctcttacatccgttgcccccttctgcagacgacaacctcaagacaccatccgaacgccagctgacccctttaccaccaagtgccccaccaagcgccgatgataacattaagacacctgcagaaaggctgcgcggacccctcccgccatccgccgatgataatctaaaaactccatcagaaagacaacttaccccgctgcctccctctgcacctccttccgcagatgataatatcaagaccccggctttccaccctcagaggatgatcatatcacgccacctgcccagtgtctcgtcacttccatttcacccgcagctgcacagtcaacaaatgattattagccgctacttactgtccgtttgcggctttagattccaccaccagccaatgatcattagcaggcacttgccgtctgtaagctctctgcctttccacccccagctccaccctcagcagatgatcatcagccgtcatctgcctagcgtgtgtggaggacgatttcatccacagcgcatgatcatcagtaggcacttgccatcagttagcagccttccatttcacccccagttacacccgcagcaaatgattatatcccggcacctgccatctgtgtgcggtggccgtttccacccgcagcgcatgatcattagccggcatttgccctcagttagctccctgccatttcacccccaactccatccccaacagatgatcatctcacgtcatctgccatctgtgtgcgggggacgctttcaccctcagcgaatgattatcagtaggcacctcccgagcgtcagtagtctgccattccaccctcagctacatcctcaacagatgataatcagcagacacctgcccagcgtgtgcggagaaagattgagaggcccattgccgccaagtgccgatgacaacctgaaaactcctagcgagaggcagcttaccccactccccccaagcgcgccaccgtctgccgatgataatatcaaaaccccagccgaacgactgcggggtccgctgccacccagtgcagatgataacctgaaaaccccatctgagcgccagctgactcctttgcctcccagtgcccctccatcagcggacgacaacatcaagacacctgccgagaggcttcgcggacctctgcctcccagcgcggatgacaaccttaaaactccttctgagagacaactgacccctctgcctccaagtgcacccccttctgcagatgacaacattaaaacgcctgcggaaagactgcggggacctctgccacctagcgccgatgataaccttaaaactccccctctcgctactcaagaagcagaagcagagaaacctcggaaacccaaaagacagcgggcagccgagatggagccaccacctgagcccaagcgcagacgcgtaggcgatgtggagccgtcaagaaagcccaaacgcaggagggcagctgacgtcgagccttccagcccagagccaaagaggcggagagttggcgacgtggaacccagtcggaaacccaagcggaggagagccgcagatgtggagccatcaagcccggaaccaaagagacgtagggttggcgatgtcgaaccaagcaggaaacctaaacgaaggcgcgcagccgacgtggagccgtccctgccagaaccaaagcgaagacgcctatcatag

SEQ ID NO: 60717 - DNA, 810 bp, Artificial Sequence
  Description of Artificial Sequence: Synthetic coding sequence
atggacgagattgaaaaataccaggaagtcgaggaggatcaggacccgagttgcccgaggcttagtcgggaattgctggatgagaaggaaccagaggtgctgcaagactcactcgataggtgctactctacaccctccgggtatctggagctcccagaccttggacagccatatagctctgcagtgtacagtctcgaagagcaatatctgggactagcactggatgtggaccgcacaaaaaaggatcaagaggaggaagaggatcagggaccaccctgtccacggctctcaagggagttactggaagtggtagagccggaggtgctgcaagacagcctggaccgctgttattcaactccctcttcttgcctggagcagcccgactcttgtcaaccttacggatcaagtttctacgcactggaggagaaacatgtcggctttagtcttgatgtgggtgagatcgaaaagaaagggaagggcaagaaacgtcgtggcagaagatcaaagaaggaacgacggcgaggacgaaaggagggagaggaggatcagaatccgccatgccctcggctgagcagagaactgctggatgaaaaagagcccgaggtattacaggattcactggaccgctgctactccacaccctctgggtatctcgagttacctgatcttgggcaaccttacagttcagcagtttactctctagaggagcagtacttagggctggcccttgatgtggactcagagtacctgaccgtcaaagtgatatcgctccacctagtgttccagatcggagtcatttttcttcaatag

SEQ ID NO: 60718 - DNA, 570 bp, Artificial Sequence
  Description of Artificial Sequence: Synthetic coding sequence
atggtacaggggtcgagccgcaccgcgcgaccgctgcctgctccagcctgcgggttgtctccaggcccagactgtaacgcttcttggcaggatagggccgctgacttttgtccagtcagggccgtctgtaaagtaggaccttgtccctgctgccagctgaaaactgacccacgtcttggtaaaagaacgggccttgatctgttcagcgtgtggtccagaagtgcgatgctcgcacccgctgggagtgtgctggcaatgcctacgctgcggccaccaaggaattccgttggggattctggggcatgctgcttgcgcacaactggtctggatataagtaaggtcctaccagaatcctttctgtcttgccctctcctggagctgccctggcacttgtcctcctgggttctgaaccccggtctgcctactttaagaacccctcacgcctcttactcttgtttcgcagcccaagctcgatcgccggaaagagccgctgggggtgcctggcccttaacaggaaagccatggcccaggaccggaatactatcgccaagccactcggagattctttag

SEQ ID NO: 60719 - DNA, 684 bp, Artificial Sequence
  Description of Artificial Sequence: Synthetic coding sequence
atgagtcaccacacccgcacgttgggcgtcgtgctgagcccccagcagggagcccctgctggaccaggcggaggcttaggaaccccctatcactcccatccatgtaaacctcgacaggtacccgtaagcgaatcccagcctccaccccacaccatgcaggtggggaggtgggctggacttggagtgggacaagcggaagcgacttcagtccgcttgggtctgcatggtctggaggcagtgttcccctacctgggccatgatcttcagggacccgcagtcagtcatggcgatggccttgccggagtaggccgtgagctggccctgctcctgggaggaccggagcaaagaggcgctaagcatcgagccaaggtggtccagggacacttgattgactgtctgctcctatgccatcctgtggaagatcggagccgcggatgttgcttcaacgctacaaccaggcgagaggcggagggcctgtgcagggctcgggtgctacgggaaggagtaacttctaccctggcggtgctccaggccgatagttcattgggggtttcgtcaacccgccgaacagccgctggtggcgcagcccgagctgctgcccacgggcagtcctgccccagggcaactcctgcgaccaccccctcaccgggaagccctcgccagggtcggctgtctatggaatag

SEQ ID NO: 60720 - DNA, 1023 bp, Artificial Sequence
  Description of Artificial Sequence: Synthetic coding sequence
cccgtccccggtccaactagttccgctacaaacgtgagcatggtcgtgtcagccggtcccctgtcgtctgaaaaggccgagatgaacatccttgagattaatgagaaactccatccacagctcgcggagaagaagcagcaatttcggaacttaaaagagagatgcttcgttactcagctggccggttttcttgctaatcaacagaagaaatacaagtatgaggaatgtaaggaccttataaagagcatgctgcgtaacgagcggcagttcaaagaggaaaagctagccgagcagctgaagcaagctgaagagttaagacagtataaggtgttggtgcacgctcaggagagggagcttacacagctacgcgagaagttacgagaaggccgtgatgcctcacgttccctcaacgagcatctgcaggcccttctcacccctgacgaacctgacaaatcgcaagggcaggatctgcaggagcagcttgccgaggggtgccgtctagctcaacacctggttcagaaactcagtcctgaaaacgacaatgacgacgacgaagacgtgcaggtcgagctggccgagaaggttcagaaatcctcagcccctagagaaatgcagaaggctgaagaaaaggaggtaccagaggactctcaggaggagtgcgccatcacgtactctaatagccacgggccatatgatagcaatcagccccataggaagacaaagattactttcgaagaggataaagttgattctactttgatcgggtcaagttcccatgtcgagtgggaggatgccgtacatattattccagaaaatgaaagcgacgatgaagaagaggaagaaaaggggccagtgtcacccaggaacctgcaagagtcagaggaggaggaggttcctcaggaatcctgggacgaggggtactccacactttccattccgcctgagatgacctccgtgggatctagtgagaaaggaggcccaaggggtaaccggagccaggcccaacagggtgccgcaggctag

SEQ ID NO: 60721 - DNA, 11424 bp, Artificial Sequence
  Description of Artificial Sequence: Synthetic coding sequence
tgacccggtcccacttcctctgcaacaaacgtctctatggtggtgtcggcaggacctctgagctcggaaaaagcggagatgaatatcctggagattaacgaaaagctgcatccacagcttgccgagaaaaagcagcagtttcgaaacctgaaggagaggtgtttcgtgacgcaacttgcaggatttcttgcaaaccaacagaaaaaatataagtatgaagaatgtaaagacctcatcaagagcatgctgcgcaacgagagacagttcaaggaggaaaagctcgcagagcaactcaagcaggcagaggaactgaggcaatacaaggtactagtgcatgcccaggagcgggagctcacacaactccgggagaagctacgtgagggacgcgatgcctcccgcagcctaaatgagcatctgcaggcgttgctgacccctgacgaacctgacaaatcacaaggccaggacctccaggaacagctggcagagggttgtcggcttgcacagcatcttgttcagaaactttcgcctgagaatgacaacgacgatgatgaagacgttcaggtggaactcgcagaaaaagtgcaaaaaagcagcgcaccccgagaaatgcagaaagctgaggagaaggaggttccagaggactcacaggaagaatgcgccatcacatattccaattcccacgggccatacgactccaatcaaccccacagaaaaacaaaaatcacttttgaagaagacaaggtggattccaccctgatcggatcgtcctcacacgtggagtgggaggatgcagtgcacattatccccgaaaatgagtctgacgatgaggaggaagaggaaaaaggacccgtgagccccaggaacctgcaagagagcgaggaagaggaggttccacaggagagctgggacgagggctactctacactgagcattccaccagaaatgctcgcatcataccagtcctactcatccacgtttcacagcctagaggagcaacaggtgtgtatggcagtggatatagggaggcatagatgggatcaggttaaaaaggaggaccaggaggccacaggtcccagactgtcccgcgaactgcttgacgagaaggggccagaagtgcttcaggatagtctagatcgctgctattctaccccttcagggtgtcttgagctcactgacagctgtcagccctaccgttccgcattttacgtactggaacaacagagaatcggactcgccgtggacatggatgagattgagaaataccaagaggtggaggaagatcaggacccttcgtgccccagactgagccgggagctcctcgacgaaaaggagcctgaagttctacaggattccttggacaggtgttactcaacaccttccggctacctcgagctgcctgacctgggccagccttacagctcagctgtctactctctggaagagcaatacctgggtctggcgctcgacgtggataggaccaagaaggaccaggaggaggaggaggatcagggcccaccctgtccacggctgagccgcgagctgctggaagtcgtcgaacctgaggtactccaggacagccttgatcgttgctatagtacacccagcagctgtctggaacagccagactcttgtcagccgtacggatcatctttctacgccctggaagaaaaacatgtggggttcagtttggacgtcggcgagatcgagaagaaaggcaagggaaagaagaggagaggacggagaagcaaaaaagagaggaggcggggaaggaaggagggagaagaggaccagaaccctccatgtccacggctgagccgcgagttgctcgacgagaaggggccagaggttctgcaggactcactagaccggtgctacagcacaccatctgggtgcttggaactgacagacagctgtcaaccatacaggagcgcgttttacgtgcttgaacagcagagggtgggtctggccgttgacatggatgagatagaaaagtatcaggaggttgaggaagaccaggacccatcctgcccacgattatccagagaattgctggatgagaaagaacccgaggtgctccaggacagcctggatagatgttattccaccccctctggctatctcgaattgccagacttgggacagccctactcgtcagccgtttatagcctggaggagcagtatctgggccttgctctcgacgtggaccgaacaaaaaaggatcaggaagaagaagaggatcaggggcctccatgtcctaggctgtcgagggaattactggaagtggtggaaccagaagttctccaggactcactggatagatgctatagcacaccatcctcctgcctcgaacaacctgactcctgccaaccatatggttcttccttctatgcactagaggaaaagcatgtgggtttttccctagacgtcggcgagatcgagaagaaaggcaaagggaagaaaaggcgtggaagacggtcaaagaaggagagacgcagaggacgaaaggaaggggaggaagaccagaatcccccttgtccaaggttgtctagggaactgctggacgagaaggaacccgaggtgctgcaggatagcttggacagatgttactcaactccgtccggatatctcgagttaccggacctcgggcaaccttatagctcagccgtgtattccttggaagagcagtacctgggcctggctttagatgtggacgagattgagaaataccaagaggtcgaggaagatcaggatccctcatgtcctcgcctctccagagaattgttagacgaaaaggagcctgaggtgctacaagactccctcgataggtgctactccacaccctctggctacctagagctgccggatctaggccagccctactcgtcagccgtttacagtctggaggagcagtatttaggcctcgcacttgacgttgaccgcaccaagaaggaccaggaagaagaggaagaccaaggcccaccctgcccgagattaagtcgcgaattgctggaggttgttgaaccagaagtcctccaggactccctcgacaggtgctattcaaccccctccagttgcttggagcagccagatagttgccaaccctatgggtcaagtttctacgccctcgaagaaaagcatgtcggtttttccctggacgtgggagagattgaaaaaaagggaaaaggcaagaagaggcggggaaggaggagcaagaaagagcggagaaggggaaggaaggagggggaggaagatcagaatcctccctgccccaggctctccagagaacttctggacgaaaaagaaccagaggtcctgcaagattcattagaccgctgctactcaacaccgagcgggtatctggaactgcccgatttgggccaaccatactcttccgcagtctacagccttgaggaacaataccttggcctcgcactagacgtggacaggaccaaaaaagaccaagaggaggaagaagaccaggggcctccgtgcccacgattatcacgcgaattgcttgaggtggtggaacccgaggtactgcaggactctcttgatcgttgctactcaaccccatcttcatgtcttgaacagccggattcttgtcaaccgtatggaagctctttctacgcccttgaggagaaacatgttggcttctccttagacgttggagagatagaaaagaaaggaaagggcaaaaagagacgtgggagacgctctaaaaaagagcgccgtaggggcagaaaagagggtgaagaggaccaaaatcctccttgtccccgtcttagcagagaacttctggacgagaaggagcccgaagtcctgcaggacagcctcgatcgatgctatagtacacccagcggctacctggagctgcccgacttgggccaaccttacagcagcgcagtttactctctggaagaacagtacttagggctggcacttgatgtggacagaactaaaaaggaccaagaggaagaggaggaccagggtcctccctgcccaagacttagtcgggaactgctggaagtggtagaacccgaagtgcttcaggatagtctcgatcgctgctactccacgccatcctcctgtctggaacagcctgacagttgtcagccctatggctcatccttctacgccttggaggaaaagcacgtgggtttttccctcgacgttggggagatcgagaagaaaggcaagggaaagaagcgcaggggtaggcgctcaaagaaggaaagacgcagaggacggaaagaaggtgaagaggaccagaatccaccttgtcctcggctgtcacgcgaactgctggatgaaaaggaacctgaggtgctgcaggattctttagacaggtgttacagcacgccttccggctatctggagctgcctgatctcggccaaccatattcaagtgctgtttactctctggaggagcagtacctggggttagctctggatgtagaccggacgaaaaaggatcaggaggaggaggaggaccaaggcccaccctgcccaagacttagtagggaactgctggaagtcgtagaaccggaggtcttacaagacagcctggatcgctgctactctacaccctcctcatgtttggaacaacccgactcttgtcagccctacgggtcatccttctacgcactcgaagaaaagcacgtaggcttctccctcgatgtgggggagatcgagaaaaaaggaaaggggaagaagagaagaggtcgcaggtccaagaaggagaggcggaggggaagaaaagagggagaagaggatcagaacccgccttgtcctcgcttgagtcgggagctcttagatgagaaaggaccagaagtgctgcaggattccttggaccgctgttatagcacaccctcaggctgcctcgaactgacagacagctgtcaaccctacagaagtgccttctatgtcctggaacagcagcgggtcggtctggctgtggacatggacgagatcgagaagtaccaagaggtggaagaagaccaggatccttcatgccccaggctgagtagggagttgctggacgaaaaggagccggaagtcctgcaagattcattagacaggtgttattccaccccttctggttacctggagctgccagatttgggacaaccctattcatccgcagtctactcattggaagagcagtaccttggacttgcccttgatgtagaccgcacaaagaaagaccaggaggaagaggaggaccagggccctccatgccccagactgtccagagaactgctggaagtcgtggaaccggaggtcctccaagatagcctggaccggtgttacagcacaccaagcagctgccttgagcagcctgattcttgtcaaccatatgggagcagtttctacgcacttgaagagaaacacgtagggttctccctggatgtaggtgagattgaaaagaaagggaaagggaagaagcgacggggaaggcggtccaagaaagagcggagaaggggtcgaaaggagggagaagaagatcagaaccctccatgccctcggctgtccagggagctgctggacgaaaaaggacccgaggtgctacaggattcactcgacagatgttattcaacgccttcaggatgcctggaactgacagactcctgccagccttataggtctgcattttacgtgctggagcagcagcgcgtggggctggccgtagatatggatgaaattgagaagtaccaggaagttgaggaggaccaggacccctcctgcccgcgactgtctcgggaacttctcgatgagaaagagccagaggtcttacaggattctctggatcgctgctatagtacccccagtggctatctggagctgccggacttaggacagccctactcgtcggcagtgtatagcctggaggaacagtatctgggccttgcacttgatgtcgacagaaccaaaaaggatcaagaggaagaagaagaccaaggaccaccctgtcctcgcttgagcagagaattacttgaagttgtggaaccagaagtcttacaggactccctcgacaggtgttactcaacaccctcctcttgtcttgagcaacccgattcttgccaaccctacgggtcgtctttttacgcactcgaggagaagcacgtggggttttccttagacgtgggcgagatcgagaagaaaggtaaaggtaaaaaaaggaggggaagaagatctaagaaagagagaagacggggacggaaagagggagaagaggatcaaaaccctccttgtcctcgactttcgagagaattgctggatgaaaagggacccgaggtgctgcaagattccctggatcgttcttattccactccatccgggtgtttagaattgactgactcatgccagccttaccgctctgctttctatgtcctggagcagcagagagttggcctggccgtagatatggacgaaattgaaaaatatcaggaggtcgaggaagatcaggatccgtcctgtcccaggctgtctcgtgagttactggacgaaaaggaaccagaagttctgcaagactctctggaccggtgttactccacaccgtctgggtacctcgagttgcccgatcttggtcagccctatagttctgctgtctattcattggaggagcagtatttggggctcgctctggacgtggaccgcacgaagaaggaccaagaggaagaagaagaccaagggccaccatgcccccgactcagcagagagcttttagaggtcgttgaacctgaagtgctgcaagactccctggacagatgttactccaccccaagttcctgcctcgagcagcccgattcttgtcaaccctacggctcaagtttttatgctctggaagagaaacatgtaggcttctctctggatgtcggggagatcgaaaagaaggggaaaggcaaaaaaagacgcggaaggagatctaagaaagagcgacggagagggaggaaagagggagaggaggatcagaaccccccatgcccacggctctcacgggagcttctggacgaaaaaggccctgaggtcctccaagactctctcgaccggtgctactcaactccctccggctgcctggaactgacggactcatgtcaaccctataggtctgccttctacgtgctcgaacaacaacgagtgggattggctgtcgacatggacgaaatagagaaatatcaggaagtggaggaggatcaggacccaagctgccccaggcttagccgcgagctgctggacgagaaggaacctgaagtgcttcaggacagtcttgacaggtgttactccaccccgagcggctatctggaactgcccgacctgggacagccatatagctccgccgtgtattctcttgaggagcagtatctcggacttgccctggacgtggataggacaaagaaggaccaggaagaggaggaggaccaaggtcctccttgcccgcgtctaagtcgtgagctactggaggttgtggaacctgaggtgttgcaggattcgctggatcgatgctatagtaccccttcgagttgtttggagcagcccgactcatgtcagccctatggcagctcattctatgcactggaagagaagcatgtcggcttctcgttagacgttggagaaatcgagaagaaaggtaaaggcaaaaaaaggaggggcaggcgatcgaagaaggaacggcgacggggacgcaaagaaggtgaagaagaccaaaatccaccgtgtccaaggttgtcacgcgagttgctggacgaaaaggaaccagaggtgctccaggatagcctggacagatgctattcaacacccagtggctatctggaactacccgacctgggacagccctacagcagtgcagtttattctctcgaggagcaatatctaggccttgctctggacgtggaccgcactaaaaaggaccaggaagaggaagaggatcagggccctccctgcccacgattgagccgagaactactggaggtggtagagccggaggtgctgcaagacagtctcgataggtgttactctaccccctctagttgtctggagcagcccgattcatgccaaccttatggatcaagcttctacgctctcgaagagaaacatgtaggattctccctggacgttggagagatcgagaaaaaaggaaaagggaaaaaacggagagggcgtcgctcgaagaaggaacgccgacgcggtaggaaagaaggtgaggaggaccaaaacccaccatgcccaagactctcaagggagctgcttgatgaaaaaggccctgaggtgttacaggatagtctggaccgttgttattccaccccctctggctgcctggaactgactgactcctgccaaccgtacaggtctgccttctatgttctggaacagcagagagttgggctggccgtcgatatggatgaaatcgagaagtaccaggaagtggaggaagatcaggacccaagttgccctcgcttgtcgagagaattactggacgagaaagagccagaggtgctccaggattcactggacaggtgctatagtacaccctcaggctacctggagctgccagacctcggccagccctatagttccgcagtctactctcttgaggagcaatacctgggcctggcactggacgtcgacaggaccaaaaaagaccaggaggaagaggaagaccagggtccaccctgcccacgcctgagtagggaacttcttgaggtggtggagcctgaagtcctgcaggactccctggatcggtgctacagtaccccctcttcctgcctggagcagcccgactcatgccagccctatgggagctccttttatgccctcgaggaaaaacacgttggcttcagtctcgatgtcggcgagatcgagaagaaagggaagggaaagaagaggagaggacgcagatccaaaaaagagaggaggcgcggtcgcaaggagggggaggaggaccagaatcccccatgcccccgtctatctcgggaacttttggatgagaaagagccggaggtgttgcaggactccctggacagatgctattcaacaccatccggttacttagagctgcccgacctgggacagccttactcaagtgcagtgtatagtttggaagagcagtatctgggcctggctctggacgtggaccgaaccaagaaggaccaagaagaagaggaggaccaaggcccaccctgtccacgcctctcgcgggaactccttgaggtggtcgagccagaggtcctgcaagacagcctggacaggtgctatagcacaccctcttcttgcctcgaacaaccggacagttgtcagccttacggctccagcttttacgctctggaggagaagcatgttggcttcagtctggatgtgggtgagattgagaaaaaagggaaaggcaagaaaaggcgcggaagacgttctaagaaggagcgacgacgaggtagaaaagaaggcgaagaagaccagaatcctccatgcccacgtctgtctcgggaactgcttgatgaaaaagagcccgaggtgttgcaggactccctcgacagatgctactctactccttcagggtatctggaactgccagatttagggcagccctactcttcagccgtttattccttggaggagcagtacctcggtctggccctggatgtggatagaacgaagaaagatcaggaggaggaggaagatcaagggcctccatgtcccaggttatccagggaactgctggaagtcgtggagccagaggtgctgcaggattctttagatcgctgctatagcacaccctcatcgtgccttgaacagcctgactcatgccaaccctatggctctagcttctacgccttggaagagaagcacgtcggcttcagcctcgatgtaggcgagatagaaaaaaaggggaaggggaaaaagaggcgcggtcgcaggagcaagaaagagcgcaggcggggtcggaaggaaggagaagaggaccaaaatcccccttgcccacgcttatccagagaacttctagacgagaaagagcccgaagtgcttcaggattcgcttgatcgctgttatagcacccctagcggctacctggagctgcccgatctcggacagccctattcttcagccgtgtattccctggaggagcagtacctggggctcgctctggatgtggatcgaacgaagaaagaccaggaagaagaggaagatcagggtcctccctgcccgagactctcacgggaactcttagaagtagttgaacccgaggtacttcaggattctctggataggtgttattccacaccaagtagctgcctggagcagcctgactcctgtcagccctatggcagcagtttttacgcccttgaagaaaagcatgttggttttagtctagacgtcggagagattgaaaaaaagggcaaaggtaagaagaggcgcggacgacggagcaagaaggagcgaaggcggggtaggaaggagggagaggaggatcagaaccctccctgcccacggctgagcagggagcttctggatgaaaagggccctgaggtgctgcaagattccctggaccggagctatagcacaccctcaggatgcctggaactgactgactcctgccaaccataccggagtgccttttacgttctagagcagcagagggtgggtctcgccgtggacatggatgagattgagaaatatcaggaagtcgaggaggatcaggatccaagttgcccaaggctctcgcgcgagctcctggacgaaaaagaaccagaggtcttgcaagattctctggaccgttgttactcgaccccgtccgggtatcttgaactcccagatctgggccagccctactcctcagccgtgtatagtcttgaagaacaatacctgggtttggccctggacgttgaccggacaaagaaggaccaggaagaggaggaagatcaggggcctccttgtccccgtctgtctagggaactgctggaagtggtggaacctgaggtgctgcaggatagtctggatagatgctattccaccccttcttcttgcctggaacagcctgattcctgtcaaccgtacgggagttccttttatgcccttgaggaaaaacacgtgggattcagcttagacgtgggggagattgagaagaaaggcaagggcaagaagcgcaggggaagaagatcgaaaaaagaacgcaggcgaggcagaaaggagggtgaagaggaccaaaatcctccatgtccaaggttgagccgcgagcttctcgacgagaaagggccagaggtgctacaagactcactcgatcgatgttactctactcccagtgggtgtctcgagctcacagatagctgccagccatatagaagcgcattttacgtcctggagcaacagcgggtaggcttggccgtggatatggacggcgagtacctgtccatgaaggttattcggatccactac

SEQ ID NO: 60722 - DNA, 258 bp, Artificial Sequence
  Description of Artificial Sequence: Synthetic coding sequence
gagatgcagaaggcagaagaaaaggaggttccagaggattcgcaggaagagtgtgcgattacctactcgaattctcacgggccttacgatagtaaccaaccacaccggaaaacaaaaattaccttcgaggaagataaggtagatagcacccttataggctcttcatcccatgtggaatgggaggatgctgtccacattatccctgaaaatgaaagcgatgacgaggaggaagaagagaagggccctgtgagcccctag

SEQ ID NO: 60723 - DNA, 753 bp, Artificial Sequence
  Description of Artificial Sequence: Synthetic coding sequence
gaaatcgagaaatatcaggaggttgaggaggatcaggatccttcctgcccacggctctctagggaacttctggatgagaaagaacctgaggtgttacaggatagtctcgacagatgctacagcacccccagcggatacctggagctgccggacctgggccagccgtattcaagtgctgtttactccctggaggagcaataccttggactggcacttgacgtagatcgcacaaagaaagaccaggaggaggaagaggatcaagggccaccttgtcccagattgtctagagaactgctcgaagtggttgaacctgaagtgttacaggacagtcttgaccggtgctacagtactccctcaagctgccttgaacagcctgatagttgtcagccctacggcagctccttttacgcactggaagaaaaacacgtgggcttttcattagacgtcggagagattgagaaaaaaggcaaggggaagaagcgcaggggtcggaggtctaagaaggagagaagacgcggtcgcaaagagggggaagaagatcagaaccctccatgtcctcgactgtcccgggaattgctagatgagaagggtccagaggtgttgcaggattccttggatcggtgttatagtaccccctctggatgtctcgagctcaccgactcttgccagccatacaggtcagccttctacgtactggagcaacagcgggtcggtctggccgtcgacatggacggagagtaccttagtatgtag

SEQ ID NO: 60724 - DNA, 300 bp, Artificial Sequence
  Description of Artificial Sequence: Synthetic coding sequence
atgagacctaagaccctaagaaattctgctgcacgtagcaggaaagagcccggtttcctgaatcatcacatggaaggtagctgtctccaattaggcgagttaagtagcgtaggctactggatggagtcccatagcgttacccaggccggagtacagtggtgttcttttgggtcattacagcccccaccgccacgttttaagccattttcatgtcttagtctgccatcatcatgggattatcggaggaagaaaggatcttggctcggctctaagcttgaatttcctatgctttgtggatag

SEQ ID NO: 60725 - DNA, 300 bp, Artificial Sequence
  Description of Artificial Sequence: Synthetic coding sequence
atgcgtccaaaaacactacgaaattcagctgctcggtctagaaaggaacccggattcctgaaccaccacatggaagggtcctgtcttcagctaggcgagcttagcagtgtaggctattggatggagagccattccgtgacccaggccggagtccagtggtgcagtttcgggtcattacagcctccaccgcctaggttcaagccctttagttgtctgagtctcccatcctcatgggactatcgccgaaaaaaggggtcgtggctcggtagcaagttagaattcccgatgctgtgcggctag

SEQ ID NO: 60726 - DNA, 321 bp, Artificial Sequence
  Description of Artificial Sequence: Synthetic coding sequence
atgaggcccaagacactgcgcaatagcgcagctcgaagtaggaaggaaccagggttcttgaaccaccatatggaaggaagctgcctgcagctcggggaactgtcctcggttggttactggtggccctttgggcaccccggacccgctcaggggcatctgcctgtcgctgtttgggcttcttgggtggtcgcgggaatcagcatagcactctatctgccacctcatccggagggacgctacgagggacccttcaaacgccacaccaagaccttcagatcagcgcagtgtgccgactgcttgacttgtgctctggagccatag

SEQ ID NO: 60727 - DNA, 453 bp, Artificial Sequence
  Description of Artificial Sequence: Synthetic coding sequence
atggagaacaatccaagccacaacccagtgtcccccagcccattcccaacccggatctctgcaccactgaacatgagccagtcgcacttccgagagaattggttgatgctgaagaaatctctggagggaaagctctgcccatcctcatgcgggagtctcaagtgtagggcttcccggtctccatccgtgggcacaggtcccagccttcccatcgaatgcttcctgtacatgaaaacctggtctagccttcaaatgaccgttgcctctgaagaggataagaggagagagaaaacacagaacgcaggactgcctctcttcttcgcttccacagtggggactgtcaccctgccctcttttcatcacctgcagttgcacactcatacacatactctggtcccacagtcactttttgggacctgtctcacagctcacctcgaaactagatggtcttag

SEQ ID NO: 60728 - DNA, 486 bp, Artificial Sequence
  Description of Artificial Sequence: Synthetic coding sequence
atggggcaccggccaaacctaggacagcctccccatccgaacgcagtagcagctgcattgcatgcttcgctctgcccagccaatagaggcacctgcccactgggtaaaccgggatacccaggctgcctgtggtttcaacccctcctgctgttcccaggatgtttgtgttctccagatggtcccttcccccgtgccgtgttcactagcgccggaaagggccctcttcagaccgatcttggacggggaagagtccctccaagagatcagcagactcccaaatctcgcccatgtcccagagcccctgttgcgtctaataggcaaagtgggggttcagctgttagcgcgcctttgagcggagcgaggcgcgcttggaaaagtgcctttgctgccccaccaagaagccgactgagaccccaaaaaggagtcccatggacagagaaacgtgcacggggaggcggaagggccggaccttgtagaagaacatag

SEQ ID NO: 60729 - DNA, 321 bp, Artificial Sequence
  Description of Artificial Sequence: Synthetic coding sequence
atgcatagcaggccctgggcctggggggcttccgaaatgtgtttctgctttttcgagatgggctccttttgctgcccttccagaagtacagtcgcgcgatcccagcttaccgccgcatcaacatcctgggcccaggtgatactcccgccacaacctcccgagtgcttactcctcgtgtttatgatgacctggggtccgggaatccttcatctctgctgttcgggcgcatcacctgcgccaggagcacaccagccgcagttgcgtagagaggcacttatatgtcgggcaaagcagctgtgctttcacgtcgacccagcatag

SEQ ID NO: 60730 - DNA, 246 bp, Artificial Sequence
  Description of Artificial Sequence: Synthetic coding sequence
atgtgtagttgggaggttactacaccccagggattaggcacctcgtctgcttctgaagaatcgttgaccgatgaccaccgtctacttaaagttattagtcagggtagcttcgcagaagtcaaggccgctgggccagctcattcccactgggatcaagatggatgtgggggtcatcccaatagagcagccggtctcctgcaacctcctgggtcagtcctgcaaggtccatatgatgagggaccatag

SEQ ID NO: 60731 - DNA, 720 bp, Artificial Sequence
  Description of Artificial Sequence: Synthetic coding sequence
atgtctgatccagagggggagacattacgtagcacctttcctagctacatggccgagggggaacgcctgtacctttgcggggaatttagtaaagcagcccaaagctttagcaacgctctctatctgcaggatggagacaagaactgtctcgttgccagaagcaaatgcttcttgaaaatgggcgacctggagaggtctctgaaagacgcagaagcttccctccagtccgaccctgctttttgtaagggcattctgcagaaggccgagactctatacaccatgggggactttgaattcgccctggtgttttaccatagaggttataagttgcggccagacagggagttcagggtcggaatacagaaggcacaggaagccatcaataacagcgtcggctcacctagttctatcaaattggaaaataaaggtgacctttcctttctatctaaacaggccgagaacatcaaggctcagcagaagccgcagcctatgaaacaccttttacacccaaccaagggtgaacccaagtggaaagccagccttaagagcgagaaaaccgtgcgccagctcctaggcgagctgtatgtggacaaggagtacctggaaaaactgctcctggatgaggttacctttttaatgcagaatcgggagccattgactactctggccgagttcttaccagagctgggcaattcctcaaagcccttaaccagagaatag

SEQ ID NO: 60732 - DNA, 516 bp, Artificial Sequence
  Description of Artificial Sequence: Synthetic coding sequence
atgctgacttccaagctcagatcaacactccaaaccttacaaggacttggcctgaccagtagctgcttgctggatatattctcctcagtgtcaacccatattagaaacttgccctgcctgaatctgacattggcaagttcttgccttcagcgtatccagattatgcagggggcaggccgaaagagaaaccggggacgcgctgaaaagcagaaggcctgcgcaataagtttccaggtggactttagtaagctgcacatcttaggagcaggacgaggcagaatcctggaggagaagcaaggcattctggtgcggcaggcgaatgccgactgtcttcgagacctaggactgaagtccgcttttgagctggcatttagaagatcatcacttgttttttctcctcgggctaaaggactcaaatcttccgccgaagatcggcgttggcccctgttttggcagaacatggtgagtatttttggcgcacgctgcaaagccagctctgcacaaacctcctgctag

SEQ ID NO: 60733 - DNA, 1218 bp, Artificial Sequence
  Description of Artificial Sequence: Synthetic coding sequence
atgcacattaatagtcttcatatgcagctgaatagtcaccggatctgcaatagtacacacacagtgtatgccaaccagcttgccttgagaatgcaactcaattcacattgtgtgtgtaattcaaccagaaccgcatacgcgaacccactgacagcctacgccacccaactagcccttaggatgcaactgagtagcttgtgtgtgtgtaatcccgctcggtctgcctacgccacccaagtggcccttaggatgcagctctcctctctctgtgtgtgcaattccgccaggacggcttacgcaacacaactcgctctgcgcatgcaggtcagtagcctgtgcgtttgtaactcagccagaagtgcttacgcaactcagttggcgctgcggatgcagctgagctcacactgtgtttgcaattccgccaggtccgcttacgccactcagctggcacttcggatgcagctgtctagcctctgtgtgtgcaattcggctaggaccgcctacgccactagaaccgcatatgctacgcagctggcacttcggatgcagctgaactcccactgcgtgtgcaatagcacacgaacagcttgtgccactcagctcacactgaggatgcaacttagtctgttgtgtgtctgcaactccacgcgtaccgcctatgctaatcagctgacggcatacgcgacacagctcgctctccatatgcagagaaactccacccacactgcgtatgctactcaattgacactctatgccacccagctcgcactccacatgcagttcaacagccactgcgtgtgcaaatctacatattgtatctgtaattctacccactgtgtttgcaacagtaccagaactgcctatgccacgcagctggctctgcggatgcagctgaatagccactgcgtttgtaacagcgctagaacggcgtacgccactcaactgctgcaggtgctgatttctggtcatttcttgtttcttaccacgaccccctctcagtatttcagttcattgaagtcagctcaggacgaagctctcgacagtcggacgtgctgtatgcctcttggtctgctagaggtctgtagattggctagtccgagactccacccagccttgagttgtctgagctgtgagaatccagtcgcctccgcctctccaggaagcgacttctgcctgttaccctctagcgccgctcctctggggccatgtttggagtag

SEQ ID NO: 60734 - DNA, 411 bp, Artificial Sequence
  Description of Artificial Sequence: Synthetic coding sequence
atgaggcaggaggtagaggggcgaggacggggaagccacgaactgattattaccgacaaaaggtgtggggtttgcggcggttccttgtcttgcatcgtatacttgtgtatctcactaaatttctcccgcatcaaaaaacttaagaaatatacatggcccggtcccacccgcgactccccaaatgcgagcctccagcctgggagggccaaatttgcgttttcgcatgcctcacataccccacttcattcccagcttggtgcacttcagactgggaagccacaggccttgctggcttccgcaaacccgctttcccgatctatggggcctcctgatcatcacctgaccaccctgatcctgatctccttagagacaccctttcccggactcctctccagcggttgttttccctag

SEQ ID NO: 60735 - DNA, 1008 bp, Artificial Sequence
  Description of Artificial Sequence: Synthetic coding sequence
atgcagctcctgggcctgctcggcctcctttggatgctgaaagcaagtccctgggccacgggaactctgagcactgctacaagcatctctcaggtgccctttcctagagctgaggcagcatctgcagtgttgtccaattctccccatagtcgggacctagccggatggccactcggggtgccacagctagcttcccctgcacctggccacagagaaaacgctcccatgacactgacaactagtccccacgacactctgatcagcgaaactttactgaactctcccgtgtcttctaatacctctactaccccaacgagtaagtttgctttcaaggtcgagactaccccccctacggtcctcgtctattccgccacgactgagtgcgtttatccaacctcatttattatcaccattagccaccccacctcgatttgcgtcaccaccacccaggtagcctttacgtcctcctataccagtacccctgttacgcagaagcccgtcaccactgtcacttctacttactccatgaccaccaccgaaaaggggacttctgccatgacctcctctccatcgacgacaaccgctcgcgaaacacccatcgtcaccgttacccctagctccgtctctgccacagatacaacgttccacaccacgatttcatccactacgagaacaaccgaacgtactcccctgccaaccggttcaatccacaccacaacctcacccacccccgtcttcacaaccctgaaaactgccgtaacttcgactagtcccataacgagctcaattacttcgactaataccgtaaccagcatgaccaccacagccagccagccaacagccaccaatactctttcttctcctactagaacaattctgtcatctacacctgttctgagcacagaaactataacttctggcattacaaataccactccgctgagcacactggtcaccacccttcccaccacgatcagtcgatctacacccacttccgagaccacctag

SEQ ID NO: 60736 - DNA, 432 bp, Artificial Sequence
  Description of Artificial Sequence: Synthetic coding sequence
atgcggctgcagaaaactcggtgcgggtcagccgcatcccctcctaacaaacagcagacagaattacccgctttttcagtgatgccgaggcccgctgggcagcatgtctggccatggcgtggagagcgcatgagactcccgggtgcggcttcctcactgttctccaattatttttccctgccttacgttatttatctgtctattagcgatcttaacgtggaatgccttattttttccgtgttcgactcccagcaggtccacaccagctatcagtccaatggcctccaccgaaatggcatgttccatgactgtctggaggtgtctaagcatccttttctcggcctgactctcacactgtggctctgcgacctttctagcagcggattctacatgtcaggtcacgagccgctgtggaacttatcacctctgtag

SEQ ID NO: 60737 - DNA, 633 bp, Artificial Sequence
  Description of Artificial Sequence: Synthetic coding sequence
atgtcacgtgcagggagccaccccaagcctgcaatacccggacgtggaggcgaaaaactcgcactgctcttagctatgctgggtggcaggtgttgtccagccggtggcccagaaagccacactcccagaaaaccatggccacctattagacgagagcgccctggactccgatcccctaagccgagagaagaagccggtccccgagcagatagcaaggctgcatcccctgcacttttcatgggacccggttcacgcggtcgcaggcgcccacctagttgggctagaagacgagccagggggggaaggggttcatgtcccgagcctcacgtcagggcagggccaagattctttatcgccctggctgctcctgctgcacgcggtctgagagtgtcctcccagggcccaggcctttggcgaggaccggctgctaggaaagagggagtcgctagagtgggagtggctgccggactgcggttgcgccctcgagggcgaggaagaaagaccactcctgccctttcgggccatccagctcggttccctctccagcctggagattcacgggagcgtagcaggaaccatcgagctctggagcttacttggcaacctaggggggcaaaggccggaggggcttag

SEQ ID NO: 60738 - DNA, 633 bp, Artificial Sequence
  Description of Artificial Sequence: Synthetic coding sequence
atgagtagggctggctcccacccgaaacccgctatccctggcagggggggagagaagctggccttattgctcgctatgctcggcggtcgctgctgtccagctgggggtcccgagagtcatacaccacggaagccttggcctcccatccgaagggagagaccaggccttagatcgccaaagccacgtgaagaggcaggaccacgggcagattcgaaggccgcttctccagcactgttcatgggaccaggatctcgtgggagaagacgtccgccatcatgggcacgtcgaagggcacggggaggccgaggtagttgcccggagccccatgtgcgagcaggcccacggttttttatcgcgctggccgctcaggcagcccgtggactacgcgtttcctctcagggcccaggtctctggcgcggtcctgcagcacgaaaggaaggcgtggcaagagtgggcgtggcagccggtcttcggctccggcctcgcggtcggggaagaaaaacaacacctgctctttccgggcatccagcgaggttcccattgcagccgggagacagtcgggaaaggtctagaaaccatcgtgctctagagttaacttggcaacctcgtggcgcaaaagccggaggcgcatag

SEQ ID NO: 60739 - DNA, 1881 bp, Artificial Sequence
  Description of Artificial Sequence: Synthetic coding sequence
atgaagatgcaaaagggcaatgtgttattaatgttcggacttttgctccatttggaagctgctactaattccaacgaaacttctaccagtgcgaacacgggctccagcgtgatcagttccggagcctcaacggcgactaacagtggctcaagtgtgacaagctctggagtgagcaccgcgaccatttccggaagttctgtcacctctaacggggtgagcattgtgactaatagcgagtttcacactacttctagcgggatttcaacggctaccaactcggagttcagcactgcgagctctggaattagcattgccacaaattcagagtcatctactacttcatctggcgcttctaccgcaacaaacagtgagtcctccaccccttcctccggcgcaagtacagtgaccaatagcggatcttcagtcactagttctggcgctagtactgctactaactcagagagctcaacagtgtcaagccgggcatcgaccgctaccaacagcgagtcatctacattgagtagcggagcgagcacagcaaccaattctgacagctctaccacgtccagcggtgcctctacagccacaaattcagagtctagcacgacaagtagcggggcttccaccgcgaccaatagcgaatcttccactgtttccagccgtgccagtactgctaccaatagcgaatcatccacaaccagttcaggggctagtactgcaacgaactccgagtcacgtaccacgagcaacggagccggtaccgccacaaattctgagtcgtctaccacatcctccggtgctagtactgcaacaaacagcgacagcagtacggtgagttctggtgccagtacggccacgaattctgaaagcagcaccaccagctcgggggcatcaacggccactaattccgacagctcaacaaccagttcgggggctggtaccgcaaccaattctgagagctccaccacgtccagcggagcctccactgccaccaactccgagtcttccaccacatcatccggagcttctacagccacaaatagcgattcctctaccacttctagcggggcagggacggccaccaactcagaatcatccacagtcagtagtgggataagcactgtaactaattcagagagctcaacaccctctagtggtgccaacactgctacaaactctgagtcttcgaccacttcaagcggggcaaacacagctactaactcagagtcttctaccgttagctctggggcaagtactgcaacgaatagcgagagctcgaccaccagctctggcgtctctactgccaccaattcggaaagctcaaccacttcttccggcgcaagcaccgccacaaactccgattcttcaaccacatcaagcgaagctagcacagcaacaaactccgaaagctccacggtgtcctcaggcatctctacagttactaattctgagtcatccaccacgtcgtccggggctaacactgccacaaattcagggagctctgttaccagcgctggcagcgggaccgccgctctgacagggatgcatacaactagtcattccgcctctaccgctgtaagcgaggcaaagcctgggggaagcttagtaccctgggaaatttttttgatcactctcgtgtccgtggtcgcggctgtggggctctttgctggtttgttcttctgcgtcaggaatagcctgtccttgcgaaacacatttaatactgccgtgtatcatcctcacggtctcaatcacggccttggaccaggccctggcggtaaccatggagctccacaccgccctcgatggtcacctaattggttctggagacggccagtatctagcatagctatggagatgtcaggacgaaattcaggcccatag

SEQ ID NO: 60740 - DNA, 393 bp, Artificial Sequence
  Description of Artificial Sequence: Synthetic coding sequence
atggagggtcgcgaagtgtatttatggtactccgtggactctaggggtgactttctcgtattcctctgtcccattttcttctcttttagcttctcagaggtggagagtctgagccctaggttggagtgctccggcaccatcagcgctcattgcaatctgtgcctcctgggctcttcatacagccctgcatcagcttctcgcgtgacgggcataactggcatgtgccatcacgctcaacttatattcgtttttttggtcgagatggagtttcgccacgtgggccaaacgtcgttcgagctgttagcttcaagctctcctccagcttcggcatcccagtctgctggaattaccggagtgtcccattgcgcgtggcccctcgctcagtacctgtag

SEQ ID NO: 60741 - DNA, 459 bp, Artificial Sequence
  Description of Artificial Sequence: Synthetic coding sequence
atgccagacctgaaaatgcaagaagtgaaaaaaatctgctatgagctcgcgctggcctatttccatcacggccaagcggagatcgaggccttagcgacccttaaggtgtgggagctatgtcacacttacggaaaacccgagggaccacgcgatgcttggagagccgtagctcgcgacttctgggacacagttggtgaggaggagggcggaggtgcagggagcggtggtggaagcgaggaagggaccaggggagtcgaagtggaggacctacaggctcacatatgtaaactgatgggtatcctgcagcaagtgaaactgcagaatagttccaaggattgggagcttcaagcgttacaggaccggatggtctgtatggagaggatcatcccattggctcaggatcatgaggacgagaacgaagagggcggtgaattccattgggctcccccagaagggtag

SEQ ID NO: 60742 - DNA, 498 bp, Artificial Sequence
  Description of Artificial Sequence: Synthetic coding sequence
atgtcacatccccaggccacgtctaatctgcagcacacagtgagcaactctgacaatatcggctcttccgccggaagatggacctgggtgcccctcacttggactgacacgagtaagatgtcaatgagaggcctgttagacctgtttagcttccatagttgcattctcaagaacggctcggaacccgaggaacctcaagactcagctaaaactgatactcaattgtctcccgctactctggctctggaacgtgaggaacacagttcaaggcatgtgcccagtgtgttatcgaagaccatgagtcgggcatcagccgaactgacatgtacagcagggcgtcagggcccaggtcccccaggtagccacagccaggctccccacatgcttccccaaccagaacctctgttggcctgcgcacccgcaatgtggtgcagaagagagccccaacccatcggagggctgcagcctccccatttgcgactgcacctggagtcttag

SEQ ID NO: 60743 - DNA, 375 bp, Artificial Sequence
  Description of Artificial Sequence: Synthetic coding sequence
atgctcccctccaaggcatttgagttcgccaccgtcaagagtatgcacggtatcttcggttgtggcctagctttgccccctgtgttcgcggcagagctgttgtacctcaccagggcttgcgccagcgacgagcaaccgtttattacagcgctgaggccgcctccaagacctccgccatccgcactccagttcattagtcggcttgtgccgattgccacctgcggactcggaggccctcctgacatcctgtctttcggttccccagtgacacccgagttgctgcccttttggggagctcacatttgtgatacactggtctgccctgtgcacttcctgcacctggagttcctcagctgcagtcacatcagtatttag

SEQ ID NO: 60744 - DNA, 267 bp, Artificial Sequence
  Description of Artificial Sequence: Synthetic coding sequence
atgagaagccaagggcagggtggaccaggggcttggagacgaatggagtcttggtcagcagagccagctgggcctggccagggcaggctgggttcgccttgtgaggctgcagaacaggctagctttgaaaagaccgtcatcggggtcgggcaggcgagagccgctctttccgaggaggagcatagggtgtgggaggctgccgcaggggtaggtggcctcgagcagtggggatgctgggaagcgggtgtaacctctggttggggatag

SEQ ID NO: 60745 - DNA, 447 bp, Artificial Sequence
  Description of Artificial Sequence: Synthetic coding sequence
atgtcaagctttgtcgtggtgatgggcttcctagtggaaatgactagtcggaaaaagaacaacgtgaaggaagaggagatggagtgcgctgtgacttatctaagaaaagggggaggtatctgttctttttacttttacttctacctgttcttcatttttatttacctgttctttctccgctggagcctggctctgtctcccagactggaatggagcggggcaatctctgcccattgcaatttgcgcttacccggaagttgccattcctctgcttctgcatccagggtggccggtacaactggagccaggcaccacgcactacttatattctatatcttcagccgggatggcgtatctccatggtcccgctccccacaccttgtggtatgtcctccatggcctccgaaggtgcttggcctgcaagccccagcaactactccaggctag

SEQ ID NO: 60746 - DNA, 375 bp, Artificial Sequence
  Description of Artificial Sequence: Synthetic coding sequence
atgaccctaaatgaacacgctgccttcaagcacttgtttaacaaggcacatctggcgcctccgcttatacacctgaccttgagtggccactccacttgctttagggagcaccgggttggtggaaaagtgaccgatcagcaggatcctaaggcagaggaatttttcctagtgcaaaacaagatgaaatcactgccttgcctgttgctcagcactcagacacgccagcccagcgacttttctattttcagcccgcctttcccacctgtctatagcacaaaacctcctctgagctcatggcccgtgctcaacgaactgctcgggacacccccacgtcggggagggggaagagctgagggcttgctgacatcccagtag

SEQ ID NO: 60747 - DNA, 429 bp, Artificial Sequence
  Description of Artificial Sequence: Synthetic coding sequence
atgcggatcagaacctcatttttcatgagtgccgcactgggaggccgaccccctcctgcgaggacggaatggaccccgctcacgaggtccacccatccgaccgcccctcctgcctctttgttcggccgaagagggcctcctcgcaggccattatcttgttttcccgctcgggaacccggtcaaaggcaactgcgactcttaaggcctagcggactatggagaaggagacgccgtagacgccgaaggagacgacggagaagacgtagaggccgacgccatgctgcacgggacacccggttcaggaacgccaacgctctctgcgcgggtaccgccctgcctctaagcggaagacggtccgctggaccaggatcgctggcacacccccctctgggtacggcaacgccagagaccctgggacctgggatctag

SEQ ID NO: 60748 - DNA, 1977 bp, Artificial Sequence
  Description of Artificial Sequence: Synthetic coding sequence
ctgaagacacccccagaatgtgtgctgacccccctgccaccctccgctgacgacaaccttaaaaccccgcctgagtgcgtcttgactcccttgccaccatccgcagatgacaacctaaagaccccacccgagtgtctgttgacgcctttgccccctagcgccgatgataacctcaagaccccccctgaatgcttgctgactcctctcccaccatcagcagatgacaatttaaaaacaccccctgagtgcctgcttactcccccacccccttcggccgatgacaacctaaaaacgcgggcagagtgtctgctccatcctcttccccctagtgctgatgataaccttaagaccccgagcgaacgtcagctcactcccttacctccgtcggccccacccagcgctgacgataatatcaaaacacccgcagagcggctgcgaggccctcttcccccaagtgcagacgataatttaaaaaccccaagtgagaggcagctgacccccctccccccatcggcccctccatcggcagatgacaacattaagaccccagcatttcacccccagcggatgatcatctccaggcatcttccaagtgtgtcttcactgcctttccatcctcagctgcatagccagcagatgattatctcccggtacttgttaagcgtatgcggtttcagattccatcatcaaccaatgatcattagcagacaccttcccagcgtgagtagcctgccatttcaccctcagctccacccacagcaaatgataattagcaggcaccttccaagcgtgtgcggcggtcgttttcatccacaacggatgatcatctcccgccatcttcctagtgtctcgagcctgccctttcatccccaattacaccctcagcagatgattatttctcgacacctcccttccgtatgcggtgggagatttcacccccagcgcatgatcatttccaggcacttgccttctgtgtcctctttgccatttcacccacaattgcaccctcaacagatgataatttctcgccacctccccagtgtatgcggcggtcgcttccacccccagcggatgataatttccagacacctgccctccgtgtcatccttgccattccaccctcagctgcaccctcagcagatgattatcagcagacacctaccatccgtgtgtggcgagaggctgaggggacctctgccgccttcagccgatgacaatctgaagaccccctctgaaaggcagctgacgccacttccaccgtccgcgcctccgagcgccgacgacaatataaaaaccccagccgaaagactccgcggacctctccccccttccgccgatgataatctcaaaactccctctgagcggcagctaactcccctgcccccatctgcacccccaagcgccgatgacaacataaagactccagcagagagattacgtggccctttacccccaagtgccgacgacaatctcaagacaccctctgaacggcagctcacccctctgcctcccagtgcgccacccagtgccgatgacaacattaagactcccgctgagcgactccggggtcctctcccaccaagtgctgacgataacctcaaaactcctcccctggcaacacaggaagccgaggctgaaaagccgagaaagcccaagcggcaaagagctgccgaaatggagcctccccctgaaccaaaacgcaggcgtgtgggggatgtagagcccagcaggaagccgaaaagaagacgggcagccgatgtagagccctcaagtcctgagcctaagcgtaggcgtgtaggcgacgtggagccttcgaggaagccaaaacgtcgacgggctgccgatgtcgagccttcatcgcctgaacctaaaaggaggcgcgtcggcgacgtggagccctcaaggaaaccaaaacgcaggcgagccgcagacgtggagccatctctgcccgaacctaagcgcaggcgtctctcctag

SEQ ID NO: 60749 - DNA, 588 bp, Artificial Sequence
  Description of Artificial Sequence: Synthetic coding sequence
atgaacagcgtctttcggcagccaggctctaacttctcatttcccatatatcagcctagtgcaagcgtgacccatggtttgagttttttttgtgaagtctcgcctcaaatgctaactccacaggattatagggggaaacagcagggacaccgcggatgcccgggttgtatggtggccatggatacatggcctgccgtacttcccgaactcccgggattctggggggagggctcagggggtcaggcgtggggtgcaagaggggagccccttctgcagaaggccaactgccttctcgaggcagtcaggctatttcttaattacagacctcttggcgctgaaggtggggagctgaccttcgggaagcgcctgctcgttcctacagcagtctcctgcgcttatgattgcgtgtcttcttccgcttttctaggaatccaattactcggcgaccctactcgctctccagggcactgttatcgtcaggactttaatggcacgcttcggttaagagaaggcaagggcctggtccagtctcatacagggaccttgtgggcaggaccactgcaggagggcacacagggtcaaacctag

SEQ ID NO: 60750 - DNA, 453 bp, Artificial Sequence
  Description of Artificial Sequence: Synthetic coding sequence
atggctgtctctcgaatgtctaaatggaggctatcgcgagtcggtggttcccggagtctccctgctgagatggaggtcttgggtgaagtctggtgcgtgagagctgaagagcaacctatgacaggtctgggaattgtgtggcacagcccactcgataaggcattagagacgtggtcactccaacagcaacctgatttctccctcggcttgggccatttgggcctggggaccgatgcaacctggatgcagagctttcccggttcaggcggagatgcccaggccggaactggcgtgagcgggcctttgagactgtatcctaatctactttgcgattttgggcctcgccaaggcccattgtgggcgttactgctggaaaaacggcagatggcgggaacaggtgggtccccagcactcttagcatggaggagcgcatcatggagagcactcggctag

SEQ ID NO: 60751 - DNA, 342 bp, Artificial Sequence
  Description of Artificial Sequence: Synthetic coding sequence
atggcagtttctcggatgagtaagtggcgcttgagccgcgtgggcggtagcagatccctaccggctgaaatggaagtcttgggagaggtgtggtgcgtgagggctgaggaacagccaatgaccggtctcggtatcgtgtggcactctccattggacaaagccttagagacatggtcactgcagcagcagccggactttagcctgggcctgggccacctgggactaggcctgtacatcctggcatcatatctcctctgccctagacagcctcctagccagcctgacggcccttgtggcagtcctaatcccgtatccggcgcaaaaaaaaccaccgtcgcatag

SEQ ID NO: 60752 - DNA, 228 bp, Artificial Sequence
  Description of Artificial Sequence: Synthetic coding sequence
atgcatatttacttcacggcagagttactgaaaagacgcaacgctaagcctaccttctcaatgtcctccatgcaggctgccagatccattcccaaatctatgaatgtgcacagcatgccctccttcctctattcttcgtgttcatcaacaaatatgtggtggttgaagaattgctgcagcttctccctggtgaagttgatgcactcatgcagtcgcctgctcaattag

SEQ ID NO: 60753 - DNA, 561 bp, Artificial Sequence
  Description of Artificial Sequence: Synthetic coding sequence
atgtggaaccagcaaggtcggcctgggatacggaatcaatttagtctgttcttttttctgacccagagcctagccctctcactgcggttggagtgttctggcgcaattagtgaccactgcaatttacggctactcggctcttctgatagttctgctagcgcttccagggtcgcgggtatcatcgacgtgcgacatatgccaggtcagcacggagagacactcagtctcctcaaaatccagaaactcgcaggctgcggcggttcccatctctatagccagttgctggggaggctcaagtgggaagacggcctatctagtggcggacgagggtgttccgagctgagaggtagacactgcgcgcctgggtgggttacagctagactgtgtctgaagaagaaaaaaaaacggggaggcggtaagaccaagctctactctgtcggtctggagttcaatatttggaaagtggatatctggaacgccttggtccctctggacctgtggttctccttaaaaggagagtctagaactatcgtgttagaatcaagcgaggttcggacctag

SEQ ID NO: 60754 - DNA, 459 bp, Artificial Sequence
  Description of Artificial Sequence: Synthetic coding sequence
atgccatcgcagccccacctcagtgcatgcagcgtagagagcccaggcgcagccgcacgcctgacacagcgccacctcacaggcgtggcccgaggaggtggacagactggaactttccacatgggccttctgccatcgcgccaggaatgtgcccctgttagtgccttgaccctgaccactaccatgggcagattgtttagcgtgcattggcagatttggggaccgtgcagcccatgcattgtgtaccctaagggggattctgaacagtctgcgtccaaatccaaacaggcctttcctctcctactccgcaagggcatggagtggccactgtcggcttggttggagtcctccagtcccgcaccatgcatgcctctgtggcgcaggaatagcttttgggagagcaggccctctccttgccggatacgtgggctctgctcgatgagaccacacggcctgtag

SEQ ID NO: 60755 - DNA, 84 bp, Artificial Sequence
  Description of Artificial Sequence: Synthetic coding sequence
atgtcacccgctctgacgtttcccagacgctggatagccgagggactggttgaaaatttgaacccacccggagctgatgcatag

SEQ ID NO: 60756 - DNA, 159 bp, Artificial Sequence
  Description of Artificial Sequence: Synthetic coding sequence
atggcggctcgcagtctagctaggagagcacttcgggtcgccggaggcgacgctcgcagtgggggtccagtggcacgggatacccagttgggcgctcagtggcgttggattgcagaaggcctcgttgaaaatctaaacccaccaggcgctgatgcctag

SEQ ID NO: 60757 - DNA, 381 bp, Artificial Sequence
  Description of Artificial Sequence: Synthetic coding sequence
atgccaaatttcgccaagtccctcttcatacaccctatcaacttcttcttactattcagcactgagttttgctctgtaagccaagcaggagtacaatggcgcgatctgggttcccttcaaccactgccgtcgagatttaatcgagtatcatgcctgtcacttccctcctcctgggattaccgactgatgcctgtgattcctgccctctgggaagcaaaagccggtggctcgcctgaggtgcgtgggtctagactggcatggtccaagtggcagaatcccgtgtctaccaagaataccaagaagccgcaaaattgccccggtatggtcgcacacgcatgctctcccaattattccggaggaggaggcaggaggattacctag

SEQ ID NO: 60758 - DNA, 501 bp, Artificial Sequence
  Description of Artificial Sequence: Synthetic coding sequence
atgactgcgggtactgtggttattactggcggtatattggcaacagtgatcctcctgtgtattatagcagtgctgtgttactgcaggctgcagtactactgttgcaaaaaagacgaatctgaagaagacgaggaggagcctgatttcgccgtgcattcgcacctcccaccgctccactcaaatcggaaccttgtcctgacgaacggcccagctctgtaccccactgcatcgaccagttttagtcaaaaatcaccacaggccagggccttgtgcaggagctgttcccactgtgagcccccaaccttcttcctacaagagccacccgaggaagaagaggatgtgctgaatgggggagagcgggtcctgtacaaatccgtgtcacaggaagatgtagaacttcccaggggtgcctttggagggcttcaggccctaaaccccaacaggctcagcgccatgcgtgaggccttcgcaaggtctcgctcaatcagtacagacgtgtag

SEQ ID NO: 60759 - DNA, 1164 bp, Artificial Sequence
  Description of Artificial Sequence: Synthetic coding sequence
atgtatagatggaagcttagctctcacgaaccatgctcagcaacctgtaccactggagtcatgagtgcgtacgccatgtgcgtcagatacgatggtgtggaggtagatgattcttattgtgatgcgctgacccgtccagaaccagtgcacgagttctgcgccggaagagagtgccaacccagatgggagacttcgagttggagtgagtgcagcagaacctgtggcgagggttaccagtttcgcgtggttagatgctggaagatgcttagtccgggattcgatagttcagtgtactcagatctttgcgaggccgctgaggccgtccgccctgaagaaagaaagacttgcagaaatcccgcttgcgggccacagtgggagatgtcagaatggtccgaatgtaccgcgaagtgcggcgaacggtctgtggtgactcgggacatcaggtgcagcgaagatgaaaagctgtgtgaccccaacacaaggcctgtgggcgagaaaaattgcacgggcccaccttgcgaccggcagtggaccgtatccgactggggaccatgttctgggtcctgtggccagggtaggactatacgccatgtgtactgtaaaacctcagacggacgcgtggtgcccgagagccaatgtcaaatggagactaaacccctggctattcatccttgtggggataaaaattgcccagcccactggctggcccaagactgggagcggtgcaataccacttgcgggcgaggggtaaaaaaacgcttggtcttatgcatggaactagctaatggaaaaccccaaacccgctctggacccgagtgcggattagccaaaaagcctccggaggagtctacatgtttcgagcggccttgctttaaatggtatactagtccatggtccgagtgcacaaagacttgtggagtgggcgtccggatgagagacgttaagtgctatcagggcaccgacatcgttaggggatgtgatccactggtcaagcctgtgggacgacaggcttgcgaccttcagccttgcccaacggagccccctgacgacagctgccaggaccagccagggaccaattgcgcactggcgatcaaggtaaacctgtgcggtcattggtactacagcaaggcgtgctgccggtcttgtcgcccaccccactcttag

SEQ ID NO: 60760 - DNA, 672 bp, Artificial Sequence
  Description of Artificial Sequence: Synthetic coding sequence
atgtttccagtgagcagcggttgctttcaagaacagcaagagacaaacaaatctctcccccgatccgctagtaccccagagacaagaacgaagttcacacaggataacttgtgtcacgcccagcgggaacgtctagactctgccaacctttgggtgctcgtggactgcatcctgagagacaccagcgaagacctcggactgcagtgtgacgccgttaatctcgctttcgggagacgttgtgaggagttggaggatgtgcgacataagctccagcaccatctccacaagatgctgagggagatcacagaccaggaacataacgttgtcgcactcaaagaggcgattaaggacaaggaggaacccctgcatatagcgcagactagactgtatctcctgtcccatcgcccaaatatgcagctttgccgggaggcagcccagttctcggccgtgggagaggcctcccgccgaggtgctgtgccgttgcaacccaggggccacccacacgagcccggagagggctgctatcggcacgatcagcagagtctgcatcgtccaccagaagttcatggcccatcctaccttctgcacccacaccctgccgctggctggctgcctgtctctagcggaaccgttctgcctcctaatccccctaataaacagtgtatttcctag

SEQ ID NO: 60761 - DNA, 390 bp, Artificial Sequence
  Description of Artificial Sequence: Synthetic coding sequence
atgtttcctgtctcgagtggctgctttcaagaacagcaggagacaaataagtcactgcctcggagcgcgtctacgcccgagactaggacgaagttcacacaagacaacctgtgccacgcgcaaagggagcgactggacagtgcgaacctgtgggtgctggttgattgcatactcagagacacttcagaggatcttgggctgcaatgtgacgccgttaatctggctttcgggcgtagatgcgaggaacttgaggacgccagacataaattacagcaccacctgcacaagatgttgagggaaatcaccgaccaggaacacaacgtagtggccctgaaagaggccatcaaagataaagaggagcccctgcatatcgctcagactaggctgtag

SEQ ID NO: 60762 - DNA, 528 bp, Artificial Sequence
  Description of Artificial Sequence: Synthetic coding sequence
atgagactacctggggctcccgcacttcccgatgcggattttcttgtgcacctgcactttctggtccaaacatcatggttcatctgcaatttcctagtcagaatcccatgggctagcgccttacccgatgctccagcactcttagtaatactggagaagactttccccgagcacgcgacctgcaggggttgttgggtttccggatatctgtgctggaccgctcccggtaattgcatctgcagcgcaaatgtggggtttctgaaaatcgaaaatacctaccggcaaatacaccacactcatatgcaccgccatacccacacccacactgacaagagcatcacgcacacatgcactgatacacacacacagtcacaaagacaccgactgacttctcgcgcactgcgcctgttcatcctgaacgcaattaccgacacatccaagtttggtgcagccgtgtttttctatgtatactgtttgttcgccgactcggtgtataaattttttccatttttgcccccatttagatag

SEQ ID NO: 60763 - DNA, 1941 bp, Artificial Sequence
  Description of Artificial Sequence: Synthetic coding sequence
atggaggtaattaacctgacaacactccccatgattcctgttgacgaacacctcgcagtttcactcgtggcgagaaacacaatggtaaagacagtgaggaaggaactggaaaacaaccctccatcttgcctgattggctcaatgcaccaggtcaaccagaaaatagctgatatcaatttgcggacggagccatccgctaattcactggccattgaaagattcgagttagaaaagaaagcgttaagagaaaaaactaggagtagccctgaagacaaagtcaaaaggcaacgcaaatcccagtattcctgtaagggtagcgaactacgccatgctcggagcagtgtcattaagagaaaaaccgcagacaagaacctgctcgctgaattgtatcagtatagcaactttaactctagtaaacccaacaagctacctaatggcgtggatttctgcgacatggtgggcaacgttgtgagagccgaacgggactgtttgtccggcaaacatttctgctcaggcagggaactggagaaattcctttctagttctagtccaagggccatttggctggactcgttctggtggatcttccacgaaagataccaaccaaacaaagaactccaaaataacctctttgaccgcattgcgcagcactacgccctcctgttgttccgggttcctaagagccactctgaggaggcactcttgaaaagactgcccagcctcctgtctaaagctgtgtatacgtccttctgctgttgttttccccagtcttggttcgacactcatgaatttaaaagtgacatatgtaataccatgtctctgtggatatccgtagggacttatcctagcccccagagttatgattcttgggactattcagaactggaccctgagcggtttcgcagggaagagttgatgctctacagacggaggcttacaaaagggcgtgaattttccctgttcgcaggcaagagagctttttctcagaagcccgctcagtcgaggaagttttatcacccacagagcagcagtgccaacagccctagtgaaaagacaagctccgcgaagcagaacagcgaaaagtctttgcgtatgcagaacactgcaaaagagcaccattgccagaccttagttcttaagaaaccaacacaggaggtcaaaagaatctcagaagctcgagaatgtgagaatatgttccccaaaaaatcctgtgcagcgtgcaaatcacccgagctgacgagcaacctgtttaatatatacggcaagtcacctctgatcgtgtacttcctccagaactatgcctccctgcagcagcatggaaagaatgttctaatagtaagacgggaaaagaccacttcaacaccagactgtactcctacatacactgatgtcatctccgaaaccctctgctcaatgaagaagagaaaagacaatctcaaccagctctaccagcatcattggactgagtggaattattttgacaagcatctcaaagagctgcaagataatttcagcagggaaatgaaaaacatcgaccctaaagcggctgatacaaagaaggcgaatcatatgttcatcccgccttctgctgtaaacgaagagtctccggataaaaagactaagggcagtctccaacgcgagattgagtttaagggctgttctaataaaaaccacggaaaaggtcggagtgtcaacatgcgaggtaaagaagaacgcgagagagaggagaaacagaaactgaatattagttttcactcactaccctcaccagaagagctacataacctcgagcctggaagtgcctaccggattagggacatttcagcaacccggacgcccttgcgccgaccgtcatcatgggagccctccttgatataccaggagcaggtgcttctcaaaactcatactctctcaatggaggaggataaatttcggtgttag

SEQ ID NO: 60764 - DNA, 876 bp, Artificial Sequence
  Description of Artificial Sequence: Synthetic coding sequence
atggacgtcgtcgaggtggcgggaagctggtgggcccaggaacgagaggacatcattatgaagtatgagaaagggcacagggcgggtctgccagaggacaaaggccctaaatctttcggcagttataacaacaacgttgaccatctgggcattgttcacgagacagaactgcccccactcactgctagggaggtcaagcagattcgacgggagatcagcagaaaaagtaaatgggttaaaatgctgggtgaatgggatacatataaaaacagtcgaaagttaatagacagggcttaccagggcataccgatgaacatacgcggacctatgtggtccgtgcttctgaatatcgaggaaataaagctgaagaatcctggcaggtatcagattatgaaagaaaaaggtaaacgatcttccgaacatatacagcaaatggatctggacgtctctggtaccctgcgcagacatatattctttagggatcgatacggtacaaagcagagagagttgctctatatcctactcgcttacgaggagtacaaccccgaggttggctattgccgggaccttagtcatatagccgcactgtttctcttgtatctgcccgaagaggacgccttctgggctctggtccagctcctcgctagcgagcgacactccctgcagggattccattctcccaatggcggtactgtgcagggactgcaggaccaacaggagcacgtggtagccacatctctgccgaatactatgtggcaccagagcgccagcagacgacgtcctggagtggctaggggccatgtcttcgggactggttcacttatgccgggtcctgggatgatgacactttgcagctcaatacttgggcctttgtag

SEQ ID NO: 60765 - DNA, 420 bp, Artificial Sequence
  Description of Artificial Sequence: Synthetic coding sequence
atgtttctgttgaaaaagtcttcagaaaaaggctggtaccccgtgaaggaaagtcgcgatcgtggccctcgccgttggagtcagggtctcagtaggaagaagaggacattccccacaaaaagttggcgaaaaaaaacacccggactcctcctgcctttgcccagcggctggcaacacgggagccttagagccggacaggtgctgcatctggatggggctggtggagacagcgaggcagacgtgttaatgatgctacggagactcatccgaggtcaagtgaagggtactctgggctggcgtgtggggattgctgtaccaacaactcccactctgggaggctgcccaagacggctcgaagtctggtggtggctactcctgctactcctcctcctgttactgttgctgctcttgctgctgtag

SEQ ID NO: 60766 - DNA, 666 bp, Artificial Sequence
  Description of Artificial Sequence: Synthetic coding sequence
atgtcagcattagtgttctttcccccttctagcccacttcccattgcctttttcccgccaagtagcccactgccaatcgccttcttcccaccatcctcacctttgccaatcgtgtttttcccttctctattctccatcttcctgccccctccatatcctcacctgctgttagccgcagcttcctcctgtagggcctttctctctccccatcaccttctctttctcttcccaactgtgctgtcccctagaccccttcttagcctctcatccccaagggcattcccgactaccgttttcagccccgtgttttttcctagccacaggttcttgcccatgagctcccatcgactggctgcagcctccgtgtcgcggaatctgttaccaactttttttagcccgcctccgatagtgttcttcccgcaacctctcatcctcaggcacctactgccgttaccgacattctctcagcagcgccttcctgcagctttcttcagtccacgaactctgttcagcccactgccgctgcccaccgtctttgctcctgatagactgttggctcaccctttacttgcactctcaaactgcctcagcccacggagcgctcctcgggttcgacctcctgtaagcctgagactggtgtgtctttgcgcacagcccgcaccatag

SEQ ID NO: 60767 - DNA, 1749 bp, Artificial Sequence
  Description of Artificial Sequence: Synthetic coding sequence
tgaccaggccctaccagttcagcaactaacgtgtcgatggtggtgtctgctggacctttgtcctctgaaaaggctgagatgaatattcttgagataaatgaaaagctccatccccagcttgcagagaagaagcaacaatttcggaatttaaaggaacgctgcttcgtgactcagctggccggttttcttgcaaaccagcaaaaaaagtataagtatgaagagtgcaaggacttgataaagtctatgctcagaaatgagagacaatttaaagaggagaagctagctgaacagctcaaacaggcagaagaactgaggcagtacaaagtgctcgtgcacgcccaggagagagagctgacccagctgcgcgaaaagctgcgagagggacgggacgccagcagatctctgaacgaacaccttcaggctctcctgactcccgatgaacctgacaagagtcagggccaggatctccaggagcagttggcagaggggtgccggctcgctcagcacttggtgcaaaaactaagccctgaaaacgataatgacgatgacgaggatgtccaggtcgagttagctgagaaggttcagaagtctagtgcacccagagaaatgcaaaaggcagaagaaaaagaagtgcccgaggattctcaagaggaatgcgctatcacctatagcaatagtcatggaccctatgactcaaatcagccccaccgcaaaaccaagatcactttcgaagaggacaaggtcgactcgacccttattggatcaagttcccatgtggaatgggaagatgctgtgcacattattcccgagaacgaatccgacgatgaggaggaggaggaaaaaggccctgtctcccctcgtaacctccaggagtcagaggaggaggaggttccacaggagtcatgggacgagggatattcgactctgtctatccctcctgaaatgctcgcttcttaccaatcttactctagtaccttccattctctggaggaacagcaggtgtgcatggcagtggatatcggtcggcaccgttgggaccaggtgaaaaaggaggatcaggaggctacgggtccacggttgtccagggaactccttgacgagaagggccctgaggtgctgcaggattcgttggaccggtgttactcaaccccatcgggttgccttgaactcaccgattcctgccaaccgtatcggagcgcattctacgtccttgagcagcagagagtggggctggccgtggacatggacgagatcgaaaaataccaagaagtagaagaggaccaggatcccagttgtcccaggctgagtcgcgagctgctggacgagaaggaacccgaggtgcttcaggactccctggataggtgttactccactccaagcggctacctagagctgcccgatctcgggcaaccatactcttctgccgtgtactccctagaggagcagtacctcggcctggccctcgatgtggataggaccaaaaaggaccaggaagaggaagaggatcagggaccaccttgccccaggctcagtagagagctgctcgaggtagtggagcctgaagtgctccaggactccctggacagatgctactcaaccccctcctcctgtctggagcagcccgacagctgtcagccgtatggatcctcattttatgctctggaagagaaacacgtggggtttagcctggacgtgggggagatcgaaaagaaaggcaagggtaagaaacggcgaggccgtcggagttag

SEQ ID NO: 60768 - DNA, 474 bp, Artificial Sequence
  Description of Artificial Sequence: Synthetic coding sequence
actctggccgaccaccgacatagaggcacggattttgggggttccccatggctgctgatcataactgtgtttctgagaagctacaagtttgcaatctccctatgtacatcatatctatgcgtgagtttcctgaagaccatatttccatcgcagaacggacacgacgggtccaccgacgtgcagcagcgcgctagacgcagcaacagaaggcgccaggagggaatcaaaatagttctcgaagacatcttcacgctctggcgacaggtagagactaaggtgagggccaaaatctgcaaaatgaaggtgacaaccaaagtcaaccgccatgataaaattaatggtaaacgtaagacagctaaggaacacctccgtaaactgtctatgaaagagagagaacacggcgagaaggagagacaggttagtgaggctgaagaaaacggaaagctagacatgaaagagattcatacatactag

SEQ ID NO: 60769 - DNA, 516 bp, Artificial Sequence
  Description of Artificial Sequence: Synthetic coding sequence
atggccgagatgcgggcttggcgacccctggtacggccttcactgcagtgtgtcaagcttggcagggccacggcccgttggtggtgggttgtgaaagtgaaaccgcatgacaaagatgcaaaaatgaagtaccaggagtgcaacaagattgtgaaacaaaaggcatttgagcgggcaatcgcaggggatgagcacaaaagatcagtggtagattcgcttgatattgaatctatgaccattgagggtgagtattccggcccaaagctggaggacgataaggtgaccatcacttttatgaaggggcttatgcagtggtataaggatcagaaaaaactccaccagaaatgcgcttaccagggtctcgcgctgagccccagactcaaatgcagcgggaccatcaccgcacattgttctctgaatttgctgggtcccagggatcccccaacttctgccagccaggtagctgtcactgaggggatgcaccaccatacttggctgattttcctcttcctctag

SEQ ID NO: 60770 - DNA, 96 bp, Artificial Sequence
  Description of Artificial Sequence: Synthetic coding sequence
atgctggaggctatactgggtcccgtctccaacagcctttacgtgagcggtaagacttgccacggctcacgcagcgtattcagtagtgccaagtag

SEQ ID NO: 60771 - DNA, 225 bp, Artificial Sequence
  Description of Artificial Sequence: Synthetic coding sequence
atgtcaaaggcgcatccaccggagttaaagaaattcacggataagaagttttcattgaaactcaacgggggacgacatgtacagggcattttgcggggattcgatccctttatgaacctggttatcgatgagtgtgtggaaatggcaacatccggacagcaaaaaaacatcgggatggttgaaatcagggggaactcaattataatgctggaggctctggaatag

SEQ ID NO: 60772 - DNA, 1893 bp, Artificial Sequence
  Description of Artificial Sequence: Synthetic coding sequence
atggatccttcctggcggcgatccagtcactcatggccacaaccaatgccagattccggaagggcccctgttaggcctcatctggctaaactggaggaggacgtgtggccgtgcccccagttccaccagaccaaagctgcatcgggccctccgtttgtcaatgaggcaaattccaaatggctggacgctcattacgatccaatggcaaatatccacacttttagtgcttgcttggcacttgcggacttgcacggagacggggagtacaaactcgtggtcggagatctcgggccaggaggacagcagcctagactcaaggtactgaaggggccactggtgatgacagaatcacccttacctgcactgcctgcagcggctgcaacattcctgatggaacaacacgaaccccgaaccccagcgctagcactcgctagtggaccgtgcgtgtatgtctataagaatcttagaccctacttcaagttctcccttccccagcttccaccaaaccccctggagcaagatttatggaatcaagctaaagaagatcgtatcgatccgctgactctcaaagagatgcttgagtcgatccgagagacggctgaggaacccttgagcatccagagcctccggtttttacaactagagctctccgagatggaggcttttgtgaaccagcacaaaagcaatagtattaaacggcagactgtgatcactacaatgacaacactcaagaaaaatctcgccgacgaagatgccgtttcgtgcttggtgctcgggactgagaacaaagaactgttagtattagaccccgaggcatttactatcctggctaagatgtcattgccctctgttccagtcttcttagaggtctcgggccagttcgatgtggaattcagactcgccgctgcctgtcggaatggcaatatttatattctccggagagattctaagcatcctaaatactgtatcgagttaagtgcccagcccgttggcctgattagggtccacaaggtgctcgttgtcggatccacacaggatagcctccacggattcacccacaagggcaaaaagctgtggacggttcagatgcctgccgctattttgacaatgaatttgcttgagcagcacagcaggggactgcaggccgtgatggccggacttgctaatggcgaagtccggatttatcgagacaaggctttgctgaatgtgatccacacccctgatgctgtaacaagcctctgctttggtcgatatggaagagaggataacacactcattatgacaaccaggggcggagggctgattattaagatcctcaagagaactgcggtgtttgtagaaggcggttccgaggtcggcccaccccctgctcaggcaatgaaactgaatgtgcccaggaagaccaggctttatgtggatcagactcttcgcgagagagaagctggcaccgccatgcatagagccttccagactgatctctacctcttacggcttcgggcagctcgcgcttacttgcaggcccttgagagctccctgagccctctgagtaccaccgcgagagagcctttgaaactacacgcagtggtacaaggcctcggaccgactttcaagctcaccctgcatctgcagaatacctctaccacacgaccggtactcggacttctcgtctgctttctgtacaatgaggccctctactctctgcccagggctttttttaaagtgcccctattggtgcctggacttaactacccgcttgagacttttgtagaaagcttatctaacaaagggattagtgatataattaaggttcttgtactgcgggagggtcaatctgccccactgctgtccgcccatgtgaacatgccgggtagcgagggcttggctgctgcttag

SEQ ID NO: 60773 - DNA, 474 bp, Artificial Sequence
  Description of Artificial Sequence: Synthetic coding sequence
atggtcggcaggatgaaacttctgcccaaccgaattcgcacactggcattgaccgctattggcgtggtactgctgggcgtcgacgaccccggtgctccctccgatcaggtcgaggttcacctggagctggatctgccaacacagctcacatccgtgtggcaagtaatgtcaacagtgcctttagcaccattacctggccaactgagcctccttgggccacccggtgccctgggattcccacagcaagggggacccacacaactgcctctgctgctcagagaggtgggggtggagcacaaggaacacattggcggtaggcgctgtggcggtcccagaccagcactgtcctcataccccggacacctgctgctccaaggcccacgggtcctgcagcccctgggggaacggcctggccacctccagaaccacgcggcacagggcaagggcgaccttggtcagtctgactctgagtag

SEQ ID NO: 60774 - DNA, 738 bp, Artificial Sequence
  Description of Artificial Sequence: Synthetic coding sequence
aaggagggcgaggaggaccagaaccctccgtgccccagactgtcaagggaattactggacgagaaagagcccgaagtactgcaggattctttggacaggtgctactccaccccgtcaggatacctcgagctgcccgacctggggcagccttattctagcgccgtctactccttggaggagcagtatttagggttggccttggatgtggatagaaccaagaaagaccaggaggaagaggaggaccagggcccaccctgtccaagattatctagggagttactggaggttgtggagcccgaggttctccaagattcgctcgatagatgctatagtacacctagctcttgcctggaacaacccgacagctgccagccgtacgggagtagtttctatgcgttggaagaaaagcatgtgggcttctcgttggacgtgggcgagattgagaaaaagggaaaaggaaagaaaaggcggggaagaagaagtaagaaagaacgaaggcgcggacgtaaggaaggggaagaggaccagaacccaccatgcccacggctgagccgggagctccttgacgaaaaaggtccggaggtgctgcaagattctctggacaggtcctattctacgccatccggctgtctggagcttaccgactcatgtcaaccttatcgatcggctttctacgtcctggaacagcaaagggtgggtctggccgtcgacatggacggggagtacttgtccatgtag

SEQ ID NO: 60775 - DNA, 258 bp, Artificial Sequence
  Description of Artificial Sequence: Synthetic coding sequence
gagatgcagaaggcagaagagaaagaggtgcctgaggactcgttagaggaatgtgccatcacttgttctaacagccacggcccttacgatagcaatcagcctcatcgtaaaaccaaaattacttttgaggaggacaaggtggatagcacgctcatcggatcttcaagtcatgtggagtgggaagacgctgtgcatatcattccggagaatgaatccgacgatgaggaagaggaggagaagggtcccgtatccccttag

SEQ ID NO: 60776 - DNA, 927 bp, Artificial Sequence
  Description of Artificial Sequence: Synthetic coding sequence
atgcacacacaggtttgcgcacatacctatattcggatgcaccgtcatctttgtacccacatgcagattcatccccagcaccctatctgcgccacccatcgacacaggtatatggagacagatgcccacaccggcttgtgcacgcacattcgtatgcacaggcatctctgtactcacatgcagatacacccacagcatccaatatgcgccacccacaggcataggtatatgaagacagacgcccataccggattgtgcacccacgtttgcatgcacaggcacctgtgcacccacatgcaaatgcatcctcagtacccaatttgtgccactcatcgccacacatatatggagaccgacgcccacaccgggctgtgcacccacgtccatatgcatagacacctgtgcactcatatgcagatgcatccccagtatcctatctgtgctatacacagacacacctacatggaaaccgatgcccacaccggtctgtgtactcacgtccacatgcataggcatctgtgcacccatatgcagatgcacccacagtatccaatttgcgccacccacagacacacttacatggaaacggacgtacatactggcttgtgcacgcatgtccatatgcacaggcacctgtgtacccacatgcagatgcatcctcaatatcctatctgtgccacccatcgccacacctacatggagacagatgcacacactgggctgtgcacacatgtacacatgcataggcacctgtgtacgcacatgcagatgcacccccaatatcgcatttgtgccactcagacatacgtccatggtgacaggtgtacatatcgatccatgcatacttgtacgcacgcccaggctcccggacacacactgtacttactaatttgtagtagtcctccctgtcgactcctgggcaggtag

SEQ ID NO: 60777 - DNA, 300 bp, Artificial Sequence
  Description of Artificial Sequence: Synthetic coding sequence
atgtgggaacactggcttggcgacagtggagttgggttgctgatgcggctgcgatccgacgtctcccaggtgtgccttcagcttaacgcctgcgtggaggtcgaggatcctttgcctgggtggcttacacactgcctaccaggacgggcaggctgctggtgggaggcctcggtgcctttccatggatgtttccagtactcctgtgggattccacctgagcaggttatgaaggaaaataaggcggaggcagctgtgctttttactgcgagcttccggtcacacgttccctctgacctgtag

SEQ ID NO: 60778 - DNA, 315 bp, Artificial Sequence
  Description of Artificial Sequence: Synthetic coding sequence
atggccgctcttatcccgcagggcttcagctgccttagtagggtgctgggttggtggtctcggcagccggtgctggtcactcagagtgcggcaatagtgcccgtcaggactaagaagcggtttacctctccgatctaccaacctaaattcaaaactgaaaaagaattcatgcagcatgcccgaaaagccggtctcgtgattcccccagagaagtccgatagatcaattcatttggcatgtacagctggaatttttgacgcatacgtaccgcctgaaggcgatgcgcgtattagcagtctgtccaaggagagatag

SEQ ID NO: 60779 - DNA, 366 bp, Artificial Sequence
  Description of Artificial Sequence: Synthetic coding sequence
atgagcctcacttttagacgcccaaaaactctgcgactgagacggcaaccacggtacccacgcaaaagtaccccgaccagaaataagctaggccactacgccatcatcaaattcccgttggcgacagagtctgccgtcaagaagatcgaggagaataacacactggtattcaccgttgacgtgaaagctaataagcatcagatcagacaagctgtcaaaaaggtgtatgactccgacgttgccaaagtgacgaccttgatatgcccagacaaggagaagaaagcttacgtccgactcgcacccgattatgatgccttcgatgttgtgacgaaactggggtccccaaaactctcccccgcaggctag

SEQ ID NO: 60780 - DNA, 1569 bp, Artificial Sequence
  Description of Artificial Sequence: Synthetic coding sequence
atgtggcctcaaccccgactgcctccccacccagctatgtccgaaaagacacagcaagggaaactggcggctgctaaaaagaagttaaaagcttactggcagcggaagtcccccggaatcccagccggtgcaaaccgcaaaaagaaggtgaacggaagtagccccgacactgccacttctgggggttaccactccccaggcgatagtgctaccggtatttacggagagggacgggctagcagcactaccctgcaggatctggaaagccagtatcaagagctcgccgtggctcttgactcatcctctgccataataagccagttaaccgagaatatcaactcgcttgtgcgaacttctaaagaagaaaagaagcacgaaatacacctggtccagaagctcggtagatctctcttcaagctgaagaatcagaccgctgaaccactggcccctgagcctcctgctggtccctccaaagtggaacagctgcaagacgaaacgaatcacctgcgtaaggagttagagtccgtcggtcgacagttacaagcagaggtggaaaataaccagatgctgtctctgcttaaccggcgacaggaagagcggctgagggagcaggaagaacggctgcacgagcaggaggagaggttacatgaacaggaggaaagattgtgtgaacaggaagagcgcttgcgggagcaagaggaaaggctcagggagcaggaagaaagactgcgggaacaggaggagcggttgcatgagcaggaagaaaggctgcacgaacaagaagaacggttatgtgagcaagaggaaagattgcgggagcaggaagagcggctatgcgaacaggaagagcgactgagagagcaggaggagcggctctgcgagcaagaggagcgtctaagagaacaggaggagagattgtgtgagcaagaggaacgactatgcgagcaagaggaacgcctgtgcgaacaggaaaaacttcctgggcaggaacggttgctggaggaggtggagaagttgctggagcaagagcgtaggcaggaagagcaagagagacttctcgaacgcgagcggctgctcgacgaggttgaagaactcctggagcaggaaagattacgccagcaggacgaacgcctctggcagcaggaaactttacgcgagctcgaaaggttgcgcgaactggagagactacgagagcttgaacgtatgctcgagctaggctgggaagccctgtatgagcagcgcgctgagcctagatccggatttgaggagctaaacaacgaaaataaaagcactttacagctcgaacagcaggtgaaagaactagagaagagcggaggagctgaggagcccagggggagtgagtctgcggcagcagccaggcccgtccctggcgcacctgtcccacagggagcctggatgtgtggtcaagctggttggaccccccaggagcatcccggactgtctggagaagccgtgggtacgggggaggctgccggaggagctgaagaagcagcctgtcattcatttcgcgcagcagaaaatcgggagctgaatataacaatcatatag

SEQ ID NO: 60781 - DNA, 783 bp, Artificial Sequence
  Description of Artificial Sequence: Synthetic coding sequence
atgttaaggaacgagttgcaattcaaggaagagaaactcgctgaacagcttaagcaggctgaagaacttcgacagtacaaagtgctcgtccactcccaggaaagggaattgactcagctgagggaaaagctacgggaggggagagatgccagtcgaagcctcaacgaacacctccaggccctgctcacccccgatgagcctgacaaaagccagggacaagacctgcaggagcagttagctgagggctgtcggctggcccaacacttggttcagaagctttcaccagagaatgacgaggacgaggacgaagacgttcaggtggaggaagatgaaaaagttttagagtcctcctcacctcgcgaaatgcaaaaagccgaggaaagtaaagttccggaggactccttggaagagtgcgcgatcacctgtagtaatagccacggcccttgcgactccaatcagccgcataaaaacataaagatcaccttcgaagaagacaaggtcaattctagcctggtggttgaccgggaaagctctcatgacgagtgtcaagacgccctcaacatcttgcctgttcctggacctaccagttctgctacgaatgtgtctatggtggtgagcgccggaccactgtccagtgagaaagccgaaatgaacattctagagatcaacgagaagctccgaccacagttagcagagaagaaacagcagtttcgaagcttgaaggagaagtgcttcgtcacccaggtcgcgtgttttctcgccaaacaacagaataagtattag

SEQ ID NO: 60782 - DNA, 303 bp, Artificial Sequence
  Description of Artificial Sequence: Synthetic coding sequence
atggcaaagaacaaatttagaggccaaaaatctcgaaacgtgtttcggattgccagccagaaaagcttcaaggcaaaaaatagggtcaagccaattacagccaaccttaagaaaatccatatcatgaacgatgagaaagtgagccgcgtgaacaaggctttcggcagtgtgcaggaagaactccctcacttcagcaagggactcagtttagacctcctccagaaggagctcattccacaacagcgccaccaaagtaaacccgtgaacgtcgatgaagctaccaagctgatggcacagttatag

SEQ ID NO: 60783 - DNA, 1659 bp, Artificial Sequence
  Description of Artificial Sequence: Synthetic coding sequence
atgctcaagtcaaggatcagtatgcggtctaggcaccctcggagggcaatcagcgagggtcacaaaagcgaaggcacaatgccgccaaataaggaggcgtctggactgtcatcatccccagccggtctcatttgcctgccacctatctcagaggagctgcagctggtttggactcaggcagctcagacatccgagcttgactctaatgaacatctcctcaagacgttcagctactttccttaccccagcctggcagatatcgccctgttgtgcctgaggtatggcctgcagatggaaaaggtcaagacatggttcatggctcagagactcagatgcggcatatcctggagtagcgaggaaatcgaggaaactagggccagggtagtgtacagaagggatcagctgcattttaaatctttgctgtccttcactcatcatgccggtcgacctcctgaggaagtgccccctcctcctgttcccgcacctgagcaggttggcatcggtattgggccaccaactctctccaaaccaacccaaactaaaggactgaaggtggagcctgaggagccctcacaaatgcctcctctcccccaaagccaccagaagctgaaagagtccctcatgacccctggcagtggcgcatttccatatcagtccgacttttggcagcatctccagagctccgggctgtccaaagaacaggcagggaggggcccaaatcagtctcacggaatcggaacggcctcttggaatcattccaccacagtgcctcaaccccaggctcgtgataaaccacctccaatcgccttaatcgctagttcctgcaaagaagaaagtgcctcttccgtgacaccaagctccagcagtactagttcttccttccaggtgctggccaacggtgcgacagccgctagcaagccactgcagcctctgggctgtgtgccgcaatctgtgtctccaagtgaacaggcattgccgcctcacctagagcccgcatggccgcaaggactgcggcacaactctgtgcctggaagagtgggccctaccgagtacttgagcccggacatgcaaaggcagagaaaaaccaagagaaagactaaagaacaactagctatattaaagtcctttttcctgcagtgccaatgggcgcgtcgcgaagactatcaaaaactcgagcaaatcaccggcctccctaggcctgaaattatccagtggttcggagatacccgctacgcccttaaacatggacaattaaaatggtttagagataacgctgttccgggagctccaagtttccaggacccagctatacccacaccacctccgtcaaccaggtccctgaatgagcgagcggagaccccaccattgcccatccccccaccaccacccgatattcaaccgcttgagcgctactgggctgcacaccaacagctccgagaaacagatattcctcagcttagccaggcttcccggctgtctacccagcaggtcctcgactggtttgatagccgcctgccccagccagctgaagtcgtggtttgcctcgatgaagaggaggaagaagaggaagaagaactccctgaggatgatgaggaagaggaggaagaagaggaagaggatgatgacgacgacgatgacgacgttattatccaagactag

SEQ ID NO: 60784 - DNA, 528 bp, Artificial Sequence
  Description of Artificial Sequence: Synthetic coding sequence
atgaaggtcacaaccaaggtgaaccggcatgataagattaatggcaagcggaaaacagcaaaagaacatctacggaaactcagtatgaaagaacgagagcacggtgaaaaggaacgtcaggtgtcagaagcagaggagaacggtaaattagacatgaaggagattcatacttacatggaaatgtttcaacgggctcaggctttgagaagacgtgccgaggattactatagatgtaaaataacccccagtgcgcgtaaacctctgtgcaatcgcgtcagcctgttagtctttctggcctttggacattcactgcccggtcaggacatggatactttcttctccttgcggctgtgtgcccaggccctgcagagagagatggccgaacgaaaggcggcatataaacaccactctcccattccagtagggaaccgggtggctcagaagcatctccatccacatcctgtgggacccccatccaacatactgtcagtgcggggttctatctttgtcatcgccaatggcccttag

SEQ ID NO: 60785 - DNA, 228 bp, Artificial Sequence
  Description of Artificial Sequence: Synthetic coding sequence
atgtctaagctcgtatatctctatatgctccgcgtgtatatttctaacatcaacagcaacagcgtggtgtacatctttatttcaatccccgtcactcactcccttgacaactggacatttcttgtgagtttcgagattggaaagtacgaaagcagcaatttcgtgctctttcacgattatagcgggtacgtgcgtcccttaagcatcccctacgagctggaaggttag

SEQ ID NO: 60786 - DNA, 390 bp, Artificial Sequence
  Description of Artificial Sequence: Synthetic coding sequence
atgctctgcccatgcatccaggagtctaccttcgaaacctgtttgttcatggcagtctccaggatgtcaaaatggcggctgtcacgcgtgggcggtagcagatccctgccagcagagatggaagtattaggggaagtttggtgcgtccgggctgaggaacaaccaatgaccgggctggggattgtgtggcacagccctctcgacaaggccctggaaacatggtctctgcagcagcagcctgatttttcactcggcctgggccacctgggtctgggattgtacattctcgcgtcctacctcttgtgtccccgacagccaccgagccagcccgacggaccctgcggcagccccaatccagtttcaggtgccaaaaaaactacagttgcttag

SEQ ID NO: 60787 - DNA, 288 bp, Artificial Sequence
  Description of Artificial Sequence: Synthetic coding sequence
ggcagaaaggaaggggaggaagatcagaatcccccatgcccgaggctcaacagtgtgttgatggaggttgaagaaccggaagtgctgcaagatagccttgaccggtgttactctactcccagcatgtacttcgagctgcccgattcatttcagcactaccgaagcgtgttttactcgtttgaggagcagcacattagctttgcactcgatatggacaatagattctttacattaaccgttacatctcttcacttagtgttccagatgggcgttatttttcctcagtag

SEQ ID NO: 60788 - DNA, 543 bp, Artificial Sequence
  Description of Artificial Sequence: Synthetic coding sequence
atggggttgggcgcagtggaacaggaagcggctttggcaggcgaggccccagctgctcaagtgcctacagagggcgtgggaggcagcggcatggccggatgcagatcccgagccttgccccttggtaaagccgctcgggcaccgggagaaatagaaagaagcgccggtggatccgctctgttgggagatcctgtgcatccaccacagcccctagcacgcgtgctctcaccatccctgcctggcgctgggagggcgtgtcgactcctacgcgtgcgcgctgccaagcttactccgacccagaattcatcatggcctgccagtgtcgcctgcagcccaggatcttgtagccatctttctctgcacacttctcttcaggcagagggcgctggtagcggcctgggaaagcctcggaaaggcttaccccagtgtagcggcggactgaagggcagttcatctgccgcaaaggtcggagcccaggccgaggaggcccctcgggcatcagaggggtctgaggattgccagcacgccgtgacaagccattag

SEQ ID NO: 60789 - DNA, 390 bp, Artificial Sequence
  Description of Artificial Sequence: Synthetic coding sequence
atgctgtgcccttgtatacaggagtcaaccttcgaaacatgcttgtttatggccgtgtccagaatgtcaaaatggagattgtcgcgggtgggaggtagtaggtccctccccgctgagatggaagtcctgggcgaggtgtggtgtgttcgagccgaggaacagcctatgaccggactgggcatcgtgtggcactcccctctggataaagccttagagacttggagtctgcagcagcagcccgacttttccttgggactgggacatcttgggctcggactgtacatactggcgagctatctgctttgcccgagacagcccccaagtcagccagacgggccttgcggctcccccaaccctgtgtctggtgccaaaaagacaacggtagcctag

SEQ ID NO: 60790 - DNA, 417 bp, Artificial Sequence
  Description of Artificial Sequence: Synthetic coding sequence
atgatcttcccccagatctatctggactactttaaaatgaggcaggattattgtcagtctctgaacgtttggtcctaccttccgtggatctttttctcgttcgggctgggctttatcaacaaccttaacatcatctcctatcggatcaccaaagaagaagtcaacctcattcatctgagactgcaacccaagatacagtcaaactcatcattcagtctttcatgtttttttttcatgttccttctcctgatcgctgctcgaatccttcatcgtattagtatcgagatgtatgaaatcctgtggtctctgcacgtcaggattgctcagtatgtgaccattcagtttcaacgggagcctaccttcgtacgctttaccgatcagggagtggtggaagaagtggaactgcagatcaggtag

SEQ ID NO: 60791 - DNA, 504 bp, Artificial Sequence
  Description of Artificial Sequence: Synthetic coding sequence
atggagcaggagcacattccccactggatacagacatcagccttttctggcggtcttggacgcagctggtgcaagatccgatgtatggctagggcgggtctgcccgtccatatggtaaatggggatccagacaccggtaggcccctgctgactgctcccggtgcaaaacagccgccacgaggctggcggaggcaggcgggtagctcatgttcccgggctcggggtgtctggcgtggcgctctggcctctaggcagggcgctcagcgcggatctaagggccctggagtgagtcaccagtcgtatggagttgaaggcttggggtcctctgtgtgtcccgtgacgtggcacttaagggcattaccaagacagctgtgtgatgccagccaccagaccgcttgcattaaatcaggcgtgtgtagtagtctaaaatggagacggccagaggctctggacagaagaagtcacatactcgagggatccgtcctcggccatagatgcccctag

SEQ ID NO: 60792 - DNA, 1158 bp, Artificial Sequence
  Description of Artificial Sequence: Synthetic coding sequence
atggcttatcttggtccgtatcctacatcccgtcagccacctcagatgcgacttttaccacataattcattgcaccgccactctagtattgttaccatggccagtctcgacccagccccagcgtcgcagcctagcctgcaggcactgaatttcctcaagtctacatctcctggacctgctcatgcctctctgcagcccctgcaggcgcaattgttacatctcggaggaccctcgagacctagcctgtgcttaccgtccgcatctacagtacccactagtgccagtcagcaaattcttcacgcacagcatctgccccattgcggaccccctaaaccgtctagccaaccgtttagtagcttctacacgcccagctctcgcctacccgtggcctcctctgggccttgggggagttttctgactaccgctttccccggtccagtgttcccgtttcgcagaccactgagagctcaaaacctgctgaagagcgcttcccctgatcccttagcccctagtgggaggtcacttcgcgcacagctttttttcctggtcggcagtccaggaccaattcccgcatcgcagcagcctttatggacccagtgcttgcccattagctggcgcccatggtccgcgcactccttcctcaagcctagctcccctggtccaggccaggcctctcggtggcctttacaagacgagctcctcccatccgatggaatttctaggccgcagatggtgagcggcagatgggcacctccccgacagggttgggccagccgaagaccgcctcaggctcaggttgtgctgaagagcggctcacctggtcctgcctcccagcaggtctctaagcttttctggcttaatagctgtcccgctccaaaccgtctctgcaggcccaggacctttagttcccaggctttaagagctcacctgttacctccaggcggactgtatagttcgtccacggggtggaggaccgcctctgccggtccgtccctggccagtcaaggacccctccaagcccagctcctgcctcccaggaggccacccggtgcaaaaagcctaccagcaagccaacaaccagcgtgtgggccagctccacccagccggtggcctgttgatgctcagctgatgcctctcgcaccttgcccagaggcgtag

SEQ ID NO: 60793 - DNA, 423 bp, Artificial Sequence
  Description of Artificial Sequence: Synthetic coding sequence
atggggggtcctgagactaaaggactggagggtgacccgcatatgcatcactttctgctgtttactgtgtgctgggagtcttctcgcgctctttgccagatgccacaggaggagaaccctccacaatgtaccgtgaaggacgacacagcgttactgcccaacgatacaaggccctcctggtgtctgtatatggtcgatgccggatctgtggggccaagcgtgcttggcttggtgcgcagggagtcaacccaagagcagtccgcaagcgagagatccagtgtggccccaccggctggcgctaaccgtgactctcaccgcccacttgcagattggccaactttgcccacatcactgctcacttccagcctggtgttccagaagggagagacgactataaaagacaagcgtaagggaaggtattag

SEQ ID NO: 60794 - DNA, 375 bp, Artificial Sequence
  Description of Artificial Sequence: Synthetic coding sequence
atgactcctaatgagcaccctgcgtttaaacatttattcaataaagcccacctggctccaccactaatccacctcacactgtctgggcactccacatgcttcagagaacatagggtcgggggaaaagtcactgatcagcaggatcccaaagccgaggaattctttctagttcagaacaagatgaaatccctgccatgccttctcctatccacccagaccaggcagccctctgatttttcgattttttctcccccttttttgcctttctattccaccaagccccctttaagctcctggcccgttctcaacgaactgctaggcaccccacccaggcgcggtggaggcagagccgagggcttactgacatcccagtag

SEQ ID NO: 60795 - DNA, 465 bp, Artificial Sequence
  Description of Artificial Sequence: Synthetic coding sequence
atgggcctgtggcaacagatctcaaattgtatgccagacctcgccttgtgctctgatataaaattcttcctgcggtgcctcgaaagatggcttaaccgcaactctagcgccctgcagcttccagctagatccacccagaaagaaattatcagcgctttcccgaccaaggtaccttcttcatctcattgggactggctcgattctggatgttcaccacaaaaggcttcaaggagcagagtgggttgctgcctcacaagagaggcacagggagtgagagagcttccccctctggccaaaggtagctgcgaaggcctttgccgtgaggaacggggaattcccgctcagatcctgtgtttcccacatggcctgtgcaatccccaaacacggcgattcccttgggtgccggctccccctgggccttgggtgagctctaaaaagctcggatcccacttaggcaggcactag

SEQ ID NO: 60796 - DNA, 168 bp, Artificial Sequence
  Description of Artificial Sequence: Synthetic coding sequence
atggtgcagtctgcctccgtatctaaagccggaaaaggctcttcatcctcacacggggtggctgccgctctaaatcaggacctggatcccgacccaaagtgccacgtcttcaacgttagcagccagagatgtcaaatgggttcggcccagccctgtctctgttgctag

SEQ ID NO: 60797 - DNA, 621 bp, Artificial Sequence
  Description of Artificial Sequence: Synthetic coding sequence
atgcatcataacaagcaggctactgaaaacgcaaaggaggaagtcagaaggatcctgggcctgctggacgcatacctcaaaactcgcacatttttggtcggcgaacgagtcaccctcgcggcagagcctaaagctaaggacccatttgcacaccttcctaaaagcacttttgtcctcgatgaattcaagcggaagtattctaatgaagataccctgtctgtcgcgttgccctacttctgggagcatttcgacaaggatggctggtccctgtggtatagcgagtacaggtttccagaggagctaactcagacattcatgagttgtaacttaatcacaggcatgttccaaaggctggacaagctgcgcaaaaacgcttttgcctcggtaattctgtttggtactaacaacagtagttctatcagtggggtctgggtattccgtggccaggagctggctttccctctgtctcctgactggcaggttgattacgagtcctatacgtggcggaagctggacccgggtagagaggagacccagactttagttcgcgaatatttctcctgggaaggtgccttccagcatgtgggtaaagcttttaaccacggcaaaatcttcaagtag

SEQ ID NO: 60798 - DNA, 498 bp, Artificial Sequence
  Description of Artificial Sequence: Synthetic coding sequence
atgagctgcagccgttcacggagcctggaggcatcctcctcccgaggtacattgcctgctagctgggttcgtgggtctcgctgcctgggtagctctttcgcagacgagggtcaagcgccactacatgctgaccgtccaaggttttttggcactgtgctgacttcttttcctagtgagaaactggctgccaaagccctactgtggggtgccctcaatttctttctggggcctaattggagtgaatccgaatttccctggccttccttcctcccgatcctaggggctggaggcgctgtggacttcctaccacgcgaccttttcattatttttctgtgttccgttctcccacgtccatcagccgtgcctgcatcccctccctcacccttctctcttctccccccttttccgactttgccattgagcccattctccttgtcaagaatccttggatgcagtaaccaacgggcagttagtttgttcttccctcactactgctag

SEQ ID NO: 60799 - DNA, 1158 bp, Artificial Sequence
  Description of Artificial Sequence: Synthetic coding sequence
atggcttacctggggccataccctacctctagacagccaccccagatgagactgctgccacataacagtcttcatcggcattcctctattgtcacaatggctagcctcgatcccgcacctgcctcccagccctctttgcaggctctgaatttcctcaagtccacgtcgccaggccctgcacatgcctcactgcagccccttcaagcccagttactgcaccttggcggtccaagtcgcccatctttgtgcttgccttccgcctctaccgtgccgacatccgctagtcagcagatcttgcacgcacaacatctcccccactgtggtccaccaaagccgtcctcacagccgtttagtagcttctacactccttcaagtaggctgccagtggcatctagtggaccctggggcagtttcctaacaaccgcttttcctggacccgtttttccattcagaaggcccctgagggctcagaatctgctcaagagcgccagtccagatcccctcgccccatcagggcgatcactacgggcacaactattctttcttgtgggtagccctggtccaatacccgcttcgcaacagcctctctggacacagtgtcttccgataagttggcgaccctggtccgcacactctttcctcaagccgagctccccgggtcccggacaggctagcaggtggcccttacaagacgagctgcttcccagtgatggcatttctcgaccgcaaatggttagcgggaggtgggctcctccgagacagggctgggcctccagaagactgcctcaggcacaggtcgtgctaaagtccggttcacccggtccagcctctcagcaggttagcaaactgttctggctgaactcctgtcctgcgcctaacagactgtgcaggccaagaacattctcgtcgcaggccctgcgcgctcatctgcttcccccaggaggactttacagctcatctaccggctggcgtacagctagcgctggcccagccctggccagccaggggccattgcaagcccagcttctgccacctagacggccaccaggcgcaaaatcattgccagcatcccagcagcctgcctgcggcccagcccctccatcacgttggccggttgatgcccagctcatgcccctcgccccatgcccagaggcatag

SEQ ID NO: 60800 - DNA, 510 bp, Artificial Sequence
  Description of Artificial Sequence: Synthetic coding sequence
atggtaccaagggctcctccctgcgcttggttgaggcccggtcgcagagcccaggctggcgagggacccagggaccctggcaacgcagcgtggcggacgcgacgtactggctttccagaagcaaccggccctgctcggcacctccagctactttatgttgactttggaagatggacacatggacgtccagtgccactctgtagagcagggtggcgaccacagtgtcccggagctgctgctgctttggggttggccggattgggcgatcacatctggcccccagggcgtaccgtaccacaggatccaccggcttgggccccaccgagctctttggcccattcacttggcgctcctgtaggagcaggcgctgctggctgcccatgtggcccagctattcaccggcctgcacatgccgcttctccttctacgtgcctgcccacccccccacaaccacccacaagccaccttgaggaaaccatggggcctgcaccaccggctccaggctgttag

SEQ ID NO: 60801 - DNA, 783 bp, Artificial Sequence
  Description of Artificial Sequence: Synthetic coding sequence
atgggcgataacctgtggttggggctgagagcacaagacccgtggcgggcactgcggcctgcccaatctcctagggcctgcaggccccacgccgattgcggcgatcagggattccgaagaaaagcccagacgccacaactgaatcctccaaccgatcataaagtgcccgagcagagagacgaaggtgctgtacacctgctaagcaggccaggtcgggctcgtcctcagattcggagagcccctgccccacataactctcgaaccacaaccgctggcggtctgccatctatccgccctgggcgtcccgaacctccacctgcactttctgatcacctaggagctggtcttagcgttctgagtcaggatggcgcagtgaggattcctcctcagggcttacctgacctgctcgaacttagaagggacgcccctactctggagagtcggcctgcagccgcagctctgagtctgttattccaagcagcctcctcagcggctcggcgtgccatgtctccggcacaggagacatatagctcttctcctcacccgcttagacggttggatagattcaggcctttggaagctacgtgggggggaccccattggaagccacttcctggaatacatagcgtgccaaaagcatatagtacagagaactcgcggtctggcaggtgcaaacccggactggtgggcgcatgtagagcttcccccacgcctgatactcctcctggggttggggcagagcagagtagcggacagccattgacaactcgctgtaggacttag

SEQ ID NO: 60802 - DNA, 1224 bp, Artificial Sequence
  Description of Artificial Sequence: Synthetic coding sequence
atgtataacgctttctggaatcatcttaaagaacagttgctctccacccctcccgacttcacgtgtgcattggagctactgaaagacgtcaaagaaaacagattgaggaatgaaatcgaggaagctctcgacacagatttactgaagcaggaggccgaacatggtgcgcttgacgtgccccacctgagtaactatatcctgaaccttatggcgttactatgcgcccctgtccgtgacgaggcaatccagaagctcgagaccatccgcgaccctgtgcagttgctcagggggatcctccgggtgcttggcttgatgaagatggacatggtaaactacacaattcagagttttcgtccgtatcttcaggagcactccattcagtacgagcaagctaagttccaggagctattagataaacagcccagtctgctggactatacgactaagtggctcacaaaagccgctactgatatcacgaccttatgtccttctagccctgactcaccctcgtcctcttgttccatggcgtgctccctcccgtctggtgccggaaacaattccgaacctcctagcccaaccatggtgctgtaccagggctatctgaacctgttactgtgggatctcgaaaacgtggagttccctgaaactttacttatggacaggattagactgcaggaactggcctttcagctacaccagttgaccgtgttagccagcgtgttactcgtggcccgaagcttttccggggaagtcctgttcagatcgcctgagtttgtggaccgcctgaagtgtaccacaaaagccctcacagaggagttcatttcccgtccagaggagactatgctatcagtttctgagcaggtgagtcaggaggttcaccaaggccttaaagacatgggattgacgacattgagcagtgaaaataccgcaagtctgctcggtcagctccaaaatattacaaagaaggagaactgtatcagaagtattgtcgaccaatggatacgcttttttctgaagtgctgcctgctccacggcatgcaggagtctttgctgcacttccctggtggtctcatcctgatcgaaaaggaactagctgagctggggtggaagtttctgaatctcatgcaccacaaccagcaggtgtttggcccttactatgctgaaatattgaagcatattatccatcccgcacaggcacaagaaacagacgttgaacctaactag

SEQ ID NO: 60803 - DNA, 390 bp, Artificial Sequence
  Description of Artificial Sequence: Synthetic coding sequence
atgtgctgcaactattacggaaacagctgcggatacggcagttcctacggctgcgggtatggaagtggctatggatacggatatgggtcctcttatgggtgcggatacggtactgggtacagttgcggttatggttgcggctatggctctggctatggatgcggctatggatcatcatatggatgtggatacggcaccggatattcatgcggatacggctctggttattcatgtggttatggctccgggagcgggtgtgggtatgggacgggctttggttgcggctatggctgtggttatggtaccggatacggttgtggatgtggcagtggaagcggatactgcggctaccggcctttttgtttcaggcgctgctactccagctgctag

SEQ ID NO: 60804 - DNA, 144 bp, Artificial Sequence
  Description of Artificial Sequence: Synthetic coding sequence
atggcgctgcctcaggggttgctgaccttccgcgatgtggccatcgagttttcgcaggaagaatggaagtgccttgaccccgcacagcggacactgtaccgcgatgttatgttggaaaactaccgaaatctggtctccctctag

SEQ ID NO: 60805 - DNA, 1170 bp, Artificial Sequence
  Description of Artificial Sequence: Synthetic coding sequence
atgctcctgccccctggttctctgtctcgccctcggacctttagtagccaaccactgcagaccaagctcatgacccacaatggtctgttcaggcccattccctatgtgaccgctgctagtgccgatgaggccactgcatcgcagcaacctccccaggcacagctgcatcgttataacggactgttccggcctagttcgtgtttacccgctttttctccgggaccagagctcagtcaagtggacctgacaaggccaagtagctgtttttttgctgctagcccaggaccggctccagcttcttggtggccccttcaggcccaacccctgccccctgtatcattgtatagcccaaacgtttgtcttactgctgatagctcccgacccgcttccacaagtctttggacaccacaggcgaaactgcccacattccaacaactgctacatacgcagctcctccccccaagtgggctgtttcgtccttcgagttgcttcacacgtgcctttccaggccctacattcgtgagctggcagcccagtctggccaggttcttacccgtctcccagcagccaaggcaggcccaggtgctgccccacaccgggctctcaacatcgagtctgtgcctgacagttgcctcacccggacccaccccagtgcctggcaggcaccttagggcgcagaaccttctgaagctcgactccctggtgccaaccgctgcctcctggtggcccatgaaggctcagaatttgctgaagcttacttgccccggtcccgctccggcatcctgccagaggcttcaagcccagcctcttccgcacgggggtttcagccggcctacttcttctagttggcttggactgcaagcgcaactactcccacataactccctattctggcctagtagctgtccagcccacggtgggcagtgccgcccaaagacgtcgtcttcacagacccttcaggctcacttgttactccccggaggcattaataggccgagctttgatctgcggactgcctccgccggaccagcactggcaagtcaaggcctcttccctggcccagccctggcatcctggcaactcccccaggccaagttcctgcctgcttgccagcagcctcagcaggcacaactcctgccgcactccggtccatttcgtcctaactcgtag

SEQ ID NO: 60806 - DNA, 780 bp, Artificial Sequence
  Description of Artificial Sequence: Synthetic coding sequence
accagtttgtggacaccccaggccaaactccctaccttccagcagttgttgcacacccagctgctcccgccaagcggcttgtttcggccatctagctgctttaccagagcctttcctgggcctacattcgttagctggcagccctctctggcccgattcctgcctgtcagccagcagcctcggcaagcccaggtgttgccacacactggactgtctacttcatctctatgtctgaccgtggcctctcccggacccactccagtgccagggaggcacctgagggctcagaacctcctgaagctagactccctggtgcccaccgccgctagttggtggccaatgaaagcccagaacttactcaaactcacttgcccgggtcccgctcccgcaagctgccagcgcctgcaggcccagccattgccacatgggggatttagtagacccacgagctcaagctggctaggtttacaggctcaattactcccccataactctctgttctggccctcatcctgccctgctcacggaggccagtgccggccaaaaacaagttcttcccagaccctccaggctcacttgttgcttcccggaggcattaaccgcccatctttcgacctgagaaccgctagtgccggacctgcactagctagccagggtctatttcctggaccagctttggcaagctggcaactacctcaagccaagttcctgcccgcatgtcaacagccccagcaagctcagctcctacctcactctggtccatttcggcctaatagctag

SEQ ID NO: 60807 - DNA, 1791 bp, Artificial Sequence
  Description of Artificial Sequence: Synthetic coding sequence
atgaagatgcagaagggcaacgttctgctgatgttcggcctgctgctgcacctggaagctgccacgaactcgaatgagactagcacctctgcgaatactggcagttcggtgattagctctggcgcatctactgcaactaattctggaagcagcgtcaccagttccggggtttctacggcaactatttcaggctcctccgtgacttccaacggggtgtctatcgtaacaaattccgagttccacacaacgtccagtgggatctccaccgctacaaactccgagttcagtacagccagttccggaatttcgatcgctaccaacagcgagtcaagcaccacgagttctggcgcaagcaccgccacaaactcagagagcagtactccttcttccggcgcttctaccgtgactaatagtgggtcaagtgtaacatccagtggtgcctccacggccactaattccgaatcgtctaccgtgtcaagcagggctagcactgctactaatagcgaatctagtacactgtccagtggcgcatcaacagccacgaactccgactccagcacaacgtctagcggtgcctcgactgcaacgaactctgaatcaagcaccacatcctcaggagctagcacagctacaaatagcgaaagcagcacagtttccagcagagcgtccaccgccacaaacagcgagagcagcacgacctcgagcggcgcttctacagccactaattctgagagtcgtacgacgtctaatggagccggaactgccaccaacagcgaaagcagcacaacttcatccggtgcctccacagctactaatagcgattcctccaccgtctcttctggagcctctacagctacaaactccgagagtagtaccacatcgtctggagccagtacggccacgaactcagagtccagcaccactagcagtggcgcaagtacagcaactaattccgactctagtactacaagcagcggggctgggactgctacaaattcagagtcaagcacagtgagctctggaatcagcacggtaaccaacagtgaatcttctacgccaagttctggggcaaacacagcaacaaatagtgagagctcaacaacgagttctggcgctaacacggcgaccaattctgagtcatcaaccgtctcctctggagcctctaccgcaactaattctgagagcagtacaacaagcagtggggtttctaccgcaaccaattcagaatccagtactaccagtagtggagcctccactgcgacaaactctgatagctctaccacgtcatcagaagcttctaccgcaacaaactccgagagttctactgtgtcatcaggcatctcgactgtgacaaactctgaatcgagtaccacctcttctggtgcgaataccgccactaattccggaagcagcgtcacctctgccggaagtggcaccgctgccctgacagggatgcacacaacctcccacagtgccagtacagccgtgagcgaagcgaagcccggtgggtccctagtaccatgggaaatatttcttattactctggtgagcgtagtggcggcagtcggactgttcgccggtctcttcttctgcgtgcgcaattctctaagtctccggaacacgttcaacacagcagtttatcatcctcacgggctaaaccacggcctgggcccaggccctggaggaaaccacggggcaccacaccggcctagatggagtccgaactggttctggcgtcgacccgtctcctccattgcaatggagatgtccggtcggaacagcggcccttag

SEQ ID NO: 60808 - DNA, 1434 bp, Artificial Sequence
  Description of Artificial Sequence: Synthetic coding sequence
atgctgttctcttgggtgaagaggcagcgtaagagtcagtactcatgcaaagggtctgagctgcggcatgcccgatcaagcgtgattaagaggaagacggctgacaagaatctgctcgctgaactctatcaatacagcaacttcaatagttcgaagcctaacaagctgcccaatggagtcgatttttgcgacatggtgggcaacgtcgtaagggccgagcgggattgtctctcaggcaaacatttctgctcagggagggaactggaaaagttcctcagctcgagttctcctagggccatatggctcgactccttttggtggatcttccatgaacggtatcagcccaacaaagaactgcagaataatctctttgaccgtatcgcccagcactacgcactcctcctcttcagagtgccaaagtctcattctgaagaagcactgctgaaacgtctaccctccctcctcagtaaagctgtctacaccagtttctgctgttgctttcctcagtcatggttcgatactcatgagtttaaatctgatatttgcaacacgatgagtctatggatttccggcacctacccctcacctcagtcctatgattcatgggattattctgagcttgatccggaacggttccggcgtgaggagctcatgctgtaccggcgtcggctaacgaagggcagggaattcagtctctttgcgggtaagcgcgcattcagccagaaacctgctcagtctcggaagttctatcatccccagagctctagcgcaaattccccaagcgagaaaacatccagcgctaagcaaaactctgaaaaatcacttcgaatgcaaaacaccgccaaggagcaccattgtcaaaccctggtcctgaaaaaacccacccaggaagttaagagaatttctgaagcacgtgagtgcgaaaatatgtttccaaagaaatcttgcgccgcatgcaagtcgcctgagctcactagtaacctatttaatatttatggtaaatcaccactcatcgtgtattttttgcagaattatgctagcttgcagcagcacgggaaaaacgtgctgatcgtgcggagggagaagacaacttcagccactgactgtacgcccacgtacactgatgtgatttccgaaaccctgtgtagtatgaagaagcggaaggacaacctgaaccaactgtaccaacaccactggaccgagtggaattacttcgacaagcacctgaaagagttgcaggataactttagcagggaaatgaaaaatattgatcctaaggcagcagataccaagaaggccaaccacatgttcattccgcctagcgccgtgaacgaagagtcgcccgataagaaaaccaaggagggaaaagggggagagggaaagcggagagagaccgaggttgaacacttctttcctctgacctcaaagccgtag

SEQ ID NO: 60809 - DNA, 546 bp, Artificial Sequence
  Description of Artificial Sequence: Synthetic coding sequence
atgagcgagctgcccttcaccatcgcaagcaagaggatcaaatacttaagaatccaactgacaagagatgttaaggacctctttaaaaagaactacaaaccactgctcaatgagattaaagaagacactaacaagtggaaaaatatcccatgctcctggattgggcgaatcaatattatgaaaatggccattttaccgaaagtaatttatcgattcaatgccatccctatcaaactgcccatgaccttttttacgaaattggagaagaccactctgaagttcatttggaaccaaaagagggcgctgattgcgaaaaccatcattagcaaaaagaataaagcaggcggaattactctccctgactttaagctctgctataaagcaacagtcactaagacggcctgttgctggtacctgaatcgggacatagaccagtggaatagaacagaggttagcgagattacaattcacatctataaccatttaatattcgacaagccagataagaacaaacaatggggaaaggatagtttgttcaataagtag

SEQ ID NO: 60810 - DNA, 1737 bp, Artificial Sequence
  Description of Artificial Sequence: Synthetic coding sequence
atggcagaagagacacagcacaacaagctggccgcagctaaaaaaaagctgaaggagtattggcagaagaattccccacgcgtgccggctggagctaaccgcaatcgcaagacgaatgggtcaatcccagagaaggccacaagtggcggatgccagccaccaagagattcggccaccggcttccacagagagggccctacatcaagcgcaactctgaaggacttagaatcaccctgtcaagaacgagccgttgtgttggattcacgctcagtggaaatttcacagttaaagaatacaatcaagagcctaaagcagcagaagaagcaagtggagcaccagctggaggaagagaaaaaggcaaacaataagaagcaaaaggcaaagcgtgtgctggaggtgcagattcagaccctcaatattcaaaaggaagaactcaataccgatctgtatcacatgaaacgctcactgaggtatttcgaagagaagtcgaaggatctcgccgtgcggctgcagcattccctgcagcggaaaggcgagctggaatccgtgttaagtaacgtgatggctacgcagaagaaaaaggctaaccagctgaaggagtccttccagcaggtccagctcgagcgcgacgaatacagtgagcatctcaagggcgaaagagctcgctggcagcagcggatgcgaaaaatgtctcaggagatatgcaccctgaaaaaagagaagcagcaggacatgagaagagtggaaaagctcgagcgctcactgtccaagctgaagaaccagatggccgaacccctgcctccggaaccacccgcagttccatccgaagttgagctgcagcaccttagaaaggagctcgagagagtggcaggtgagcttcaggcacaggtcaagaagaaccaaaggatctcactacttaatcaacgccaggaggagcggatccaggagcaggaagagaggctccggaaacaggaggaaagaattcaagaacagcataagagtctgcaacagctggcaaagccacaatctgtgtttgaagagccagaacatctggaagcagctagccagcagaatcaacagttaacagcacagttgtctctcatggcattaccaggcgagggtcacggcgaacacttagactccgaaggcgaagaagcgcctcagcccatgcccagcgtcccggaagatttagagtcccgggaggccatgtccagcttcatggaccatttaaaagagaaggcagacctcagtgagctagtgaagaaggaactgtgttttattcatcattggcgcgatcggagacaccagaagacccaccatctcctgtcagaacctggagggtgtgccaaagacgctgcgctggggggaggccaccaccaggctggggctcagggcggtgacgagggggaagcagccggtgcggcagccgacggcattgctgcctattctaactacaataacggacaccggaagtttctggccgcagcccacaatccagcagatgaacccggaccaggggcacccgctccacaggagttgggcgctgctgataagcatggggatttgagagaagtttccctgacgagctcagctcagggggaagctcgcgaggatcccctcctggataagccgactgcacaacctattgttcaggatcataaagagcaccccggtctcggttccaattgctgcgttcctctcttttgctgggcttggctcccccgtcggaggcggtag

SEQ ID NO: 60811 - DNA, 1824 bp, Artificial Sequence
  Description of Artificial Sequence: Synthetic coding sequence
atggccgaagagacacagcataacaaacttgcagccgcaaagaagaagctgaaggaatactggcaaaagaatagtcccagagttcctgccggagccaaccggaataggaaaaccaacggatccatcccagagaaggccacctctggcggttgtcagcctcctagggactccgccactggttttcatagagaaggacccacaagctctgctaccctgaaagaccttgagtctccttgccaggaacgagctgtcgtgcttgattccaggtctgtggaaatcagccagctcaaaaacaccattaagtcattgaagcagcagaagaaacaggttgagcatcagttggaagaggaaaaaaaagccaataacaagaaacagaaggccaaaagagttttggaggtgcaaatacagacactcaacatccagaaggaagagctgaatacagatctgtaccacatgaagcggagtctccgctactttgaagagaagagcaaggatctcgccgttcgtctacagcactcgctgcagcgaaagggggaactggagagcgtactctctaacgtgatggcaacacagaagaaaaaggcaaaccaactgtccagccggtcgaaagcccgaactgagtggaaactcgaacaaagtatgcgcgaagaggctttgctcaaggttcagttaactcagctcaaggagagctttcagcaggtgcaactggagcgagacgaatacagtgaacatctcaaaggcgaacgggcaaggtggcagcagagaatgagaaaaatgagccaggagatctgcactctcaaaaaggaaaagcaacaagacatgcgacgcgtcgagaagctggagcgatccctgagcaaactcaagaatcagatggcagaacctctgccacctgagccacccgctgtaccttccgaagtggaattacagcatcttcggaaagagttggaaagggtggctggtgagctgcaggcacaggtgaagaagaatcagcgaatttctctcctgaatcagcgtcaagaagagcggattcaggaacaggaagagaggctgagaaaacaggaagagcgtattcaggagcagcacaaaagcctgcagcagctcgctaaaccacagtctgtgttcgaagaaccagaacacttggaagctgctagtcaacagaaccaacaactgacagcacagctgagtttgatggccttgcccggtgaaggccatggagagcatttggatagtgaaggcgaagaggccccacagcccatgccaagcgtgcctgaggacttggagtcacgcgaagcgatgagctctttcatggaccacctaaaggagaaagccgacctctccgagctcgtcaaaaaggaattgtgtttcatccaccattggagggacaggcgtcaccagaagactcatcacttgctgtcagaacccggaggctgcgccaaggacgccgcacttgggggaggccatcaccaggccggagcccagggcggagatgagggggaggcagcaggggctgccgcagacggaattgccgcttatagcaactacaataacgggcatagaaaatttttagccgctgcccacaatcccgctgatgaacctggtcctggggcacccgcacctcaagagctgggtgctgcagacaaacacggcgacctccgagaagtatcattaacctcctccgcacagggggaggctcgggaagaccccttgctggataagcctactgcgcagccaatagtgcaggaccataaagaacatccaggccttggatctaactgctgcgtgcccctattttgttgggcttggttacccagaagacgtcgctag

SEQ ID NO: 60812 - DNA, 258 bp, Artificial Sequence
  Description of Artificial Sequence: Synthetic coding sequence
atgattcagcaggaggagatacgcaagctcgaagaagaaaaaaagcagctggaaggagagattatcgatttctacaagatgaaggccgctagcgaggctctgcagacacaactgtccacagacacaaagaaagataaacatcccgatccctatgaatttctgttgcttcgcaagattaaacacccaggatttaacgaagagctcaccatcactctgctgattatccaaaagcacgtggccggtctctcccatttttag

SEQ ID NO: 60813 - DNA, 1713 bp, Artificial Sequence
  Description of Artificial Sequence: Synthetic coding sequence
atgaatcactttcgcaagatggaagttatcaatctcacaactctcccaatgatcccagtcgacgagcaccttgcggtttccctagtggctaggaacaccatggtgaagacagtgagaaaagagctggaaaacaacccaccaagctgtcttataggctcaatgcaccaagtgaaccagaagatcgctgacataaatctacggacagaaccttccgccaactctctcgcaatcgagcgttttgagctggagaagaaagccctgagggagaagacaaggagttccccggaggacaaggtgaaacgccagagaaaatctcagtactcctgtaaggggagtgagctacggcacgcgagatcatctgtgattaaaaggaagactgctgacaagaacctgctggctgaactgtaccagtattccaactttaactccagcaagcctaacaagcttcctaatggggtggatttttgtgatatggtcgggaatgttgtcagggcagaacgggactgtctgtctggcaagcatttctgtagtggcagagagctggagaagtttctcagcagtagctccccaagggcgatctggctggactcattttggtggattttccatgaacggtaccagcccaataaggagctacaaaacaacttgttcgatcggattgcccagcattatgctctcctgctttttagggtgccaaagagccattccgaagaagctctgctgaaaagactgcccagcctgctgtccaaggctgtctatacgtccttttgttgctgcttccctcagtcctggttcgacacacacgaatttaagtctgacatctgtaatactatgagcttgtggatctccggtacctaccccagccctcagagctatgactcttgggactattccgagctagatccagagcgatttcgcagagaggagttaatgctctaccggcgtagactgacaaaaggaagggagttttcgctttttgctggcaaaagagcatttagccagaaacctgctcagagccggaagttctaccatcctcagtcatccagtgctaattctccgagcgagaagaccagttctgcaaaacaaaactccgagaagtccctgcgcatgcagaatactgccaaggaacatcattgccagacactggtgctcaagaagcctactcaagaggttaaacgcatcagtgaggccagggaatgtgaaaacatgttcccaaaaaagtcgtgcgccgcttgtaaaagccctgaactgacttccaatttgttcaacatttacgggaagagcccgctcatcgtctatttcctgcaaaattacgcatctctgcaacaacacggaaagaatgttctcatcgtgagacgtgaaaagactacaagtaccccggactgcacccccacctacaccgacgtgatttccgaaacactatgttcaatgaagaagaggaaagacaacttgaatcagctgtatcagcaccattggaccgagtggaactatttcgacaaacaccttaaagagctgcaggacaacttttcaagagaaatgaaaaatattgatccaaaagcagctgatactaaaaaagccaaccacatgtttatcccccctagcgcagtgaacgaagaaagtcctgacaaaaaaacaaaggaaggtaagggtggggagggaaagcgcagggaaacggaggtagaacatttctttccattaacgtctaaaccgtag

SEQ ID NO: 60814 - DNA, 366 bp, Artificial Sequence
  Description of Artificial Sequence: Synthetic coding sequence
atgaccggcgtgtgtgatcacgcacagttgatcttcgtgttcttcgttgaaatggaattcagatacgtcgtgcctgggtggagccagacgcccgagcttaggcaaagcgcgcacttgagactccagaagtgctgggattacagacccgaacctctttgcccctcaccctggctcatcgactcccatctcctgccggagtcattgcagggacatccattcgtatgcgtctgcgtgctcattagtccctacaaaaatacgtgccacacccgcctagggcctaccctgcttacctcattttatctcaaccatttgtacaaggaccccataagtaaatacagcacaattctgaggagctgcaacatctag

SEQ ID NO: 60815 - DNA, 474 bp, Artificial Sequence
  Description of Artificial Sequence: Synthetic coding sequence
atggcaccccaggcccaacctttgccactcctggggaaatgtaaagcctctaatgcgccaaccccccgacccccaagaagacccacgtggaaaaggaagtcagggaaggtctccacaactgtgccacagcctcaaactgtccctggctcatggccacgcgagcgcgaacggaagagggaaagggacagaataaactccttgctcctccagatcattgggcactccaagcaagccctaccgggtccaggggagcctgcacagaggttaacaccagcgccagcggaccccggtggaaggggagagcaggggggagtggctgcccaaggcgcaggactcgccgcaggaaggcgatcagctgtgggaccgtcaaagctctgtaatttggtgtcagcaagcggggctcttgccgtgtttagcataactgggatgtgtccaggccgagacgtgtccgatggtttgagaatgggtcagtag

SEQ ID NO: 60816 - DNA, 507 bp, Artificial Sequence
  Description of Artificial Sequence: Synthetic coding sequence
atgaaagggaataccaactctgcggtaaccccagccccaaaatgtcattggctggaggacctcccacccgtgagacggcaacatcgatgggtcctgtcacccctcagaccagcagcccttcgcaggctgcagctgctgtctgctgaccgtcggcctttacggcgaaccggggcacctcccgcacagggtcctgctcaacacccctggtcacgtgggccacccaggcgtccacccaggtctgtcaaattgtgtagagcccagcagtggcccgagactcgagcggaccccctgcctgctgggaccaggcagggggagtcaccactgcccagaggaagaagacccgacctcggccagggccgaccaagtgctagaaggctcccatccggtccttggacccaccgcactagaactagggtcaggggcagtctgagggccgcagcacggtcccagaacgcacgacgaggatctcccgcaagacaggcggcaaagccgaaattagaggcctag

SEQ ID NO: 60817 - DNA, 807 bp, Artificial Sequence
  Description of Artificial Sequence: Synthetic coding sequence
atgcgacgcgcaccagattgggtgcagagacaagcagctccgggatccaaatgtcgagtgccatggcagagacgtgagttcccctcaaggggcggacggaaacaacctcagcccggttcacgacagcgaaagcagaaccctatcagcttgcctggagaacagaacggtaggaaagccaccccccaggccggagcgttaggcgcactgggaattcgtggaatcccctcactgtgtcagtctgaaggcacaagatggtcacgcaggggtcgacggtgggccgaacgatgcccgccaggggttctgggagccggaaggtctctgagggctcagcggagccgccttcacagcagaccccctccactatcccccttgagaaagccaggaggaagcaatcagccccgatctgcagcagccgctggtactcatgaggcgtgccttcaggcttccggcaccactagaggctggaaataccacgcactgccattacgactcgacccaagaagcggacacgctggtagtgccctcaaggcgggaagctgccctcgactgggcggagggggacggggaagaggcgaggccggtgcacctagtagattttggcttccgaggagcttgcagcagttgttgccgaacgagcccaggaatgctgatgtccagaccctgcatcccaccccgtctcacactcgccgaggccagagaacaggcaagggagctagggggccacggttttggaagtccaagaattcccccgcaaacaggcagagctcagccctggatttttggatcaccacctctatctctttctag

SEQ ID NO: 60818 - DNA, 327 bp, Artificial Sequence
  Description of Artificial Sequence: Synthetic coding sequence
atgctacttacgtcacagaccgtctttttttttttctttttcttcctccggcagtcactgactcttctgtcatctttagagtgcaacggcaccatcagcgcacattgtattctgaggctcctgggttcatctaaaagccccgctagtgcttccttagtggctggggtgaccggtatgcatcaccacgcacgcctcatatttgtgtttcttgtggagatgggctttcaccatgttggacaggctggtctcgagctgctgacaagcgggaacccgccagcccttgcttcccagcgtgcggagatcaccggtgcttcttacagagcttag

SEQ ID NO: 60819 - DNA, 324 bp, Artificial Sequence
  Description of Artificial Sequence: Synthetic coding sequence
atgagacccaaaaccctgagaaactcagcggctcgcagccgaaaagaacctgggttcttgaaccaccatatggagggctcttgtctgcagctcggggagttgtcctctgtaggttattggtggccttttggccatccaggaccagcccagggtcacttacctgtagctgtatgggctagctgggtcgtggctggaatcagcatcgcactgtacttgccgccacatcctgaggggaggtatgaaggcccatttaaacgacacacaaagacctttcgatcagcccaatgtgcggattgccttgttcagtgccccgcatccccttag

SEQ ID NO: 60820 - DNA, 465 bp, Artificial Sequence
  Description of Artificial Sequence: Synthetic coding sequence
atgcgcgacatggaaagggctggtgtgacaagggtcagacagtctctgaagacgtgggtagagcatggccctttcagcggcgaccctggcttgccacgatctgtgagggtcgaactgctgaccctggtagcagggcctgcccgagggagatccggacacagacagccccctcctcaaccccagtccttaagacgaccattgtggctcagccatagtgatccgagtttaaagtttagaaccctggggctgcgggagggttctggcgctgaatgcctgcctcccggaactttcttgcctttctcctggtcattttccgccccagagctggcccacctctctaatgcgcgagccccatggattcccttgcctggagccttccagattcaacagaaacagattttcttctttttggaatctcggacgaaaagtggcatgaggagcagagggggtaaggattctaagtag

SEQ ID NO: 60821 - DNA, 723 bp, Artificial Sequence
  Description of Artificial Sequence: Synthetic coding sequence
atgaataagcagaggggcactttttctgaagtgagcctggcacaggatcctaagaggcagcagaggaaacctaagggaaacaaaagctccattagcggcaccgagcaagagatctttcaggtggaactcaacctgcagaacccaagcctcaatcatcagggcattgacaaaatatatgactgccagggactgctgccaccccctgagaagctgaccgccgaggtgctgggcattatttgcattgtccttatggctaccgtcttgaagactatcgtgctgatcccttttctcgagcagaacaacttttctcccaataccagaacacagaaagcaaggcactgtggccattgtccagaagagtggattacatactccaactcctgctactatatagggaaagaacgcagaacatgggaggaatcgcttcaggcctgtgcctctaagaattccagcagtttactgtgcatagataatgaggaggagatgaagtttctcgcgagtatcctgccttcttcatggatcggcgtcttccgtaacagttcacaccacccgtgggttaccatcaacggcctggcttttaagcacgagatcaaggacagcgaccacgccgagcggaactgcgctatgttgcacgtgaggggactgatatccgaccagtgtggatcgtcccgtattatcaggagagggttcattatgctgacaagattggtattaaattcttag

SEQ ID NO: 60822 - DNA, 732 bp, Artificial Sequence
  Description of Artificial Sequence: Synthetic coding sequence
atggagcgcaggtggctgagcctaagaagttccagttgctcagcacccaggctgaataccgcctggggcatgcgcagctctcctcaggccacctcatcttccagcaggaacgccgcttcgtttttacggctatttcgggctaccaggagagcaccaagcctgtgtaggctctccctttgtagatggcctgccacatccgttacacttgcgggaacgtttcctgcgctgttgagaagagacaatacgttatcctgcttctcttctcggaggctctcaagagtggcagcaagggcatcatcttggggtaagtcacccagccggtgctcatcttcaaagcctcggagtcctaatacccagtcgggaacttcccgatcctcttcccatctgacccggatcacctttcgttggagccggaggaaaacctgcaaggagaagggctcactcgcgggagaatggtccaagctgtcatcatgcaaatgtacctcatgcgactcccctggcggtaaagtgatatcacagatggcctcttcgctgagcgatagcacatccctttctagcaaaactgtttctggacgccctggctcaatgcagagagccagctccagtcggcctgcagcactgcggtgttcattttgtcgtagcttctccggggttcacagttggttgaggctgtcgtgcttccgtcggctctcactcacttcagacaggaaaacagcaaagaggttggagtag

SEQ ID NO: 60823 - DNA, 4041 bp, Artificial Sequence
  Description of Artificial Sequence: Synthetic coding sequence
atggataacaagcgggataaagcgaaggcgggtgcggctgccagaactcccgcagcacgagcccctggacttctcaccccaagaccacccggttctccccgtcccccaccccctgtcactcctgccgctcttagggttctgggagcagccggtgccgtaggtagaaagcccctcgcggaacgtgccggagggatcggcggtgcaaccattccggagtcagcacctcgagccggtcccactcgatccgcgggaacctcctccaggaatcccgcatcgcggcctccggctagtggacggggagagcgcgctcccccagctaagaacacttctcccggtccagtctcaagtcctggcagggcctcaggaacaacccggccaggccctctgggccaaaaaggcctccgcatctctgcagaagagaccgtagccaggggcaaggcaaccgaggctcccaaaagatcagccctaagcgcaggggctagacgtgataccagtggtcccactccaggcacaccttcacccgcaatggcgagacgatcacgggcagctggaaccgaagtaggtctccctcgtccagctccttctgcacgtccgcgaccccctaccgaaggcccacggaagtccgtttcttctgcgtccgaacacagcaccacagagcccagtcctgctgccaggcgcaggccgagcgctgggggtggactacagcgcccagccagtcgatccttgtcctcaagtgccacacctctctcctccccagctcgctccggaccaagtgcacgcggtacgcctcgcgcaccagcccacccctctcagcctaagcccaaaggattgcaggctctgcgaccccctcaggtcactcctcccagaaaggacgctgctcccgcactgggccctctgtcaagctcccctttagctaccccttccccatctgggaccaaggccaggccagttccccctcccgacaatgctgcgaccccccttccagctacactgccaccctccccgcctgttaccccgccaccgccagcagctctgcagtcacaagcacctcctacgctccctgctacccctcattcctcgagtcttacttgtcagctggcaactcccctccccttggctcctccgtccccctcagcccctccctcacttcagacactgccctctcctccagctacaccacccagccaggttcccccaacacaacttatcatgtccttcccagaggctggtgtgagctccttagcaaccgccgcattcgtagctagcgtcagccccagtgtgagcagtccacttcaatctatgccgccaacccaggcaaatcccgcactgccctctttaccaaccttgttaagcccactggccactcccccactcagcgccatgtcacccctgcagggccctgtgagccctgctacatctttagggaactcagccttccctctggcagcgctgccacagccaggtctgtccgctctaactacgcccccaccacaggcctccccctcaccgagccctccttcgttgcaagccactccccacacactggccaccctaccacttcaggattctcctctgttggcaacactgcctctgcaggccagccctagccctcttactaccgtgagccttcaggatccgcctctcgtttccccttctctgctggccagccctcctctgcaggcccctccacatccgcaggctccacctagcatgacaacccctccaatgcaggccccaccctcactgcagacaataccacctatccaggtccctcactctctcacctccccctctcttcaggctccgccttctcctctcgctttaagcagccttcaggccaccacatcactcggttcccctaccctgcaggcgacccacagcttcttaaccatgagtcctagacaaacgcaagcctccctaatttcgcctagcaggcccgcttctactcctcctgactcacccccactacaggcgccactgagcctgcccgcatcgcccccattgcagacaagcctttccccggcagtatcacctctcagctcccctcttactattcatcctctacaggccctgagcagcctggcatcccattcgccgcaggctccactttccagtctgatcatgcctcctctcgagacacagtcttccttagcaccgccatccttgcaaacacctcctgcctctctgaccactccaccgctagagaacctgcctagcttggctcccccacccctacagacggcctccgctccactcaccacaccacctttggaaaacctgcccagcctggcgcctccccctttacaaactgcctctgccccattgacgaccccacatctcgaaactcccccatgtcccgctccctgtccacttcaagcgcctccaagtcctttaactactccaccccctgagacccccagcagcattgccacacctccaccccaggctcctcctgcgcttgctagcccgccactccagggcctgccaagcccgcctctcagccctttagcaactccacctcctcaagctcctccggctctggcgctgccccctctgcaggcaccaccgagtcccccagcctcgccaccattgtctcctctggccacccctagcccccaggctcctaatgcactagccgtgcatttgctacaggcacccttcagcccacctcctagtcccccagtccaggcgccatttagcccccctgcgtcgcctcctgtatcgccaagcgcaacacccccttcccaggccccaccctccctggctgcgccaccattgcaggttcccccaagtcctcccgcaagtccccctatgagcccatccgcgaccccccctccccaagcacctcccccattggctgcaccccctcttcaggtccctccttcccctcccgcttcgccaccaatgagcccttccgcaactcccccacccagggtgcctccgctgctggccgctccccctcttcaggtaccgccaagccccccagcgtcgctgcccatgtcacctctcgccaaaccaccacctcaggctcctccagccctggctacgccccctctccaggccctacctagcccacccgcatcattccccggacaggctccgttctcccccagcgccagtcttcccatgagccctctcgctaccccgccaccccaagccccaccagtccttgcagcccctcttttacaggtcccaccctcacccccagcgtctcccacgttgcaggcccctaggcgcccacccactccaggacccgataccagcgtcagtggtccgcgtcttaccctggccctagcccctggcccaccccctcctccgagcagaagcccaagctcgaccctgagcggacctgacctggcaggacacagctcaagcgcgactagcactccagaagagctgcgcggttatgactccggccctgagggaggggcagccgcttctcccccaccagacgctgaattggcagcatgccatcctgccgcttggagtcgaggcccagcgcctcctttagcatttagaggtgctcctggagctccactgccatggcccccagcgacgggccctgggtctgcagatggactctgtaccatatatgaaacagaaggaccggaaagcgccacccctgccccaggagctctcgatccgggacccagtcccggaacctctggcggtaaggcagccgcaggtgctggggctggagcttcttcaagatctccgaagcaggcaaggctgggagaactgccactgggcgcactgcaggctagcgtcgtgcagcacctgctctccaggacattgctgctcgccgcagccgagggcgcagccggtggctcaggaggtggaccagggggtgcagaagggggtggagtgacaggcggagctcgggcagcactctcagacgctgaactcggcaggtgggcggaactcctatcccccctggatgaaagcagggcttctatcacctccgtcacgagcttttccccagacgatgtggcatccccacagggggattggacagtagtagaggtggagacattccattag

SEQ ID NO: 60824 - DNA, 2010 bp, Artificial Sequence
  Description of Artificial Sequence: Synthetic coding sequence
atgttcacgttgtctctgctgtcccgcggacatgggaagttaggacaggacaagcagaagttggaggtgtacttcgagcccgaggactatctaaactggaggtctccagaggactatgtgcctgttagtaagcctcaagacaaaaacaatgcctcacagcattcttggtccctctttctgccaaagaccttttccacgcggaagggggcactcattctttacagcgagggtttcgctatctccgcctggacgcccaaagaaaggcgcaaagggccatattgccctagaggcccatggagaaagttggacctggagctccataccctccaagacctcaaagaagccatactggcatatggccgacagcaaggagaacaggatcgcgcatggcagccgtacttgcactttcggtcacagctcgaatcacaggcacagcgtcagatccagccaggacactcggctaagagatacctgcgcggtctgttgcggacttggcccccagatgcaatgtataggctctggtgcgcaggctatatcaaggacagcgtgctgctccaggattcacagttgaatgtgcctaagaagttgaggcctcaacaggatctgtctggcgtgcctcccaagtaccaccttctgccagtgtttcctagcttttggatccaacagggcaagtcattcgagcagcgtcagcagggcttggacgaaggagaggccggtgccgcaggccacgtggaccagggtcctttggccaaaaatcacggcagtcaaggaacccgcttacccccaaggcggaaacagccctggcaggaggatgagacgcaggcagaggacacaagcatcgagaatcacttgtgcctgtacgctagtaaggagtcgtacaacgagaaaacacagcagacaagtcggaaagcatttggacatggcagaatagatcattcctggcttccctccgacaaatctcacattactttctgtggtggagccttccctaacaggaaagccgacctgtctgataagcagcggaacgtaaagctacacaaagccagatcatcccatctgctccaggtactgccagcagagcgcagcttgtttccgcctgttgctagcgcaactggctctcgaattatcactccaggggaggtgaaaaagaaaaaagcacccaaggccctaaaactgcccccaatttcagaagaaccgcctcgcgtgctcgagcccttgaagtcacagttcaaagctaacgaacctcccaccgaattgtttatcttgccagtcgagatccattaccataccaagcagccaccaaaagagaaagctcatcgaagaggcgcaccgcacccagagagtgaaccagaaagctctgaggagagcacgcctgtctggcggccacccctcaaacacgcctcactcgaaaccccttgggagctgaccgtccacctgcccgtggacgctagtagggacaccttatcgccccagggctcctcgtcactgccacccgctagtttgggaaacttgactttgaagggcagcaaagccagacacacacgggtgcactcacagggcaaaggtgtgtggaagggcgatgacgatgctccgcctcatgacgtggcgcctccgctggatttgctgcctccaattaaaggaaagaagtcccccgagagtcagaagggggtagatagcccccgaacgagtgatcacaatagcccaccttcgctgccaaatatgcgggtgccacgacgtgctctgcccgctgcacaagaggactcatctgaccccacattgggacattttttattggggccagacggagagaaagtttgtctgtccttacccggtcacacgcagaccgaagctctgccaagcggaaaggcgtacgaatcagtaaacagcaacatctcccacgaggaggaaggcccatccagccagcatttcctcaaggacatggctgccgcagcaagtgatcagggtaaagatgatgacctggagacttttagtcccaagaattcgctgtag

SEQ ID NO: 60825 - DNA, 411 bp, Artificial Sequence
  Description of Artificial Sequence: Synthetic coding sequence
atgaggcaagaagttgagggacgtggtcgtggaagtcatgagcttattatcactgacaaaaggtgcggcgtgtgcgggggtagcttgtcttgcatcgtgtacctatgtatcagccttaatttctccaggattaaaaaactcaagaagtacacgtggccagggcctactcgggactcccctaatgccagtctgcaaccaggacgcgctaagtttgcattttcccatgctagtcatacacctctccactcccaactcggcgctctccaaaccggaaaaccgcaggctctgctagcttcagctaacccgctctcccgcagtatggggccaccggaccaccatctgacaacgttaattctcatcagcctcgaaacaccgtttcctggcctgctgtcttcagggtgcttcccgtag

SEQ ID NO: 60826 - DNA, 381 bp, Artificial Sequence
  Description of Artificial Sequence: Synthetic coding sequence
atgcccactcagccaccgccaggcagcggcgaagtccgacagagtccctccggcaacggggcacttgttccaaccggacaagggtgccgcggtcgcaacctgccaattcagggctacagccccgagggacgtccaaccgcttcatcacagccggcaggagcctggcactccgaatcgtcccaaaagggtaccgcatgtcctctcgctctcgggagaggcggagcaagaggcggaggacagcgaaaatctagatccggggcacgagctcccggtcagcctgcagaggcagggttgagcgcatcaccagaaaagactagaccagagggaagagcggagcgcggaagggcggtggtgtggcagagccagcccaaccgctggtag

SEQ ID NO: 60827 - DNA, 699 bp, Artificial Sequence
  Description of Artificial Sequence: Synthetic coding sequence
atgttctgttgccttggctacgagtggctgtctgggggatgtaaaacatggcattccgcatgggtgattaatactctggcggaccaccgacatcggggaactgacttcggcggatcaccatggctactgattatcaccgtgtttttaaggagttataaatttgccattagtttgtgcacttcttacctttgcgttagtttcctcaagacgatattcccgagtcagaatggtcacgacggctcaaccgatgtgcagcagagagctcggcgatctaactgccgtcgtcaagagggaattaaaatagttcttgaggatattttcaccctgtggagacaggtcgaaaccaaagtacgggctaagatccggaagatgaaggttaccacaaaggtgaataggcacgacaagatcaacggcaaaagaaagaccgccaaggagcacctccgcaagttgtcaatgaaagagagagagcatggggagaaggaaagacaagtttcagaagctgaagagaatgggaaattagatatgaaggaaatacatacctatatggagatgtttcagcgggcacaagccctgaggaggcgggctgaggactattaccggtgtaagattacccctagtgccagaaaaccactgtgcaaccgatgcacgtataacctggttctgcccggaagcgagaagaagtactactcccatgcatag

SEQ ID NO: 60828 - DNA, 636 bp, Artificial Sequence
  Description of Artificial Sequence: Synthetic coding sequence
atggcctatttggggccatacccgacctcaagacagcccccacagatgagacttctgcctcataatagcctgcatagacactctagcattgttacaatggcctccttggaccccgctcctgcaagccaacctagcctgcaggccctgaactttcttaagtccactagtcctggacccgctccagccagctggtggccactccaggcgcagcctttgccacctgtgtcactctactcccctaatgtgtgcctgactgcagattcctcacgacctgcctctacaagtctctggacaccccaggccaagctgcctaccttccaacagctgctgcacacccaactgttacccccatccgggctgttccgtcctagtagttgtttcacaagagctttccctggtcccacatttgttagctggcagcctagccttgctcggtttctgccggtttcacagcagcccaggcaggcgcaggttctgccccatactggcttgtctacgagctcactttgcctgactgttgcctctcctggacctacaccagttcccggtcgacatctccgagcccagaatctgctaaaatcaaattctccaggacctccttcggcgtctaggtggcatcagcaggcccagttgtag

SEQ ID NO: 60829 - DNA, 654 bp, Artificial Sequence
  Description of Artificial Sequence: Synthetic coding sequence
atgacactgctgcccagactcgcattgagagaagaagctgctaggagaggcccacttagggcccctgtccagcccggactcggtgagagaagcccacagcgacatagggagccaaagcagggcagggtcagccagagatggcatccagcgcgtgaacccctcgcagcaaccgggtttctacacggattggggcatctaggacgggcagcacagtcacctcgggcatcctgctgcatcctttggcctggaacttggggggatccacttcgcacccttggcagatcacagcgggaggttcagactgtctgcactggggttagtggggaccaagctcagaaggaacaggatggccaccttctggcgtggcgtaagattctcctgccaggaaagaaaaccactccccgtggcattggactcggatgtcggaccctatcccaggccacagctcctttcttactgcagaactggggtagaaaaagggcgtttaggccaggctccgagaatccaagcagcggaacgagcagaccaagtagggggagactggaggcgaggtctagtggcctggacgaggcctgggaagcacagcgcctaaccggccacgggaggttcccctcgcccagaaaggagaaatccctccagaggggattagggtag

SEQ ID NO: 60830 - DNA, 336 bp, Artificial Sequence
  Description of Artificial Sequence: Synthetic coding sequence
atggtttccttgtgggtggaagacacatttctgagccctggcttcggatttgctcacgtcgcatgttctggactaggcatgaagcagaagcgaaaggccgcatcttcggaaccgacatccgaagtggcgttgggaggcagtgcaggacccgtgagatctcacctgcatcccgaaggcctattgtggtgctcgaggtgtttctttagtctgcgcccaaagggcaccgaaccccctgggcgaagcgctgggttgcaaggggctactgagcgttccggatggacttccgtgcaggctcaggcacaagcctgcgagaatcttgttcccgctgcagtttag

SEQ ID NO: 60831 - DNA, 5103 bp, Artificial Sequence
  Description of Artificial Sequence: Synthetic coding sequence
atgacctccgcgcagtgtcccgcactggcgtgcgttatgtcccctctacggttctggggtccctggccactgctcatgtggcagctcctctggctcctggtcaaagaggcacagccattggagtgggtgaaagacccactccaactcacgagcaatcctctcgggccacccgaaccgtggagctcccatagctctcacttccccagggagtcacctcacgctcctacgctgcccgctgacccttgggactttgaccacttagggcctagtgccagctccgaaatgcccgctcctccgcaagaaagtaccgaaaacctcgttccttttcttgacacctgggattcggccggtgaactgcctttggagcctgaacaatttctggcgtcacagcaggatctgaaagataaactctccccccaggagcggctccccgtgtcacccaaaaaactgaagaaagatcccgctcagagatggtctctcgccgagatcataggtattatccgacagctgtcgacgccacagtcacaaaaacagacactccaaaatgaatattcctccacagacaccccgtatccgggaagtctacctcccgagcttcgagtgaaaagtgatgaacctcccggaccttcggagcaggtgggtcccagccagttccacctcgagcccgagacgcaaaatccagagaccctggaggatatccagtcttcctcccttcagcaggaagcacccgctcaattgccccagttactggaagaggaaccctcctccatgcagcaggaagcccctgcgctgccacccgagagctctatggagtcacttacgcttcctaatcacgaggtgagtgtccaaccacctggagaggatcaggcatattaccatctgcccaatatcacagttaagcccgcagatgtggaggtgactatcacctcagaaccaactaatgaaacagagtcctcgcaggctcaacaggaaacacccattcaattccccgaagaagtggaaccttcggccacccaacaagaggcacctattgagccacctgttccacccatggagcacgagctcagcatatcggaacagcagcagcccgtgcagccatcagaatctccaagagaggtcgagtcaagtcctacccagcaagagacaccaggacaaccaccagagcaccacgaggtcacagtctctccacctgggcatcatcagacacatcatttggctagcccttccgtctccgtgaagccgcctgacgttcaacttactattgccgcagaaccatctgcggaagtgggtactagcctggtccaccaggaggctaccacccggctgtctggctccggtaacgatgtcgaacccccagctatccaacacggaggtccacctctcctgccagaatcatccgaggaagccggaccattagcggtacagcaggaaaccagctttcaatctcctgaacctattaataatgaaaatccctctcccactcagcaggaggccgctgccgagcacccgcagacagctgaagagggagagtcctccctgacgcatcaggaggccccagcacagactcccgaatttccaaatgtggtggtggcacagccacctgaacactcacaccttacccaggccacggtgcagccccttgatttgggttttactattacaccagagagtaagactgaggtagagctctctcccacaatgaaggaaactcccacccaacctcctaaaaaggttgtgccacagctgagagtctaccagggagtgacgaaccccacccctggacaggaccaggctcaacatcccgtgtcaccatccgttaccgtacagctgctagatctgggactgacaataacccccgagccaacaacagaggtggggcatagcaccccacccaaacggacaatcgtgagccctaaacaccctgaagtgacccttccccacccggaccaagtgcagacccaacatagccacctgactcgggctaccgtccaaccgctggacctaggttttaccatcacgcccaagtcgatgaccgaggtcgagccctctaccgcccttatgacgaccgctccccctcccggacacccagaggttactttgcccccatcagataaagggcaggcccagcactcccacttaactcaagcaacagtccaaccgctcgatctggaactgactattacaacgaaacctactacagaggtcaaaccctcccccacgaccgaggagacgagcacccaacctcctgacctcggcctggctattatacccgagccaacaaccgagaccgggcactccactgctctagaaaaaactaccgcccctcgccctgatagagtgcaaacgttacatagaagcttaaccgaagtgacaggaccacccacagagttggaaccagctcaagattctctggtgcagagcgagtcatacacacaaaacaaggctctgacggctccggaggaacacaaggcttccacttctactaatatctgtgaactgtgcacatgtggggatgaaatgctgtcatgtatcgatctgaacccagaacagaggttaaggcaggtgcccgtgcctgaaccgaatacacacaatggaacctttactatcctcaatttccaaggaaactatatttcttatattgatggtaatgtctggaaggcttactcttggaccgagaaactgattcttagggaaaacaacctgaccgaattgcacaaggacagcttcgagggcctactatctctgcagtacctggatctgagctgcaataagatccagtcgattgaacgccatacatttgaaccactgcccttcctcaagtttatcaatttaagctgcaacgtgattactgaactgagctttggaaccttccaggcatggcatggcatgcagttcttgcacaaattaatcttgaaccacaatcctttgaccactgtagaggacccctatctgtttaagctgcccgctcttaagtaccttgacatgggcactactctcgtgccgcttacaacactgaagaatatcctcatgatgacggttgagctggagaaacttatcctcccatcccatatggcgtgctgcctgtgtcagttcaaaaatagtatcgaggccgtgtgtaaaaccgtcaaattgcactgtaactctgcttgtctcactaacactactcactgtcccgaggaagcttctgtcgggaacccagagggagcatttatgaaggtgctgcaggcccgaaagaactacacatcgactgagctgatagttgaacccgaagaacctagtgatagtagcgggattaatctgtctggcttcggcagtgagcagttggacacgaatgacgaatccgattttatctccaccttaaggtacatactcccatacttcagcgccgtaaatctcgacgtgaagtctctgctcctgccattgatcaagctgccaactacgggcaactcattagccaaaatacagaccgtgggccagaataggcagagggtgaagcgcgtgctgatgggacccagatccatccagaagagacatttcaaagaagtgggaagacagtccatccggagggaacagggcgcacaagcgtctgtggaaaatgccgcagaggagaaacgactgggaagtccggcaccccgtgaggttgagcagccccatactcagcaggggcctgagaagctagccggtaacgccgtatatactaaaccaagcttcactcaggagcacaaagccgctgtgagtgtcttaaagcccttctctaagggagcgccatctacaagttcacccgctaaggcacttcctcaagtgagggataggtggaaagatctaacacacgcaatttcgaccctggaatcagccaaggctagggtgactaataccaaaacttctaaacccattgttcacgcacgaaaaaagtatcgatttcataagacgagaagtcatgtgacccaccgcacccctaaggtgaaaaaatcacccaaagtgcgcaagaagtcttacctctcacgcttaatgctggcaaatcggctcccgtttagcgcggctaagagcttgatcaattctcctagtcagggagctttcagtagccttggtgatttgtcacctcaagagaatccattcttggaggtttcagcaccaagcgaacactttattgagaaaaacaacaccaaacacaccaccgcgcgtaacgctttcgaagaaaatgacttcatggaaaacaccaacatgccagagggtactataagcgaaaatactaactacaaccatccgccagaagcagacagtgctgggacagccttcaatctggggcctacagtgaagcagactgaaacgaagtgggaatacaataatgtcggaacggatttaagtcccgagcctaagagcttcaattatcctctgctttcttctcctggcgaccagttcgaaattcagctaacacagcagctacagagccttatccctaataataatgtaagaaggcttattgcccatgtgattagaacccttaaaatggactgttctggaactcacgtccaggtgacctgtgccaaacttatctctcggacaggtcacttgatgaagctgctgtcaggccagcaggaggtgaaggccagcaagatcgagtgggacactgaccaatggaagatcgagaattatatcaacgaatcaaccgaggcccagtctgagcagaaggagaagtcactggaactcaagaaagaagtgcctggctatggctacaccgacaagctgatcctcgccctaatcgtgaccgggattttgaccatattgataattctattttgcctgatcgtgatctgttgccacaggcgcagcctccaggaggatgaggagggattttctcgcggtatttttaggtttcttcccaggcgcggttgttctagccgtcgagagtcacaggatggcctctccagttttggccagccgctatggttcaaagatatgtacaagcccctgtcagctaccagaattaacaatcatgcgtggaagctccacaaaaaatcgtccaatgaggataaaatcctgaacagggatcctggagactcagaggcccctactgaggaggaggagtctgaggcgctcccatag

SEQ ID NO: 60832 - DNA, 4908 bp, Artificial Sequence
  Description of Artificial Sequence: Synthetic coding sequence
atgacctcagcacagtgccctgccttggcttgtgttatgtctcctctccgtttctggggcccatggcccctactgatgtggcaactgctgtggctgttagttaaggaagctcagccccttgaatgggtgaaagacccccttcagttgaccagcaaccctctgggcccacctgaaccatggagctctcactcatcccactttccccgtgaatcaccacatgcacccaccctccccgctgatccatgggactttgaccatctgggcccttccgccagttccgaaatgcccgctccgcctcaagagtccacagaaaatttggtgccttttcttgacacctgggactccgccggtgagctacctctggagcctgaacagtttctagcttctcagcaagatctcaaggataaactaagcccccaggaacggctgcccgtgtcccctaaaaaacttaagaaggatccagctcagaggtggtctctggcagagatcatcggtataatcaggcagctgtccacgccccagtcacaaaagcagacgctgcagaacgaatacagttccaccgacaccccctatcccggatcgctacccccagagctgcgcgtcaaaagtgacgaacctcccggtccatccgagcaggtcggaccgagtcagttccacctggaaccggagacccagaatcccgaaactctggaggacatccagtccagctcccttcagcaggaggcacccgcacaactgccccagctgctggaggaggagccatcctcaatgcaacaggaggcgccagccttgcccccagagagctctatggagtctctgaccctgccaaaccacgaagtaagcgtccagccaccgggtgaggaccaagcttattaccaccttcccaatataactgtcaaaccagccgacgtagaggtgactattacctccgagcccacaaatgaaaccgaaagttcacaggcccagcaagagactcccatccaattcccagaggaggtcgagccctccgccacacagcaggaagcccctatcgaaccccctgtgccgcctatggaacacgaactgtccatcagcgaacagcagcagccggttcagccatcagaaagtccacgggaagtggagtcttcacccacacagcaggaaaccccaggccagccaccagaacatcatgaggtcaccgtgagcccacccggacaccatcaaacccaccatctggcctcccctagcgtcagcgtcaagccccctgatgtgcagctgacaatcgccgctgagccctcagccgaagtgggaacatccctggtgcatcaagaggccaccactagactgtctggcagtggaaatgatgtagaaccccctgctatccaacacggtgggcctccgctgctcccagagtccagcgaggaagccggtccccttgctgtgcagcaggagacctcatttcagagtcccgaacctatcaataacgaaaaccccagcccaacccaacaggaagccgcagctgagcacccgcaaacggccgaagaaggagaaagcagtttaactcaccaggaggcacccgctcagacacccgaattccctaatgtggtggttgcacagccccctgagcactctcacctcactcaagccacggtgcagcctttggacctgggatttaccattactcccgaatcaaaaactgaggtggagttgtccccaaccatgaaagagaccccaacacagcctcccaaaaaggtggtgccacagctgagagtctaccagggcgtaacaaaccccacaccaggacaggatcaagcgcagcacccagtttccccctctgtgaccgtgcagctgttagaccttggtttaactatcacccctgaacccaccactgaagtaggacattcgactccgcctaagcgaactatcgtttctcccaaacacccagaagtgactttacctcaccctgatcaggtgcagacccagcatagccacttgacaagggccaccgtgcagccactcgatctgggcttcacgatcacaccgaagagcatgacagaggtggagcccagtacagccttaatgacaacagctcctcctccaggccatccagaggttacgttgccgccatccgacaaaggccaggcacagcacagccatctgacacaggcaaccgtccagccacttgacctggagctaaccataacaaccaagcctaccacagaagtaaaaccgtctcctacaaccgaagagactagcactcagccaccggatctggggcttgccatcatcccggaacctaccactgagaccggtcatagtactgctctcgagaaaactactgcgcctaggcctgacagagtccaaaccttgcacaggtcactgactgaagtgaccggtccaccaacagagctggagcctgcccaggactctctggtgcagagtgaaagctacacacagaataaggcccttactgccccagaagagcataaggcaagcacatctacaaatatttgtgagttgtgcacttgcggcgacgagatgttatcttgtattgaccttaatccagagcaacggttgcggcaggtccctgtgccggaaccgaacactcacaacggcaccttcacaattctgaattttcagggcaactacatcagctatattgatggcaatgtgtggaaggcctatagctggacagaaaaactgatcctgagagaaaacaacctgacagagctgcataaagattcattcgaaggtcttctcagtctccagtacctggacctgagttgtaacaaaatccagtccattgaacgccacacatttgaaccactgcctttccttaagttcattaacctcagctgcaatgtgataactgagctgagcttcgggactttccaggcctggcacgggatgcaatttctgcataagttgatcctgaatcacaatcccttaaccactgtcgaggacccatatctgttcaagctaccagcgctaaaatatctggatatgggaactacgcttgtacccctgaccaccctcaagaatatcctcatgatgacagttgaactcgaaaaactcattttacccagccacatggcctgctgcctctgtcagttcaaaaactccatagaagctgtgtgcaagaccgtcaagctgcattgcaattctgcatgtctcacaaacacaacccattgccccgaagaggcctccgttgggaatccggagggcgcattcatgaaggttttgcaagcaagaaaaaactatacatccactgagcttatagtggagccggaggagccctccgactcatcagggatcaatttatctggttttggatcagagcagctggatactaatgacgagtctgacttcatttcaaccctccgatacatccttccctatttcagcgctgttaacctggacgtcaagagcctgctgctgccactgataaagctgccgacgactggcaactccctggctaagatccagactgtcggccagaacagacagcgggtcaagcgcgtgcttatgggacctcggtcaatacagaagcggcattttaaggaagtgggtcggcaatccatcagacgggagcagggggctcaggcttccgtggaaaatgcggcagaggaaaagcggctgggttccccagccccaagagaggtcgaacagccgcacacccaacagggacctgaaaaactcgccggaaacgccgtatacaccaaaccaagctttacccaggagcataaagccgctgtcagtgtcctgaagccttttagcaagggcgcaccctccacgtcatcaccagcaaaggcattgcctcaagttagagatagatggaaggatctgacccacgctatcagtaccctggaatccgccaaggctcgggtgactaataccaagaccagcaagccgattgttcacgcgaggaaaaaatacagattccacaagactcggtctcacgtcacccacagaactcccaaggtgaaaaaatcacctaaagtgaggaaaaagagctatctgtcccgacttatgttggccaatcgactaccattttccgcagctaaaagccttattaattccccaagccagggagccttcagttcactcggagatctgtctccccaggagaacccatttctggaagttagtgctcccagcgaacattttattgagaagaataacacaaagcataccacggcaaggaatgcctttgaagagaacgacttcatggaaaacactaacatgcctgaggggacgatctcagagaatactaattacaatcacccaccagaagcggatagtgctggcacagccttcaatttgggacccaccgtgaagcagactgagacgaagtgggaatacaataacgtagggaccgacctcagccctgagccgaagtcattcaactatcctcttctaagctctcccggtgaccagttcgaaattcagctcacccagcaacttcagtcgctgataccaaataataatgttagaagactgatcgcacatgtcattaggacattgaaaatggactgtagcggtactcacgtgcaagtgacttgcgcgaagctgatttccagaaccggtcacctgatgaagctgttgagcggacaacaggaagtgaaagcaagcaagatagagtgggatacagatcaatggaaaatcgaaaactatatcaacgagtccacagaagcacaaagtgagcagaaggagaagtccctagaacttaagaaggaagtacccggttatggctacactgataagctcattttggccctaattgtgactgggatcctgaccattcttatcatcttgttttgcctgatcgtgatctgttgccatcgtagaagccttcaagaggatgaggaggggttcagtcgagacagcgaggcaccaacggaagaggaagaatctgaggcgctcccatag

SEQ ID NO: 60833 - DNA, 1701 bp, Artificial Sequence
  Description of Artificial Sequence: Synthetic coding sequence
atgaagatgcagaaaggcaatgtgctgctcatgttcggtcttctgttacatctagaagccgctacaaacagcaatgaaacctccactagtgcgaataccggatccagtgtaatctccagtggcgcaagtaccgcaacaaattccggctcatctgtgacgtctagcggggtgtccaccgccactatttcgggtagttcggtaacaagcaacggggtgagcatcgtcaccaactcggagtttcacaccacctctagtggcatctccacggccaccaatagtgaattctccacggccagtagcggaattagcatcgccacgaactcggaaagctctaccacctcctccggggcttctacggctaccaactctgagtccagtactcctagctccggcgcaagtactgctacgaactcggagagctctaccctgagctccggcgcatctactgcaaccaactccgacagctccactacaagctctggcgctagtacagccaccaattccgaaagcagcaccacatcatcaggtgcatcaacggccacaaactctgaaagttccaccgtttcatctagggcctcaactgccactaactcagagagctctacgacctctagcggcgcaagcaccgccacaaactctgagtcacgcacgaccagcaacggtgctgggacggcaacgaacagcgagtcatccaccacctccagcggggctagtactgcaacaaactcagacagcagtactgttagctcgggggctagtacagctactaactcagagagttcaacgacctcttccggcgcatccacagcaaccaattccgaaagtagcacaacctcatctggcgcatcaacagctacaaacagcgacagcagcacaacctctagcggggcagggacagccaccaattccgaaagttcaactgtgtccagtggcatctccactgtgaccaactcagaaagtagtacaccctcgtccggcgcaaatactgcaacaaacagcgagagcagcaccaccagttctggggcaaataccgccaccaactcggagtcctcaacggtcagctctggagcctcgaccgctaccaattctgagtcaagtacaacatcatcaggtgtgagcaccgccacaaactccgaatcttcaacaaccagctccggtgcatccactgctactaattccgatagctccaccacctcctccgaggccagcaccgcaaccaattccgaatctagcaccgtgagtagcgggattagtacagtcaccaattctgaatctagcaccacctcctctggagctaacactgctaccaactcaggatctagtgttaccagcgccggttctggcaccgctgctctcactggaatgcacaccaccagtcatagcgcctcaactgccgtgtcggaggccaagcccggtggaagtctggtcccctgggagatcttccttattacacttgtctcagtcgtggctgcggttgggctctttgcgggactgtttttttgtgtgcggaatagtctgagcctgcggaataccttcaacaccgccgtctaccacccacatggcctgaatcatgggcttggtcccggacccggtggaaaccacggcgctccccatcggccacgatggtcccccaattggttttggcggcgacctgtgagttccatcgctatggaaatgagtgggagaaacagtggcccatag

SEQ ID NO: 60834 - DNA, 375 bp, Artificial Sequence
  Description of Artificial Sequence: Synthetic coding sequence
atgactcccaatgagcacccagcttttaaacatttgttcaataaggcccatcttgcacctccactgatccacctgaccctgagcggacacagcacctgttttcgtgagcacagggtaggcggaaaggtcacagaccagcaggatcctaaggcggaggaattctttctggtacaaaacaagatgaaaagtctcccgtgccttctgctcagtacccaaacgcgtcagcctagcgatttttctatcttttcccctcctttcctgccattctactccaccaaacctcccctgtccagctggcctgttctgaatgagttactgggcactcctcctcgcaggggagggggtagagcagaggggctcctcacctcccagtag

SEQ ID NO: 60835 - DNA, 816 bp, Artificial Sequence
  Description of Artificial Sequence: Synthetic coding sequence
atgttcctgtcagaagagaagctgcactatagaagcgcgaggactaaggagctggacgccctactgggagacctccactgcgagattcgagatcaagagacactactcatgtaccagttgcagtgtcaagtgctagcgagggctgccgtcctcacgcgggtccttgaccttgcctcccgtctggacgttttattagcactcgcctcagccgctagggactacggttactccagacctagatactctccgcaggtcctgggagtgcggatccaaaacgggaggcaccctctgatggagctgtgtgccaggacttttgtgcctaactcaactgagtgtggaggagacaaaggaagggtaaaagtcatcaccggtcccaacagcagtggcaagtccatttatttgaagcaagtggggttaatcacttttatggctctggtcgggagttttgtgcctgccgaagaggccgaaataggagctgtcgatgcaattttcacacggattcacagctgcgaatcaatcagcctgggactgtcaactttcatgatagacttgaatcaggttgccaaggcagtgaacaatgccactgcccagagcctggtcctcatcgacgagtttggcaaggggactaatacagtggacggccttgccttgctcgccgctgtgttgcgtcactggctcgcaaggggccctacctgcccacatatcttcgtggccaccaattttttgagtctggttcagctgcaattgctcccacagggaccgctggtacagtacttagattggcctcgcgtatcgggacaggaaggaggtgactag

SEQ ID NO: 60836 - DNA, 372 bp, Artificial Sequence
  Description of Artificial Sequence: Synthetic coding sequence
atgcagtctgaaaaaccacagggcttattcctgcagctcaaccctaatgcatctagtacagaaacccaactgctggtccctgcgctggaaagccgcgacaccctcccgccaacccattgcttcatggcgggtacagagtcacccctcgggaatccatggcccctgtcactccctcctccatgctggaccgggtgcgtcctgcctgcaccgaggggacaacggaagccgggtccactcggactgtccatcttcatctcattggggaataaaagacacagatcaggtaaccacgttgtaagagaaagtgaacaacccctatcacagggtaaccctcaccagggctggggcccagataccaggaagggaagatag

SEQ ID NO: 60837 - DNA, 102 bp, Artificial Sequence
  Description of Artificial Sequence: Synthetic coding sequence
atgcttaacttcgacatctccgccgctcctcgaaaaacggccctgatgaaactggagacaatcatacattccaagttgctccaggggcagaaaacaaagtag

SEQ ID NO: 60838 - DNA, 102 bp, Artificial Sequence
  Description of Artificial Sequence: Synthetic coding sequence
atgctgaatttcgatatttctgccgcacctagaaaaactgctttgatgaagctagagacaatcatccactccaagttattacaggggcagaaaaccaaatag

SEQ ID NO: 60839 - DNA, 2025 bp, Artificial Sequence
  Description of Artificial Sequence: Synthetic coding sequence
atgcagttctacaccctcaagattatactgaatcataatccactgacaaccgtcgaagacccatatcttttcaaactgcccgctctgaaatacctcgacatgggtaccacacttgtgcccctcacgactctcaagaatatactgatgatgacagtggagcttgaaaagctaatcctgccaagccatatggcatgctgtctgtgccaatttaagaatagcatcgaagccgtctgtaagaccgtgaaactacactgcaactcggcctgcctcacaaataccactcattgcccagaggaggcttccgttgggaacccggaaggcgctttcatgaaagtgttgcaggccagaaagaattacacctcgaccgagctcatcgtcgagcctgaagagccctcagacagcagcggcatcaatttgtcaggatttggatctgagcagttggacaccaacgatgagtccgacttcattagcactcttagatacattcttccctacttcagcgccgttaacctcgacgtaaaatctttgctgttgccactgatcaaacttcccacaactggaaattctctagcgaagattcagacagtaggccaaaataggcagagggtcaagcgggtcctgatgggtcccaggtcaattcagaaaaggcactttaaggaagtcggcagacagtccataagacgagaacaaggagcccaggcctccgtcgagaatgccgctgaggaaaagagactgggcagccctgcccctagagaggtggaacagccgcacactcaacaaggaccagaaaagctcgcaggcaacgccgtatataccaaacctagcttcacacaggaacacaaagcggcagtgagtgtgctcaaaccgttcagcaaaggagccccatccaccagcagtcctgctaaggctcttcctcaagttcgagaccgttggaaggacttgacgcacgccataagcacactggagtctgcaaaagcgagggtaacaaacacgaaaacctccaagccaatcgtgcacgctcggaaaaaatatagatttcataaaacccggagtcacgttactcataggactcccaaagttaaaaaatcacctaaagtgaggaagaagtcttacctatcccgactgatgctcgctaaccgcctgcccttctcagccgcaaagagtctcattaattccccgagccagggcgcattctccagcctgggcgatctgtccccacaagagaaccctttccttgaggtgtctgcacctagcgaacactttatcgagaaaaacaataccaaacataccacagcccgaaatgcctttgaagagaacgatttcatggaaaataccaatatgccagagggtaccatcagcgaaaacaccaattataaccaccccccagaggcagacagtgctgggaccgcatttaatctgggtccaactgtgaaacaaaccgagacaaaatgggaatataacaacgtcgggacggacctgtccccggagccaaaatccttcaactacccgcttctctcctctcccggtgaccagttcgaaatccagttaacccagcagcttcaatccctaatccctaataataacgtacggagactgatcgcccacgttattagaaccctcaaaatggactgttccggtgcccatgtgcaggtgacgtgcgctaaactcatctctagaaccggacacctgatgaagcttctgagcggacaacaggaggtgaaggcctccaaaatcgaatgggacaccgaccagtggaaaatcgaaaactacattaatgaatcaactgaggcgcagtctgagcaaaaagagaaatctctggagttaaagaaggaggtgcctggctacgggtatacagacaagctaatcctggccctaatcgtgaccggcatactgaccattctcatcatcttgttctgtctcatcgtgatatgctgccatcgcagatccctgcaagaagatgaggaagggttctcccgggatagcgaggcccctaccgaggaagaggagtctgaggctttaccatag

SEQ ID NO: 60840 - DNA, 4908 bp, Artificial Sequence
  Description of Artificial Sequence: Synthetic coding sequence
atgacgtccgcccagtgtcctgcactggcctgcgtgatgtctccactgcgattttggggaccatggcctttgctgatgtggcagctgctgtggcttttagtaaaagaagcgcagcccctggagtgggttaaagatcctctgcaactcacttcaaatcctctgggccctccggaaccttggtcgtctcactccagccattttcctagagagtcaccacatgctcccaccttacctgctgatccttgggatttcgaccacctcggtcccagcgcgtccagtgagatgccagcaccaccgcaggagagtactgagaatctggttccatttctggatacatgggacagcgcaggggaacttcccctggagcctgaacagtttctggctagtcaacaagacctgaaagataaactcagtccgcaggaaaggctaccggtaagccctaagaaactgaaaaaagaccctgcccagaggtggtctctggccgaaatcatcggcatcatcaggcagttgagtactcctcagagccagaaacagactttgcagaacgagtacagcagtacagatactccgtaccctggcagtctgccgcctgagctgcgtgtaaagtctgatgaacctccaggtccttctgagcaggttggtccctctcagttccacctggaaccggagactcagaatccagagacactcgaagacatacagtctagctccctgcagcaagaagctcctgctcagctgccacagttattggaggaggagcctagttcgatgcagcaggaagcccctgccttgccaccggagagttcgatggagtccttgaccttgcccaatcacgaggttagcgtgcaaccacccggagaggaccaggcctactatcacttgcctaacattaccgtgaagccggctgatgtggaagtcacaatcaccagtgagcctaccaatgagactgagtcttcacaagctcaacaggagacccctattcagtttccagaggaggtggaacccagcgctacacagcaggaggctcccatcgaaccgccagtgcccccaatggagcatgaactcagcatttctgagcagcagcagcccgtgcaacccagcgaaagcccaagagaagtggagtcctccccaacccaacaggaaacccccggtcagcctcccgagcaccatgaggtgacagtgagcccacctgggcatcatcagactcaccatctcgctagcccctccgtcagtgttaaaccgcctgacgtccagctgacaatagcagctgagcccagcgctgaggtgggaacttcccttgtgcaccaagaagcaacaacccgcctgagtgggtcaggaaatgatgttgagccacccgcaattcagcacgggggacctcctcttctgcccgaaagttctgaggaggccggtcccctcgccgtgcaacaggaaacttcgtttcagagtcccgagcccatcaacaacgagaaccccagtcctacacaacaggaggcagcagcagagcaccctcagaccgctgaagagggtgagtcgagcctcacacaccaggaggcccctgcacagactcctgagttccccaacgtggttgtggctcagccaccagagcatagccatctcacccaggcgacggtgcagcctctcgatctcggctttacaatcacgcctgaaagcaagacagaggtcgagttgagccctaccatgaaagaaacacccactcagcctccgaaaaaagtggttcctcaactacgggtgtatcaaggagtcacaaaccccacacctggacaggaccaggcacagcatcctgtgtcaccctcagtgactgtgcagctcctggatctgggtttgaccatcacgccagagcccacgacagaggtgggccatagtactcctcctaagcggactatcgtgtcccctaaacatccagaggttactttgccacacccggatcaggttcagacacaacattctcatctgactagagctacagtgcagccactggacctgggcttcacgatcacacctaagtctatgacagaagtcgagccttccactgccctgatgacaacagccccaccccctggtcaccccgaagtcacactgcccccaagcgacaaaggccaggcgcagcactctcacctcactcaggccacagtacagcctcttgatttggagctcaccatcaccacgaagcccacaactgaggtgaaaccctcccctaccacggaggagacgtctactcagcctccggacttgggcttggctataattccagagcccaccactgaaactggccactccacagccctcgagaagacaacagcccctcgccctgatcgagtccaaacgctccatcgctccctgactgaggttaccggccctcctacggagttggaacccgcacaggactcactggtacagtcagaaagttatacgcagaataaggcattaaccgctccagaggagcacaaggcatccactagtacgaatatttgtgaactctgcacatgtggggatgagatgttaagctgcattgatttaaacccggagcagaggctgcgccaggtccccgttccagagccaaatacacataacggcacctttaccatcctgaatttccaggggaattacatcagctatatagatgggaatgtttggaaggcctattcatggacagagaaactaatcctccgggagaataatctgaccgagttacacaaggactcattcgagggattattatcactccagtatttggacctgtcttgcaacaagatccagtctatagaaagacacactttcgagccgctgccattcttaaagtttatcaatctaagctgcaacgtaattactgaactgtcgttcggaaccttccaggcctggcatggcatgcagttcctgcacaagctcattcttaatcacaatccacttacaaccgtggaagacccatacttgttcaagctgcctgccctcaaatacttggatatgggtaccaccctggtgcctttgacaacactgaaaaacatcctcatgatgacggtcgagctggagaagctcatcttgcccagtcacatggcctgttgcctctgtcagtttaaaaatagtatcgaggctgtgtgtaagacagtgaagctgcactgcaacagcgcttgtttgaccaacacaacccactgcccagaagaagcaagtgtggggaacccggaaggtgcgtttatgaaggtccttcaggctcgcaagaactatacttctactgaactcattgttgagccagaagaaccttcagattcatctgggatcaatctgtctggctttggatcagagcagttggatacaaacgacgagtctgacttcatctcaaccttgcgttacattcttccctatttttcagctgttaacctagatgtgaaatcccttctgcttcctctcattaagctcccgacaaccgggaactcactcgcaaagatccagacagtgggtcaaaatcgccagagggtgaaaagggtgctgatgggccctaggtccatccagaagaggcatttcaaagaggtgggccgacagtctatcagaagagagcagggcgctcaggcaagcgttgagaatgccgcagaggagaaacgcctgggcagccccgctcctagagaagtggagcagccgcatacacagcaaggacccgagaaattggctggtaatgcagtgtacactaagccaagctttacgcaagagcacaaggccgctgtgtcagtgctgaagcctttcagcaagggcgcacctagcactagctctccagctaaagcccttcctcaagttcgggacaggtggaaagatctgacacatgcaatcagcacactggaaagtgcaaaagctagggtgactaatactaagaccagcaagccaattgtacatgcgagaaagaagtatcgatttcacaaaaccagatcccatgttacccaccgcacgcccaaagttaagaagtctccaaaagtccggaagaaatcatacctttcaagactcatgcttgcgaaccggctgccattctccgctgccaagtccctcatcaactcaccatctcagggggcattttcttcccttggtgatctgtctccccaggagaacccgttcttggaagtcagcgctccgtctgagcacttcatcgagaaaaataacaccaagcacactacagctcggaatgcatttgaggagaacgatttcatggagaataccaacatgcccgaaggtacaatcagtgaaaacactaattacaatcaccccccagaggccgatagtgctggaaccgcatttaacttgggtccaactgtaaagcagaccgagactaagtgggaatataacaatgtgggcaccgatttgtccccagagcctaagtcttttaactatccactgctgtctagtcctggtgaccagtttgagattcagctgacacagcagctgcaaagcttgataccaaacaataatgtcaggagactgatcgcacatgtaataagaacgttaaaaatggactgctcgggcgctcatgtccaagtgacctgtgctaagttgatctctcgtactgggcacttaatgaaactactatccggccagcaggaggtaaaagcttctaagattgagtgggatactgaccaatggaagatagaaaactacattaatgagtcaaccgaagcgcaaagtgagcaaaaagaaaaatccctcgagctcaagaaggaagtccccggatacgggtataccgacaaattgattctggcactaatcgttactggcatcctgaccattctaattatccttttctgccttattgttatttgctgccatcggagaagcctacaggaagatgaagaaggcttttctagggacagcgaggcacctactgaagaggaggaaagcgaggctctcccctag

SEQ ID NO: 60841 - DNA, 2262 bp, Artificial Sequence
  Description of Artificial Sequence: Synthetic coding sequence
atggagtttcacagggtggcacaggcaggggtcgagctgctgtcatcaggcgaccctcctgctagtgcttctcagtctgtcggcataattggggtaagtcattgtacctggcacattaattttcagggtaactatattagctacatagatggcaatgtctggaaggcttacagctggacggaaaagctcatcctccgcgagaacaacctgaccgagttacacaaagattcgttcgaaggcctgctgtcccttcagtatcttatcctgaatcataacccgttaacaacagtggaagatccatacctgtttaaactccctgcgttaaagtatctcgatatggggacaacgctggtgccattaactacgctgaaaaatatcctgatgatgactgtggagctcgaaaagcttatcctgccctctcatatggcatgttgcctctgtcagttcaagaactccatagaggctgtgtgtaaaaccgtaaagctgcattgcaattccgcttgtcttaccaataccacccactgtccggaggaggcctctgtggggaatccagagggcgctttcatgaaggtgttgcaggctagaaagaactacacttccacagagctgattgtcgagcccgaagaaccctcagattcaagtggaataaatctgagcggatttggaagcgagcagctggacacaaacgacgaaagcgactttatcagcacgctgagatatatccttccatattttagcgccgtcaatctggacgtcaagagtctgctactccccctcatcaaattgccaaccaccggcaattccctggccaagatccaaaccgtcggccagaacagacagagagtgaagagggttttaatgggtcctcggtcaattcagaagcggcactttaaagaagtgggccgacagtccatccggcgtgaacagggtgcgcaagctagcgttgaaaacgctgcagaagagaagaggctgggctctcccgcacccagagaagttgagcagccccacactcagcagggtcccgagaagttagccggaaatgccgtgtatactaagccttctttcacacaggagcataaagcggcagtttctgttcttaaacccttctcaaagggagccccttctacctctagtccagctaaggcgctcccacaggtcagggacagatggaaggatctgactcatgccataagcacactggaaagcgctaaagctcgggtgacaaacactaaaacctcaaaacctatagtgcacgctagaaagaagtatcgctttcataaaacacgctcgcacgtaactcaccgtacgccaaaagtaaaaaagtctcccaaggtcaggaagaagtcctacctctctaggctgatgcttgccaataggctaccattctctgccgcaaagtcgctgattaatagtccaagtcaaggagcattttcaagcctcggtgatctgagtccacaagaaaatccctttcttgaggtgagcgccccttctgagcacttcatcgaaaaaaacaacacaaagcataccaccgcgcgaaacgccttcgaagagaacgacttcatggagaataccaacatgcctgagggtactatcagcgaaaacacaaactacaaccatcctcccgaggccgacagcgctggtactgctttcaacttgggtcccaccgtgaagcagaccgaaactaaatgggagtataataatgttgggactgatttgtcccccgaaccgaagagctttaactatcctttactcagttctcccggtgatcagtttgagattcagttgactcaacagctgcagtcattgattccgaataacaacgtacgaaggcttatcgcccatgttatccgaacccttaaaatggattgctcaggagcccacgttcaggttacctgtgccaagctgatatcaagaacaggacacctgatgaagctcctctctgggcagcaggaagtaaaggcaagtaaaatcgaatgggatactgaccagtggaaaatcgaaaattacattaatgagtctactgaagcacagagtgagcagaaggagaagtccctcgagctaaagaaggaggtgcccggatatggatatacagacaaactgattcttgctttgatagtcaccggcattctcacaattctcattatacttttttgtctgattgtgatctgttgtcacaggcgctctctacaggaggacgaggagggtttctcaagagatagtgaggcccctactgaagaagaggaaagcgaagccctcccctag

SEQ ID NO: 60842 - DNA, 372 bp, Artificial Sequence
  Description of Artificial Sequence: Synthetic coding sequence
atgcagtcggaaaagccccagggcctttttctacagttaaacccaaacgccagctcaactgaaactcaactcctggtgccagccttggagagcagggacacactgccgcctacacattgctttatggctggaacggaaagtccgctggggaatccatggccactgagcctccccccaccctgttggactggatgtgtgttgccagcaccgcgtggtcaacgcaagcctgggccattgggcctgtccattttcatttcgctgggcaacaaacgccacagaagtgggaaccacgtagtgcgggagtcggaacagcctctaagccagggtaacccacatcaggggtggggaccagacacgcggaaagggcgatag

SEQ ID NO: 60843 - DNA, 876 bp, Artificial Sequence
  Description of Artificial Sequence: Synthetic coding sequence
tctgcaggcggtggaggggctggaagtaggctacaggccgagatgttgcaaatggatcttattgacgctaccggagactcaacccccgacgagccggacgttcacttttccaagaagtttttgaacatcttcatgtctggacgatcccgttcctctagcgctgaaagctttgggctgttcagctgtataattaatagggaagaacaagaacagacccatagaacaatttttaggtttgtacctcgccatgaagacgaaccagagctcgaagtggatgatccactcttagttgagctgcaggccgaagactattggtacgaagcttacaacatgcgtaccggagccaggggcttctttactgcgtattacgccattgaagttacaaaagagcccgagcacatggccgctctcgccaagaacagcgactgggtggatcagtttagagtgaaattccttggcagtgtccaggtgccctaccataagggcgacgtggtactgtctgcggcaatgcagaagatcgcaacaactagaaggcttaccgtgcatttcaacccacctagtagttgcgtgttggagatttcagtgaggggcgtgaaaatcggtgtgaaagctgacgactcccaggaagctaagggcaataagtgtagccacttctttcaattaaaaaatatcagcttccgtggctaccaccccaagaataacaaatacttcgggtttattacaaaacacttggctgaccaccggttcgcgtgtcatgttttcgtctccgaggatagcacgaaagcccttgctgagtctgtcgggcgtgctttccaacagtttcacaaacagttcgtcgagtatacctgcccaacagaggatatatatctcgaatag

SEQ ID NO: 60844 - DNA, 2055 bp, Artificial Sequence
  Description of Artificial Sequence: Synthetic coding sequence
atggcctgtttgggatttctgttaccagtcggcttcctcctacttattagcacggtcgccggtggaaagtatggcgttgcgcacgtcgtgagcgaaaattggtcaaaggactactgcatcctgttcagctccgattatatcacactcccacgtgacctgcatcacgcccctctgcttccactgtatgatggtacgaaggccccttggtgccccggagaggactctccccaccaggctcagctgcgcagcccatctcagaggccgttacggcaaacaacggcgatggttatgcgagggaattgtagttttcacaccaagggttggctcgcccagggccaaggtgcacatggccttctgatagtcagcagggtctctgatcagcaatgctccgacactactctggctccacaggatccccgtcagcctttagccgatttgaccatacccgtcgcaatgctccactatgcagacatgctggacattctgtcccatacacgtggagaagccgtggtcagagtcgccatgtacgcacccccagagccaatcatcgactacaatatgttagtaatttttattttggctgtcggaaccgttgctgcaggtgggtactgggccggactaaccgaggctaacaggctgcagcggaggcgtgcgcgaagagggggtggccctgggggtcaccatcagctgcaggaggctgccgctgctgagggagctcaaaaagaggacaatgaagatataccagttgattttacaccagcaatgaccggggtggtggtcacactcagctgctcattaatgctcctcctatacttcttttatgaccactttgtctacgttaccattggaatctttggtttgggtgcgggtatagggttatacagctgtctaagtcctctggtctgtaggctgtcacttcggcaataccagcggccaccccattctctgtgggcatccctgccgctgcctcttttactcctcgcctctctatgcacaaccgtaatcatcttttgggtggcatacaggaatgaggatagatgggcatggctgttacaggacactctgggaattagttattgcctgtttgtcctccaccgcgtgcggctgcccaccctgaaaaactgctcttccttcctgctagccctgttggctttcgacgtatttttcgtctttgtgactccgttttttaccaaaactggcgaatccattatggcccaggtcgctcttggcccagccgaaagctcatcccacgagcgacttcccatggtgctgaaagttccgaggcttcgagtgagtgcactaaccctgtgcagtcaacccttctccattctcggctttggcgatatcgtcgtgcccggattcctggtggcttactgttgtccgttcgacgtgcaagtatgttctcgccaggtgtactttgtggcgtgcactgtggcgtatgcagtcggactcctggtgacattcatggcgatggtcctgatgcagatgggccaaccagcgttgctttacctcgtgagttcaacactcctgacatccttggcagtcgctgcatgcaggcaggagctcagccttttttggactggccagggtcgagcaaagatgtgtggtctgggttgtgccccttcggccggaagcagacagaaacaggaaggtgccgctgacgcccatacagcctccactctggagaggggcacttcccgaggagcgggagatcttgattccaacccaggtgaagacaccaccgaaatagtgaccatctcagagaacgaagccactaaccccgaggatcggtccgatagcccagaaggatggtctgatgcccacttggatccgaacgagcttccgttcattccgcctagagcttcagaagaactcatgcctctaatgcccatggccatgctcattcctctaatgccacttatgcctcgcccaagcgagttgggacacgtgcacgcccaggcccaggctcacgagacagggttgccctgggccggtctccacaaacggaagggcctgaaggtcagaaagagcatgagtacccaggcccctctttag

SEQ ID NO: 60845 - DNA, 372 bp, Artificial Sequence
  Description of Artificial Sequence: Synthetic coding sequence
atgcaatctgaaaagccacaggggctgttcctgcaactgaaccctaacgcgtcttcaacagaaacacagctgctggtgcctgctttagagtcacgggataccttgcccccaactcactgcttcatggctggcacggagtccccactgggcaacccctggcctctgtctctcccaccaccttgctggactggctgtgttctccctgccccacggggacagcgcaagcccggaccactgggcttaagtatttttattagcctggggaataagaggcatagatctgggaaccacgtggtgcgggagtctgaacagccgttatcacagggaaatccccaccaagggtgggggcctgatacgcggaagggacggtag

SEQ ID NO: 60846 - DNA, 2025 bp, Artificial Sequence
  Description of Artificial Sequence: Synthetic coding sequence
atgcaattctatacactgaagatcatcctcaatcataaccccctgactaccgtggaggatccgtatctttttaaactgcctgccctgaaatacctggacatggggaccactctcgttcctcttacgacccttaagaacatcctcatgatgactgtcgagcttgagaaactgatcctgcccagccatatggcatgctgtctgtgtcagttcaagaactctattgaagccgtatgtaaaaccgtcaagcttcactgcaactctgcctgcctgacaaacactatccattgcccagaagaagcctctgttgggaatcctgaaggggcattcatgaaagtactgcaggctcgcaagaactatacaagcacggaattaattgtggaacccgaagagccttctgactcatccgggattaatctgtcaggttttggaagcgaacaactcgatacaaatgatgaatcagatttcattagtactctccgctatatcttaccctactttagcgctgtcaatctggatgtgaagtctctgctgctgcccctgatcaagttgcccaccaccggaaatagcctggccaaaatccaaacggtcggtcagaacagacagagggtcaagagagtcctcatgggccctagaagtattcagaagcgacactttaaagaggtgggccgtcagtccattcggagagagcagggtgcgcaagctagtgtcgaaaatgccgctgaggaaaaaagactgggctcccctgcaccccgagaggtggaacaaccccacacacaacagggtccagagaaattagcagggaacgctgtgtatacaaaaccctccttcactcaggaacataaggccgcagttagtgtcctaaaaccttttagcaagggtgcgccatccacaagctcacctgctaaagctctcccccaggtccgcgaccggtggaaagacctgactcacgctatcagcattctggaatcggctaaggctagagtgaccaataccaaaacaagcaagcccatagtgcatgcacggaaaaaataccgtttccataagacaaggagccatgtcacccatcgaactccgaaggttaaaaagtccccaaaggtacggaagaagtcatacttatccagactgatgttagccaatcgactccccttttccgcggctaaaagtttaatcaattccccctcccaaggagccttcagctccctaggagacctctcccctcaggagaatcccttcttggaggtttctgccccatcagaacacttcattgaaaaaaataacacaaaacatactactgccaggaacgccttcgaggagaatgatttcatggagaacaccaacatgcccgaaggcaccatttcagagaacaccaattataatcatccaccggaagcagactccgccggaactgcatttaacctgggaccaacggtaaaacagacagaaacaaaatgggagtataacaacgtaggcacggaccccagtcccgagccaaagtctttcaattatcctcttctgtcaagtcctggcgatcagttcgaaattcagttaacccaacagctccagagtcttattcccaataacaacgtgcgcaggctgatcgcacatgtgattcgcactctgaaaatggattgttccggtgcccatgtgcaagtaacgtgcgctaaactaatatcacgtacaggtcacctcatgaagctgttaagtggacaacaggaagtgaaggctagcaaaatcgagtgggatacagaccaatggaaaatcgagaattacatcaacgaatccacagaggcgcagagtgagcagaaagaaaagagcttagagctcaagaaggaagtccccggatacggatacaccgataagttgattttagcccttattgttacaggcatcttgaccattctaattattctgttctgtctgatcgtaatatgctgccacaggaggagcctgcaggaggacgaggaagggtttagccgtgattctgaggctccaactgaggaagaggaatccgaggctttaccctag

SEQ ID NO: 60847 - DNA, 393 bp, Artificial Sequence
  Description of Artificial Sequence: Synthetic coding sequence
ggcgctaggtcccctggcagcacccaccagggctctctcgcaagcggcgtgttgccaatcaagtgctcccacgtggaattcggcatgtggaaaggaggaagatctcatccgtttctgccacactcttctcgctgcgcaggaagtggcggacaactggatagtattttgccccaccaaagcccagcttggggtccttggggctgcaaggaccttagctctggcttcccctctttcctcaccagttcaatattgtggaaatcagccgtggtgagagagccccatatttcccctcaccaggcccctccctacaaaacaagcgactgcatccgagcaatctctttcccagtctgcacaattcaccaggaaattatgagggggcattggcataaatag

SEQ ID NO: 60848 - DNA, 876 bp, Artificial Sequence
  Description of Artificial Sequence: Synthetic coding sequence
tcagctgggggaggcggtgccggttcgcgtttgcaggcagagatgctccaaatggatcttattgacgccactggtgactctactcccgacgagccagacgttcacttctcaaagaaatttttgaacatctttatgtcgggcaggtctcgcagtagttccgcagaaagctttgggctttttagctgtatcattaatcgcgaagaacaggaacaaacacatagaactattttccgttttgtccctcggcatgaagatgagccggaactcgaagtggacgacccgctccttgtggagctgcaggccgaggattattggtacgaggcatataacatgcgcacaggggcacgcggtttctttactgcctactatgccatcgaggtgacaaaagaaccagagcacatggccgctctggctaaaaactctgactgggttgaccaattccgtgttaagttccttgggtcagtgcaagtgccgtaccacaagggagatgtcgtgttaagcgctgcaatgcagaaaattgcaaccacgaggagacttactgtccatttcaacccacccagttcttgcgtccttgaaattagtgtcaggggggtgaaaattggcgtaaaggccgacgacagccaggaggcgaaggggaacaagtgctctcatttcttccagttgaagaacattagtttcagaggctaccatcccaagaacaacaagtacttcggctttatcacaaagcatcttgctgatcatcgctttgcttgccatgtatttgtgagtgaggatagtaccaaggccctggctgagtccgtaggcagggcattccaacagttccataagcagttcgtggagtacacttgccccactgaagacatatacctggagtag

SEQ ID NO: 60849 - DNA, 1593 bp, Artificial Sequence
  Description of Artificial Sequence: Synthetic coding sequence
atgtcgctgaagtggacctcagtgtttctcctcattcaactgagctgctacttcagctctgggtcatgcgggaaggtcttagtatggcctaccgaatactctcactggattaatatgaaaacaatcttggaggaactcgtgcagagaggccatgaggtcaccgtcctcacctcaagcgcatcaaccttagtgaatgcctctaagagtagtgccataaagctggaagtgtatcccacctctctcacaaagaacgacctcgaggatagcctgctgaagattctggatcgctggatctacggcgtatctaagaatacgttttggtcctacttttcacagctgcaagagctgtgttgggaatattacgattattcaaataagctgtgcaaagacgccgttttgaacaagaagttaatgatgaagctgcaggagtccaagtttgacgtaatattggccgatgcgcttaatccatgtggtgaacttcttgctgaactctttaatattccatttctgtactcactaagatttagcgtcggctatacatttgaaaagaacggcggaggctttctgtttcctccttcatacgttcccgtagtgatgtccgaattaagcgaccagatgattttcatggagcgcattaagaatatgatccacatgctctatttcgacttttggtttcagatctacgacctcaaaaagtgggaccagttctactccgaggtgcttggacgccctaccacactcttcgagacaatggggaaggcagaaatgtggttgattaggacctactgggactttgaatttcctagaccctttctccctaatgtggactttgtagggggattgcactgcaaacccgctaagcctcttcctaaggagatggaagagtttgtgcaaagcagtggagagaacggcatcgtagtgtttagtttagggtccatgatctcaaacatgtcggaggagtccgcaaacatgatcgcctccgcccttgcccagatcccacagaaagttctttggaggttcgacggaaagaaacccaacacgttaggtagcaacacccggttatataagtggctgccccagaacgacctgcttggccacccaaagacgaaggcattcatcacacacggtgggaccaacggaatttatgaggctatttatcacggcatacctatggtcggcataccacttttcgcggaccagcatgacaatatcgcccatatgaaagcaaaaggagctgccctgagcgtagatatccggacaatgagttcccgggacctgctcaacgcgctgaagagtgtaatcaatgatcccgtctacaaagagaatgtcatgaagttatccaggattcaccacgaccagcccatgaaacctttggacagggcggtcttctggatcgaatttgttatgcgtcacaagggagccaaacacctgagggtggccgctcacaacctcacctggattcagtatcattccttagatgtgattgccttcctgctggcctgtgtagctactgtgatatttattattaccaagttctgtcttttctgcttcaggaagcttgcgaagaaggggaaaaaaaagaaaagggactag

SEQ ID NO: 60850 - DNA, 102 bp, Artificial Sequence
  Description of Artificial Sequence: Synthetic coding sequence
atgctcaattttgatatcagcgcggctcctcgtaagacagccctgatgaagctggagaccatcatccactctaagctcttgcagggccagaagactaaatag

SEQ ID NO: 60851 - DNA, 375 bp, Artificial Sequence
  Description of Artificial Sequence: Synthetic coding sequence
atgaccctgaacgaacacgcagcgttcaaacatctgtttaacaaggcccatctggcccctcctctgattcatctgacactgtcgggccacagtacctgtttcagggagcatcgggtagggggtaaggtgacagaccaacaggaccctaaggccgaggaattctttctcgtacagaacaagatgaagtcacttccatgtttgctgctctctacccagacaggccagcccagcgactttagtatattctcacctccatttcctccattttatagcacaaagcctccacttagcagttggccgatcccaaacgagccccttggcacacctcccaggcgaggacggggacgcgcagagggactgctgacttcccagtag

SEQ ID NO: 60852 - DNA, 474 bp, Artificial Sequence
  Description of Artificial Sequence: Synthetic coding sequence
atgcacccgtggctgggcagcgcactcggattccctaaatgcagaggcatccatctttgcgcgtgcggaaacggctggacacccggagagacacttagccaaaacaaaacagaaattacaaagaacaaagtgacatgctggaggccccacggatgtgaacctaataccggactggggtaccaagggagccacacgtctaaatacacactcctgccctggaacctgctcaaaacaaaaccgcttcctccgtcgcatgggaaggaggggggtaaggaagcaaaagtgccatcaggcgacaactctggcagaggagaggtcccccgagcacaagaaggccaagcggcttgtgggagggcagctagtggcgactcacaggaagggatgcgaagaggatgcgaggagcgggctactgcacagcgccctgctgtgagaagcgctgagaccaccgcgcatggaacgtggatctatccatag

SEQ ID NO: 60853 - DNA, 612 bp, Artificial Sequence
  Description of Artificial Sequence: Synthetic coding sequence
atgggaaacatattcgaaaagttatttaagtcactgttaggaaagaagaaaatgagaatcctaattctatctttagacaccgctggtaagacaacaattctgtacaagttgaaactgggggagaccgttcctgccgttccaacggtcgggttctgcgtggaaaccgtggaatacaaaaacaacactttcggagtgtgggatgttgggtctcacttcaagattaggccactgtggcagcacttctttcaaaatactaaaggcgcacgctctcccggaagtacgcaccaaggctcactggcgagcggcgtgctgcctataaagtgctcgcacgtagaattcggaatgtggaagggtggcaggtcgcaccctttcttaccgcattcttccaggtgtgccggttccggtggccagctggattctatccttcctcaccaaagtcccgcatgggggccatgggggtgcaaggatctatcttccgggtttccaagttttctaaccagttccattctttggaaaagcgcagtgtcttatcagctgccaagcctccacaactcttcgcggaattacgcagggtctctggcacagatgatgagacacttactggaggcttag

SEQ ID NO: 60854 - DNA, 1701 bp, Artificial Sequence
  Description of Artificial Sequence: Synthetic coding sequence
atgaaaatgcagaaggggaacgtgttactgatgtttgggctgctgctccaccttgaggcagcaactaacagtaatgagacgtcaacaagcgctaacactggaagctccgtcatcagttctggtgcttcaacagcaaccaactccggatcttcggtgactagtagcggcgtgtccacagcaactatctcagggtcctccgtcacctcaaacggcgtgtccatcgtcaccaactctgagtttcataccacttcctctggaattagcactgcaacgaacagcgaatttagtactgcaagtagtggtatttccatcgctacaaattcagaatcgagcaccacatcatccggtgcctcgactgcaacgaactcagagtcctccactccctccagcggagcatctaccgccactaactctgagtcgtcaaccctgagttccggggcttccaccgctacaaactccgattcttccactacaagctcaggggctagcactgctactaacagcgaaagtagcactacatccagcggagcatcaaccgccacgaacagcgaatcatcaactgtttccagcagggcttctaccgcaacaaactccgagtcctcaaccactagttctggcgcatcaaccgccactaattctgaaagtcggaccacctcgaatggggctggaacggctaccaattcggaatcgtcaactacatcgagcggagcctcaaccgcaaccaattccgattcatctacaacctcctcaggcgctgggacagcgacaaatagcgagagtagtaccacctccagcggagcaagcaccgcaaccaattcggagtcaagcaccaccagcagcggtgcatctaccgcaaccaacagcgacagcagtactacgagctcaggtgccggtacagcaacaaatagcgagtcttccaccgtgagctcaggcatcagtaccgtaacgaactcagaatcctccaccccatccagcggggctaataccgctaccaactctgagtcaagcaccacctcctccggggcaaacactgcgactaattcggaatcaagcactgtctcgtcaggcgcatccacagccactaacagcgaatcctcaactacctcgtcgggcgtgagtacagctacaaactcagaaagcagtaccacctccagtggcgctagtaccgcaacaaatagtgactcctcaaccactagctctgaagctagcacagcaacaaatagtgaatccagcactgtatctagcggcataagtacagtgaccaattccgagagctcaactacatcaagtggagctaacacagcaaccaactccggatcctctgttacatccgcgggtagtggaacagcggctctcacagggatgcataccacttcccactcagccagtactgcagtctcagaggcgaaacctggtggttctttggtgccttgggagatcttcctcatcacactggtcagcgtggtggctgccgtgggcctgttcgcaggactctttttttgtgttcggaattccttaagtcttcgtaacacctttaacaccgcagtgtatcaccctcacggcctgaatcacggcctgggcccaggcccaggcggaaaccatggagcccctcatagacctcgttggtcccctaattggttttggcgacgtccggtatcttccattgcaatggagatgagcggaaggaactctggcccatag

SEQ ID NO: 60855 - DNA, 4908 bp, Artificial Sequence
  Description of Artificial Sequence: Synthetic coding sequence
atgacgtctgctcagtgtccggctttggcctgtgtcatgtcaccgcttagattttggggcccatggcctcttttgatgtggcaactgctctggctcctggttaaagaggctcaacccctggaatgggttaaggatcctttgcagctgacttcaaaccccctgggtcctccagagccttggtcaagccactcatcacattttcctcgagagtctccccatgctccaacactgccagctgatccatgggactttgaccatctcggcccttctgcctcatccgagatgcccgcacctccgcaggaaagcacggagaacctggtgccgtttctggacacctgggattctgcaggggaacttccgctggagccagagcagtttctggcttcccagcaggacttgaaggataagctttctccacaggaacgtctacctgtctcacccaagaaactgaagaaggaccctgcacagcgttggtcccttgcagagattataggcattattaggcaactctctaccccacagagccagaagcaaacacttcagaacgagtacagtagcaccgataccccatacccgggaagtcttccacctgagctacgggttaagtccgatgagccccctggacccagcgagcaggtgggccctagccaatttcacctcgaaccagaaacacagaaccccgagactttagaagatattcaatccagcagcttacagcaggaagctcctgcccagctcccacaactgctggaagaagagcccagctcaatgcagcaggaggctccagcactcccccctgagagttcaatggagtcacttaccctcccaaaccatgaggtctcggtacaaccccctggggaagatcaagcttactatcacctgcccaacataacagtaaagcctgccgacgtggaggtgacaatcactagtgagccgactaacgagacagaatcttcccaagcccagcaggagacacccattcagttccctgaagaggtggagccttccgcaactcagcaggaggcaccgatagagccacctgtcccacctatggaacacgaactgtccatttcagagcaacagcagcctgtccaacccagcgagtcgccgagagaagttgagtccagtcccactcagcaggaaacaccaggtcagccacctgagcatcacgaggttacagtctccccaccgggacatcatcagacacatcaccttgcctctccaagcgttagtgttaagccacccgatgtgcagctgacaatcgccgcagaaccctctgccgaagttggtacaagtctggttcatcaagaggctacaacccgactctccggaagtggaaacgacgtcgagcccccagccattcagcacggaggacctcctttgctgcctgagtcatccgaggaggccggtccccttgctgtgcagcaagagacatccttccaaagtcctgaaccaatcaacaacgaaaatccctctcccactcagcaggaggcagcagcagagcaccctcagaccgccgaggagggagaatcttcattgactcatcaggaggccccagcccaaacaccagagttccctaacgtcgttgtagctcagcccccagagcatagccaccttactcaggccaccgtacagcctttggatctggggtttaccattacaccagaatccaagacagaagtggagctgtcccctaccatgaaagagactcctacgcagccaccaaagaaggtggtcccacagctgcgcgtgtatcagggggtcaccaatccaacccccggacaagaccaggcccagcatccagtgagtccttccgtcactgtacagttactcgacctcgggttgaccatcacacccgagcccaccaccgaggtggggcattcgactcctcccaaacgcacgattgtgtcccccaaacacccagaggtaacactgccacaccccgatcaagtccagacacagcactctcatctgacccgggcaactgtgcagccgcttgacctcggcttcacaattacgccaaagtcaatgacagaggttgagcctagcaccgccctcatgaccacagctcctccccctgggcatcccgaggtaacccttcccccaagcgataaagggcaggcccagcattcacacctcacccaggccacagtccaaccactggatcttgaactgacgatcacgaccaagcccacaaccgaagtgaagcctagccctactactgaagaaaccagtacccagccacctgacctggggctggcaatcattccggagcccacgaccgaaacggggcacagcaccgccttggaaaagacaacagcccctagacctgatagggtccagactttgcacaggagcctcaccgaagtaactgggcctcctacagaactggaaccagcgcaggacagccttgtgcagagcgagtcctacacacagaacaaagctctgaccgcacccgaggagcacaaggcctcaactagtacaaatatttgtgaattatgtacctgtggcgacgagatgctctcctgcattgatcttaacccagaacagcgtctgagacaggtgcctgttcccgagcctaatacgcacaatggcaccttcaccattctaaatttccaggggaattatatctcttacattgatggaaacgtctggaaagcttactcttggacagagaagctgatcttgcgcgaaaacaacctgactgaactccacaaggattcatttgagggcctgctgtctcttcaatatctcgacctcagctgcaataaaattcagtccattgagagacacacattcgaacctttgccttttcttaagtttatcaatctatcgtgcaatgttatcacagagttatccttcggcacatttcaggcttggcatggtatgcaatttttacacaagctgatcctgaaccataatccattgactacggtggaagatccttatcttttcaaactgccagccttgaagtatttagatatgggaactacattggtgcctctaacaaccttgaaaaatatcctcatgatgaccgtggagctggagaagctgattttgcccagccatatggcctgctgtctgtgccagttcaagaacagtatcgaagctgtgtgcaaaacagtcaagctgcactgcaactccgcttgcctcactaacaccattcactgccctgaagaggcttccgttggtaaccctgaaggagcttttatgaaggtcctgcaggctcgaaagaactacacctcaacagagctgattgtagagcctgaggagccctcggacagtagtggcatcaacttgagcggatttggctcagagcagctcgacacaaacgatgagtcagactttatctccactttgagatatatcctgccctacttctcagctgttaatctggacgtgaagtctctcctgctcccactgatcaagctgcccactaccggcaatagccttgctaaaattcagacagtaggccagaatagacaaagagtgaaacgggtgctcatgggaccacgctctatccagaagcgtcattttaaagaagtcggcaggcagtctattcgcagggagcagggcgctcaggcaagcgtggagaatgccgctgaggagaaaaggctgggttcaccagcccctcgcgaggttgagcaaccacacacgcagcagggacccgagaagcttgctggaaatgccgtttacactaagccttctttcacgcaggagcacaaggctgccgtgtcggtgctgaaacccttttccaagggggcaccatctacctctagcccagccaaagctctgcctcaggtccgcgaccgctggaaggatctaacgcatgccatttcgatcctcgaaagcgcaaaggcacgcgtgaccaacacaaaaactagcaagccgatcgtgcacgccagaaagaagtatcgctttcacaagacccggtcccatgtaacacataggacacccaaagtgaaaaagagccccaaggtccggaagaagtcatacctctcccgactgatgttagccaaccgacttccatttagcgccgctaaaagcctcatcaatagccctagccaaggggctttctcttcactcggagacctctctcctcaggagaacccatttctggaggtgtccgccccttccgagcactttattgagaaaaacaacactaagcacaccactgcccgtaacgcatttgaggaaaatgatttcatggaaaacaccaacatgcccgaagggaccatctcagagaataccaactataaccatccacccgaagccgacagtgcaggaactgcttttaacctggggcctacagtgaaacagacagaaactaagtgggaatacaataatgtcggcactgacccgtcgcctgagcccaaatcctttaattatcccctcctgtcttcccctggagaccagtttgagattcagctcacacaacagttgcagagtcttatccccaacaataatgtgcgtcggcttattgcccacgtgatcaggacactgaaaatggactgctcaggggctcatgtccaagtcacatgcgcaaagctgatttctaggacaggtcacctcatgaaactacttagtggtcagcaggaagtgaaagcgtcaaagatcgaatgggatacggatcaatggaagattgaaaactatattaacgagagtacagaggcacagtccgaacagaaagagaagtctctggagttgaagaaggaggtgcccggatatggctatacggataaactgatcttggctttaatagtgaccggcatcctaactattctgatcatcctcttctgcctgatcgttatctgttgccatcgtcggtcactccaggaagatgaggaaggtttttcaagggacagcgaggcacccactgaggaagaagagtcagaagctttaccctag

SEQ ID NO: 60856 - DNA, 372 bp, Artificial Sequence
  Description of Artificial Sequence: Synthetic coding sequence
atgcagagtgaaaagccccagggtttgtttctccaactaaatcctaatgcaagttccacagaaactcagctgctggtaccagctctcgagtcaagagatacactgccaccaacacactgcttcatggcgggtacggagtctcctctgggcaatccatggcccctgtccttgccacccccatgctggactgggtgcgtgctgcctgcaccacggggacagaggaagccaggtcccttaggattgtctattttcattagcttaggcaacaaacgacaccggagcgggaatcacgtagtacgcgagagcgagcaacctctttctcaaggcaacccacaccaaggatggggccctgacacccgaaagggaagatag

SEQ ID NO: 60857 - DNA, 2262 bp, Artificial Sequence
  Description of Artificial Sequence: Synthetic coding sequence
atggaatttcatcgggtggcgcaggcaggggtcgagcttctatcatcaggggacccgcctgcgtccgcttcacagagcgtgggcattataggagtaagtcattgtacatggcacatcaacttccagggtaactacatttcctacattgacgggaacgtatggaaggcctacagttggaccgaaaagctgatcctgagggagaataacctaacagaactacataaagactcgtttgaaggactgctctctctgcagtatctcatcttgaaccacaatcctcttacaaccgtggaagacccatacctattcaaattgcccgcactgaagtacctggatatggggaccaccctggtgccgctgaccaccttgaaaaatattttgatgatgacagtagagctcgaaaagttaatccttcccagccatatggcctgttgcttgtgccagttcaagaattccattgaagccgtatgcaaaacagtaaaactccattgcaatagtgcgtgtctgaccaacacaacccactgtcctgaagaggctagcgttggtaatccagagggtgcctttatgaaagtactgcaggcacgaaaaaattatacctccactgaactcatcgtggagcctgaggagccgagtgacagctctggcatcaacctgtcgggtttcggctccgagcaacttgacacgaatgatgagtccgacttcatcagtaccctgcgttatattctgccctacttcagcgcagtcaacctggacgtgaaatcgcttctcctgcctctgatcaaattgcccactactgggaactcactcgcgaagattcagacagtgggtcagaataggcagagagtcaagagggttctcatggggcctcggagcatacagaagcggcatttcaaggaagtcggtcggcaaagcatacgccgagaacagggggcacaggcgtcggttgagaacgccgcagaagaaaaacggctgggaagccctgccccaagggaagtcgagcagcctcacactcagcaaggacccgaaaagcttgccggtaacgctgtatacacaaagcccagctttacccaagagcacaaggctgctgtgtctgtgttgaaaccattctcgaagggggcaccctctacatctagtcctgccaaagcattgccacaagttcgagacagatggaaggatctgacacacgcaatctcaaccctcgaatccgccaaggcccgagtgacaaacactaaaacatctaaacccatcgtccacgcgcgaaagaaatatagattccacaaaacgcgcagtcacgtaactcatcggacaccgaaggtgaaaaagtcacccaaagtacgcaagaagagttatctttcgcggctcatgctggcaaaccggctgccattcagcgccgcaaagagcctcattaactcacccagccaaggagccttttcctcactgggggatttgtcccctcaagagaatcctttcctggaggtgagtgccccatcagagcattttatcgagaagaataacaccaagcatactactgctcggaacgcatttgaagaaaacgattttatggaaaatacaaatatgccagaggggacaatcagtgaaaacaccaactacaaccatccgcctgaggccgatagcgcaggaactgcttttaacctgggacccactgtgaaacagaccgagactaagtgggagtataataacgtcggtacagatctaagtcctgagcctaagagcttcaactaccccctcctttcaagccccggtgaccagttcgaaatccagctcacccagcagcttcagtctttgatccccaacaacaacgtccgacgtctaatcgcccacgtaattcgtactttaaaaatggactgttccggaacacacgtgcaggtgacatgcgcaaagctgataagccggacgggacaccttatgaagctgctgagcgggcagcaggaggtgaaggcaagcaagatcgagtgggatactgatcagtggaagatcgagaattacatcaatgagagcaccgaggcacagtctgagcagaaagagaagagcttagaactcaagaaagaggtcccgggttatggctacacggacaaactcatccttgccctgatagtcacaggtatcctcacaatcctgattatcctgttttgtttgattgtgatctgttgccatagacgttcccttcaggaagatgaggagggattctcaagagatagtgaggccccaaccgaggaagaggagtccgaagctctcccatag

SEQ ID NO: 60858 - DNA, 378 bp, Artificial Sequence
  Description of Artificial Sequence: Synthetic coding sequence
atgggcaatatcttcgagaaactgtttaaaagtctccttggcaaaaagaaaatgcgaattctaatcctgagcctggacaccgccggtaagaccacaatcctgtataagctcaaattaggcgaaacagttcctgcggtacctacagttggattctgcgttgaaaccgtcgagtataagaacaacaccttcggcgtgtgggatgtaggctcacattttaagattcgccctctctggcagcactttttccagaatacgaaagagttgtccgccagccagtttgcacagttcataaagaagctctgcggtgtcaccggaaccaatgacgaggcctctcccggaagtttgacttcttacccatcacaccttctcgaccggtag

SEQ ID NO: 60859 - DNA, 102 bp, Artificial Sequence
  Description of Artificial Sequence: Synthetic coding sequence
atgctgaatttcgacatatcagctgccccacgcaagactgctctcatgaaactggaaaccattatccattcaaagctgctacaggggcagaagacaaaatag

SEQ ID NO: 60860 - DNA, 522 bp, Artificial Sequence
  Description of Artificial Sequence: Synthetic coding sequence
atgcctgctatgccgagcccgctgtgcgcccctgcacgggtctccccttctcccctcactgccgcacccccattctgcagcctatcccccatcctctgggtcagcttgatccttcttctaacaagtatttccaagtgctgtgagtcgatctttaaattcatccaaaatccatttaccagccactacttcccgtgctcacatcccagccagggcaaacggaggctccaccctggcatccttcattcttttcccactgtgtttcccacagcctccctggtcccccaccttagcatactgttctcagctcagcaacccgagcggtcatttcagcgcatgtctccaacaatgtctcatttcagcaaactgagcagcccctgccatagcgaacagaggtcaaccccattcccacacccctccggcctacccgcattggctacacccttgacctccctccagttcctctgtgttcagccgttctggttattgccccctagccgcaacacagacaatttcctgccatag

SEQ ID NO: 60861 - DNA, 876 bp, Artificial Sequence
  Description of Artificial Sequence: Synthetic coding sequence
agcgcgggaggagggggtgccggtagcaggctccaagccgagatgcttcagatggacctgatagacgctaccggtgactccacgcctgatgagccagacgtccacttctcaaagaagttcttaaacattttcatgtctggccgttcacggagttctagcgctgagagcttcggccttttttcttgtattataaatcgagaggaacaagagcaaacgcacagaactattttcaggttcgtccctcggcatgaggatgaacccgagctagaggtggatgatccgctcttggtggagctgcaggcggaagattactggtacgaggcctacaacatgcgtactggtgctcggggtttttttaccgcctactatgctattgaggtgactaaagagcccgagcacatggcagccttggccaagaactcggactgggtcgatcaattccgcgtcaaatttctcggcagtgtgcaagtaccatatcataagggagacgtcgtgttgagtgccgctatgcaaaagatcgctacgacgcgtcgtctgaccgtgcactttaaccctccttcaagttgtgtcctagaaattagcgtgcgcggagtcaagattggtgtgaaggctgatgacagccaggaggccaagggtaataagtgcagccattttttccagttaaagaatatctcgtttcgcggatatcaccccaagaacaataaatatttcggcttcatcaccaaacacctcgcggatcaccgcttcgcttgccatgtatttgtatccgaggattccacaaaggccctggctgagtccgtaggtagagcatttcagcagttccacaaacagttcgttgagtatacttgccctactgaagatatctacctcgagtag

SEQ ID NO: 60862 - DNA, 1272 bp, Artificial Sequence
  Description of Artificial Sequence: Synthetic coding sequence
atgatgtatagacccgacgtggtgcgcgcaaggaaacgggtgtgctgggagccttgggtgatcggactcgtgattttcatctcccttatagtattggcagtgtgtatcgggctcacggtgcactacgtgcggtataatcaaaagaagacctacaactactacagtactctatctttcacgactgataagctatatgccgagtttggcagagaggcatcaaacaatttcaccgaaatgagccaacgattggaatcaatggtgaaaaacgccttttacaaatctcctttgcgcgaggaatttgtaaaatctcaagtgattaagttctctcagcagaaacatggagtgttagcccatatgcttctgatatgcaggtttcattctactgaggatccagagaccgtggataaaatcgttcagcttgtactgcatgagaagcttcaggacgccgttggaccacccaaggtcgatcctcaatccgtaaagattaaaaagatcaacaagaccgagactgattcctatctgaatcactgttgcggaacacgaagatctaagaccctgggccaaagcctgcggatcgtgggcggaactgaagtggaagaaggggaatggccttggcaggctagccttcaatgggacggttcccacaggtgcggggctaccttaattaacgctacctggttagtttcagctgcccactgctttaccacatacaaaaatccagcacggtggactgcctcttttggagtgactatcaaacctagcaaaatgaagagaggcctgcgcaggattattgttcacgaaaagtacaagcaccccagccatgattatgacatcagcctggcagagctttcttcgcctgtgccctacaccaacgcagtgcatagggtctgcctgcccgatgcatcctacgagtttcagccgggagacgtcatgtttgtcaccggttttggcgctctgaaaaacgatggctattcccaaaaccatctgaggcaagcacaagtcaccctcatcgatgctactacttgcaatgaaccccaggcttataacgatgccatcactccaaggatgttgtgcgccggatcactggagggaaaaacagacgcctgccagggagactctggaggacccttggtctcctctgatgctcgcgatatctggtatctcgccggtatcgtttcatggggggacgagtgtgccaagccaaacaaaccaggggtctacacccgcgtcacagctctgcgcgactggataacaagtaaaacggggatttag

SEQ ID NO: 60863 - DNA, 375 bp, Artificial Sequence
  Description of Artificial Sequence: Synthetic coding sequence
atgacacctaacgaacatcctgcattcaagcacctgtttaacaaggcacaccttgctcccccattaatccatttgacactttcaggacactccacgtgcttcagagaacaccgcgtcgggggaaaagtgactgaccagcaggaccctaaggcagaagaattcttcctcgtgcagaacaaaatgaagagtttaccctgtctgttgctgagtacacagacccggcagccatcagacttctctatcttcagccccccattcctccctttttattcaaccaagccccctctgtctagctggccagtactgaatgagctgcttggcacccctcccaggcgcggtgggggacgcgcagagggcctcctaacatcacagtag

SEQ ID NO: 60864 - DNA, 339 bp, Artificial Sequence
  Description of Artificial Sequence: Synthetic coding sequence
tgcgacattcaaatgactcaaagcccttcatcactcagcgcctccgttggagaccgggtgacaatcacctgccgtgctagccaatcaatctctagctatctgaactggtaccagcagaaacctgggaaggcaccaaagctcctaatttatgccgcatctagcctgcagtctggcgtgccctcccggttttcgggttcagggtccggaactgattttacgctgacaatcagctctctgcagcctgaggatttcgctacctactattgccaacagagctacagtactcccccaactgtgctgcagggtacaagattgaagatctctcgggtggaagcgtag

SEQ ID NO: 60865 - DNA, 384 bp, Artificial Sequence
  Description of Artificial Sequence: Synthetic coding sequence
atggaatttggtcttaattgggtgtttctggttgctatcatcaagggcgcacaatgcgaggtgcagctggtggaatccggagggggtctggtccagcccggtgggtcactgaggctctcgtgcccagactcaggcttcacatttagcaaccattacatgtcatgggtccggcaggcccctggtaagggcctggaatggatcagttacatcagtggagatagcgggtatacaaactacgctgactccgttaaggggaggtttacaatctcccgcgacaacgctaataacagcccctatttgcagatgaactctctaagggctgaggacacagctgtctattattgtgtgaaacacaccgcaagaggcaatctacagttttattag

SEQ ID NO: 60866 - DNA, 315 bp, Artificial Sequence
  Description of Artificial Sequence: Synthetic coding sequence
atgacccaatctccctcaagcctgagtgcttctgtgggagaccgagtgactatcacttgtcgcgcaagtcaaagcatcagctcctatctgaattggtaccagcagaaacctgggaaggcgcctaaattactcatatacgcggcttccagtctgcaatcgggagtaccctcacgctttagcggaagcggttccggcactgactttactctcacaatcagctcactgcagcccgaggatttcgccacttactattgccagcagtcttactccacgcctcctactgtcggcagcggaacttattttaaactgaaatag

SEQ ID NO: 60867 - DNA, 348 bp, Artificial Sequence
  Description of Artificial Sequence: Synthetic coding sequence
atgctgtgggtgccaggttcctccggagatgtggtaatgacacagagccccctcagtctgcccgtgactctcgggcagcctgcatctattagctgtcgcagttctcagtctctagtttattccgacgggaacacctacctgaactggttccagcagcggcctggacagtctcctagaagactgatctacaaggttagtaactgggactcaggagttcccgaccggtttagtggaagcggatcgggtacagatttcacattgaagataagtcgggtagaggcagaggacgtgggagtgtactactgtatgcaggggactcattggccaccgactgtagtccagccatag

SEQ ID NO: 60868 - DNA, 348 bp, Artificial Sequence
  Description of Artificial Sequence: Synthetic coding sequence
atgagggtgcccgcacaacttttgggacttttacttctttggctgaggggcgctcgctgtgacattcaaatgacgcagagtccttcatctttgtcagcttctgtgggcgatagggtgaccattacctgtagagcaagtcagagcatctcatcttaccttaattggtaccagcagaaaccaggcaaggcacccaagcttttaatttacgccgcaagctcattacagtctggagtgccaagtcgtttcagcggcagcggcagcggaaccgatttcacactgacaatttcatcgctccaacccgaagactttgccacatactactgccagcaatcctacagtaccccatag

SEQ ID NO: 60869 - DNA, 432 bp, Artificial Sequence
  Description of Artificial Sequence: Synthetic coding sequence
atgtgggtccagacacacccgtctagcgctagctataaaagctggggcccaggcaccgctgacacccacaccatgcgccttagtcgacggcctgagacatttcttctggcattcgtgttactttgcaccttgctgggcctgggctgtcccttacactgtgaaatctgcacagccgctggctcgcgatgccacggccaaatgaaaacctgttcctctgataaagatacctgcgtcctcttggttggcaaagccacgagctctaaaagaatgtggccgggaacatggtggggtgggggagtttacttacagggaggcagggattaccatgcagaagggggaagctcatggttctcgcggagagagcggggaaagaagtcagtagaatcccgtaaagaggggaagaccatcatgaggtggagggaacagaagtag

SEQ ID NO: 60870 - DNA, 939 bp, Artificial Sequence
  Description of Artificial Sequence: Synthetic coding sequence
cttgcactccgtcccaggcgcatggcctcgaatcgacagaggtcccttagaggcccaagccacccttctcacatggaggagccattccttcagatggttcaggccagtgagtcgcttcctccttcccaaacgtgggcccagagagagttcttcctgccttcagaatcctgggagttcccgggttttacccgacaggcctaccaccagctcgccctgaaactccccccttgcaccgacatgaagtctaaggtgcgtcagaggctcatccacccctggaaaggaggtgcccagcatacctggggattccatacctggttggacgtctgcaggctgccagcaaccttccccactcagcccgaccgcccatatgactcaaatgtttggcgatggctcactgacagtaacgctcacagatgtccccctaccgaacacccaattcctccaccgtcgtggatggggcaaaactcattcttaacattcatccactgttacccaacatttgtcgatatgaagcgcaagaaacaggtcatctttaggacagtcaaggagctgaaagaggtggagaaattgaaattaaggagcgaagctcgcgcaccacctctggacgcccaagggaatattcagcccccagcttcttttaaaaagtacagacatattagcgccggaggacgcttcgagccccagggcctccagttgatgcctaacccctttcctaacaatttcgccaggtcctggccttgccccaatcccctgccccactatcaggagaaagtcctcaaactagcactgctcccctctgcccctttgtcccaggatttgattagagatttccagacgctgataaaagaccgcactgccctgcctttacatcatttgtccaaagcccaagctagcaagagccccgctagaaagagaaaacgacgacccggtcacttttag

SEQ ID NO: 60871 - DNA, 456 bp, Artificial Sequence
  Description of Artificial Sequence: Synthetic coding sequence
atggctgtctcacagatgtccaaatggaggctgtctagggtcggcggaagcaggagcctaccggcagaaatggaagttttgggtgaggtgtggtgtgtcagagcagaggagcagcccatgacaggcttagggatcgtttggcactcccccctgctcgataaagcactcgaaacatggtcactgcagcagcagcctgacttctccctaggccttgggcacttgggcctcggaactgacgcaacttggatgcaatcattccctgggtctggaggagatgcccaggctggaacaggcgttagtgggctgctgcgcctgtatccgaacttgctctgtgattttgggccacggcaggggccactgtgggcattgttactcgaaaagcgccagatggccggaaccggcggatcacctgcactcttagcttggagaagcgcgagttggagagccctagggtag

SEQ ID NO: 60872 - DNA, 345 bp, Artificial Sequence
  Description of Artificial Sequence: Synthetic coding sequence
atggcggtaagccagatgagcaaatggcgtctgtcaagggtgggcggtagcagatcgctgccggcagagatggaggtcttgggagaagtgtggtgtgtgcgggcagaagaacaacctatgactgggcttggtattgtgtggcatagcccactgctcgataaagccctcgaaacctggagtcttcagcagcagccggatttcagcctcggactaggtcaccttgggcttggtctgtatatcctcgcctcctaccttctctgtccaagacaaccccctagtcagccggacggtccttgtggaagtccaaaccctgtgagcggcgcaaaaaagactaccgtggcttag

SEQ ID NO: 60873 - DNA, 504 bp, Artificial Sequence
  Description of Artificial Sequence: Synthetic coding sequence
atgctgtgcccttgcatccaggaatcaacattcgaaacatgcctatttatggctgtctcccagatgtcaaagtggaggttgagcagggtgggtggctctcgatcccttcctgccgagatggaagtccttggggaggtctggtgtgtgcgggcagaggagcaacccatgactggcctcggaatcgtatggcacagccccttgttagacaaggcgcttgaaacgtggagtctccagcagcaacccgatttctcgctgggtttggggcatctggggctgggtacagacgctacatggatgcagtcttttcccggaagtggaggggacgcccaggccggaacgggcgtttcagggttgcttagattgtacccaaacctcctctgcgatttcgggcctcgccaaggcccactctgggccttacttctggagaagaggcagatggcaggcacaggaggttccccagcccttcttgcttggcgttcggcgagctggcgggctctggggtag

SEQ ID NO: 60874 - DNA, 393 bp, Artificial Sequence
  Description of Artificial Sequence: Synthetic coding sequence
atgctgtgcccatgcattcaggagagcactttcgagacttgcttgtttatggccgtcagccaaatgagcaagtggaggctgtcccgggtgggtggctcccggtccttacctgcggagatggaggtgctaggtgaggtatggtgtgtgagagctgaagagcagccgatgaccggcctggggatcgtctggcactcccctctcctggataaagccctagagacttggtcactgcagcaacagcccgacttttccctgggattgggacacttggggctgggactatacatcctcgccagttatctcctctgccctaggcagccaccaagccagccggacgggccatgtggatcaccaaatccggtgagtggagcaaagaagactacggtggcctag

SEQ ID NO: 60875 - DNA, 2124 bp, Artificial Sequence
  Description of Artificial Sequence: Synthetic coding sequence
atggtcgacccggtacctgaggaagagaaagcaggcgctgagcctggagattctgggggagacgaggctgtggccagcgtgccccctgactcgcagggagcacaggaacccgctgcctcatccgctagtgcttccgcgagcgcagccgtgcctcgaaaggccgaagtcccctgcgcggctgctgagggagggcgtagagagcagagccccctgttgcacctggacctgtttaactttgattgtcctgaggccgagggctctcgctacgtattgacttcaccgagatccttagaggcatgtgccaggtgtgcagtgaagcccgtggagctgctccctcgcgcactagcagatctggtgcgagaagctcctggcaggtcaatgcgcgtagcaacagggctttacgaggcctatgaagccgaaagacgggcaaaactgcagcagtgtcgtgctgagcgcgaacggattatgagagaagaaaaaagacgcctgttcaccccccttagtcccgcagcagcggctgctgcggcagctgccgcagcgagcgcaccgtcagccggtagctccagctcctgctcatctgcgtcgctgcccgctagccctgctcccagggccgctaggaaagccagtccgagtccctcctctgcacgtacacaaccacccccagcgggatcccggaccggaaggaagtcccactcactagacagcctgtccaggcgaagggagggagcactgtcttctgagtccggggcttctagcagctcctacagcggtgaatcgctgcgggaactgcgttggccccctcgagctagcgctagaaactcatgtccagctggctctgcttctagcacgacaaatgcacctggacgtcccagcgcccttacactcgttcccattactggacggtctttttccctaggagatttgtctcatagcccccagacggcccaacacgtggaacggatagtgcggcaggtgagggccgagcggggactcaggggagtgccagagcgagaccggaaaatcgcagccctgatgctagccagacatcaggaggaacttctactgcttgagcaacgcgcagcagcccatgggcagtgggaactccagcgagtgcatgctaagcagcgacgggagcgcgaagagcgagagaaacagagagcactggaacagggacgcagggcgtgggccgcacaggtggaagagcggaggggacgtaggggcagggaggagagggaggccgctagaaggaggcagcggcagtatgagcgctcggaggagcgtagacgggagcttgcggagcgacaggggctacttagacgggaacgggcagagagagctgccagagaagatcggctccgcaagctgcagcaagagcagaatttaaagcagagagaagaaggcttgcaggagggccgagagagggccgaacaaatccggcgagaaagagcacagcgtgccgcaagggccaaacagcggcaagaggggcaactccaaagggaaaagcgcgaactttcccgcgctgagagggcacgccacgaggcactacttcaaggccgaactcgtcagcagagacaagagcgggaggggctgcggtcaagtctggaagcctccctcggtcgagcgcaggagaattacgaacatctggtggagcagcgcactcgcgagctccgcgagagagctagacgcgaagagttgcagggtcgcagagccaaggaggccgcagagaggaaggagagagaacatcaggcccacctcgaggccctcgccagagccggagagaggaggttgcagcacgcaacacaggttgccgaagaggcggtgcaacagaaagccaggcgtgttggtcagtcgagactagagaaagaaagggcccaaagagcaaataaggagaaggtggagcgcgatgaagattgccgacggagagaactcctgcaggctattggacgcaagttagaaaggagcgaacaactgacacgcgagagacgcagcgcattggaatcggccagaagtacggctcgagcctctttccacgtgagagagaaagtgcgagaagaaacaaacaccagatccttcgatcggatggtccgtgaagcccagctccatgcttccttagataggaaatag

SEQ ID NO: 60876 - DNA, 198 bp, Artificial Sequence
  Description of Artificial Sequence: Synthetic coding sequence
atgtcggagcaaaacatttgcaaccagaaagacaagtctactttgccattctgccaagcgcacctttgtgaggagacaaccaatcggctatgtgtgagcaataaagctgtctactccctcgagtgcaaatgggccgaaagcgaaaatcgagtgtcggaggggaggtgggggaggggctgcttcatcggcgtaggctag

SEQ ID NO: 60877 - DNA, 477 bp, Artificial Sequence
  Description of Artificial Sequence: Synthetic coding sequence
atgagagcctccagatcacccccaagccctaggcgatgccaccatcaccatgaagccacaggcgctgccagcggggcagctgccggaggtcctggtgctggttgtgtcggtctttgtcggctggctctcaccccttcagcccaagacggcaggaattctaccttccaaacttacaagaaggaagtgtgtctccctcgacactctatgcaccctggcccttgggccatttgctgcgagtgccagactcgattcggaggtcgcctccctgtgtcgagagtggaggcagctctgccatactgggtccccctgagcctgagaccacgcaaacagcatccctgttggatgcatgccgcagggacaacggctggcggttccgctgtaatgagcgcatgttgtccctcctctagctcatccaggcctcctaccagaacctcttatcgccttttacagagggtgtgttgcccctccgcctcatag

SEQ ID NO: 60878 - DNA, 1668 bp, Artificial Sequence
  Description of Artificial Sequence: Synthetic coding sequence
atgcgtcggccatcaactgcaagtttaaccagaactcctcccagggcttctcctactcgcatgccgagcagagcgagcttaaagatgactccttttcgggcatcactgactaagatggaatcaactgcgctgcttagaacactcccaagagcaagtttgatgcgcacgccaacccgggctagcttaatgagaacaccacccagggccagccctacacggaagccacctagggcgtctcctcgaactccgtcaagggcttcccccactagacgcctgcccagagccagtcctatggggtcgccccatcgcgctagcccaatgaggactccacccagagcgagcccaaccggcaccccttccaccgcctcccctacaggcactcccagctcagccagccctaccggcacaccaccgagagcctcacctacaggtaccccccctcgggcttgggcgacacggtcaccgtctacagcatcccttacaagaaccccaagccgggcatccctaacacgatggcctccaagggctagtccgacacgtacccccccacgagaatccccgaggatgtctcacagagcctcccctacaagaacccctccaagagctagcccaactagacgccctccccgtgcttcacctacccggacccctccacgtgaaagcctgagaacaagccaccgcgcaagtccgacgaggatgcctcccagggcctcccccacacgtaggccacccagagcatctcctacaggttctccccctagagcgagcccgatgacaccaccacgtgcgtccccaagaacaccacccagagcatctcccactaccaccccatcacgtgcttctctgaccagaacgccaagctgggcgtcgcccacaacaactccaagtcgggcttctttgatgaagatggagagtactgtcagtattaccagaactccgccacgggcatcccctaccggaactccgtcaagggcctcacctaccggtaccccgtctcgtgcgtcactgaccggttccccatcaagggctagtttgaccggtaccccatcgagggctagtctgatcggtacaccctccagggccagtctgaccggaaccccccctagagcatctctaacaggaacttcttccacagcctctcttacaagaactccctcgagagccagtctgacaaggacccaatcttcttcctctttgacgcgcaccccttcgatggcttctttgacccgaacccctccgagagcatctctcacgaggaccccccctcgcgcttctctcacccgcactctgccgagggcctctctaacccgaactccacctagagcttctctgacacgaaccccgagtatggtgtcccttaagcggagccccagcagagcatctttgaccagaacaccaagccgcgcatctctcacaatgacccccagcagggcatccttaacaaggacccccagcaccgcatcgttgactggtacacccccaacagcctctttaacccgaaccccacccaccgcctccctgacgcgttctccccctacagcttcactgacccgcaccccatccaccgcatctctgacccgcatgccctctacggcctccttgacaaggaagtcgaatgtgaatcagcaatgcccagcaagtacccccagctccgaggtgatttcatag

SEQ ID NO: 60879 - DNA, 1719 bp, Artificial Sequence
  Description of Artificial Sequence: Synthetic coding sequence
atgcctgtatattgtaaatatcagttccacaaaacccctgttcataagaccaaaggggaacctcatgggacgcatgtctacttccaggacatcaatgtgatattcctcggggcattgcatcctagtgatcttcgggagtatctcgaaggacctcccatggtagtcgaggtgcacgaccgggataggaaatctgaagaatgcagccaaaagccggtactgtttggtgaagacccgctggactcctacttgaattttcaggctctcatcagtcctcgtgagacagagaacaacccgtttgaatcacagaataaaatgtggtatccatatggtatcgcccaggtgtccttcgccgatttgctgttgggccacaagtatctcaatctggccgtgccaattcatagctgtgaggtgcagcccactcattgcggacaagactcacgcaggcggaaagtcgtggggttaggggtgcccagagacggccaccaacatggacccatgcccaggggaaattacctggaggccgactcacagttgaaactgcgggtcgacatagccgtccctctgagggcaggtgcacgagccgcagacccagacctggggggatcacagtttggaaggatcatctttgtttttgatttcaagaaagtgagccttcttcattctctcctgcaggacatcaccatgattaatgccaaggcactcggactggacagctacccggtacgaaccctgcagcaaatcctgtccgctttcaaagtacgggtacgggtgcaggagcagcagcatctggatgtactgaccgggttccatctgttagatggaaagacccatttgttcattcttgaggggttagccgaccaaggactacgtcaactgtgggaaaaccaccaatcatggatcccaagaagtgagcaccgaaagtacaaagttctgtacaatagccagttactgtttcggagcaggttatatggcgacctagaggctatactttaccatgttcatctgttccagccaacagagttattactgcagcaggccgtttttttcctgagagatacagagcggagacgcgtgttccaggcattagcgcgaatccacgatatctgttacaattctaccacactgtgggacgttaccgtgagggatctccttcccagcagtgccatgatcaaggacttgtctcaggaatttggaatgccccttagccaagaggagctgaccgacgagaaactttttgcactgcctcctcagccggctcctaacctcgaggactatcacagtcgcaattcaacattaacactggagatccacgcccaccaagaacctagaaagcgctttacctactctcaagattatctttccgccatggtagaacctcttgacctgaaagaagaggagaaaaaggcacagaagaaaagtcggcaggcgtggctaacggcaagaggcttccaggtcactgggctccagagtgacaccgagagctcattccaagacctaaaactccccccaataaaggagctgaacgaagaatggaaagaaaactccttgtttgccaatgttcttgagcctgtgctggacagggataggtggtcgtgggataggcaccatgtggactttgacttatacaagaagccgcctccatttcttgagctgctgccgagtcccgcaccaaaacccgtgacagtgcggaaaaagaaagggaattcacctatcagctag

SEQ ID NO: 60880 - DNA, 1719 bp, Artificial Sequence
  Description of Artificial Sequence: Synthetic coding sequence
atgccggtgtactgtaaataccaatttcataagacgccagttcataagaccaagggggaaccccacggaacccacgtctattttcaggatatcaatgttatcttcctgggtgctcttcacccctccgatcttagggagtacttggaggggccaccaatggtggtcgaggtgcatgaccgcgatcgcaagtccgaggagtgctctcagaaacccgtgctatttggagaggaccctctggattcctatctcaatttccaagcactgattagtccccgagagacagagaataacccctttgagtcacagaataaaatgtggtacccttacggcatcgcccaggtctccttcgccgacctgttgcttggccataaatacctaaaccttgccgtccctatccattcctgcgaggtgcagccgacacactgtgggcaggactccagacgccgtaaggtagtcggccttggagtgcctcgggacggccatcagcatggacctatgcctcggggaaactacctggaggccgactcacagttgaaactgcgagtggacattgctgttccgttacgagcaggcgcaagggccgctgatccagacttgggaggatcacagttcggtcgtatcatatttgtctttgacttcaaaaaagtatcgctgctccactccttactgcaagacattaccatgatcaatgccaaagctctcggtctggatagctacccagtacggacgctgcagcaaatactctcagcatttaaggttcgcgtgcgggttcaggagcagcagcatctcgacgtgctgacgggattccatctgctggacggaaagacccacctttttatcttagaaggtctggcagaccaggggctgcgccagttgtgggaaaatcatcagtcgtggattccccgaagcgaacacagaaagtataaagttctttataactcccagctccttttccgctcgcgactgtatggagatctagaagccatcttgtaccatgtccacctttttcaaccgaccgagctactgctgcaacaggctgtcttctttctcagagatacggagcgacggcgtgtgtttcaagccctcgcacggatccacgacatttgttataacagcaccactttatgggacgtaacagttagagatcttctcccgagttctgccatgattaaggacttatctcaggaatttggcatgcctctgagccaagaggaacttactgacgaaaaactttttgcactgcctccacagccagcaccaaatctggaagattatcattcccggaatagtaccttgaccctcgaaattcacgcccatcaggagccacgtaaaaggttcacctattcacaggattatctgagtgccatggtggaaccgctggatctgaaagaggaagaaaagaaagctcagaaaaaatctcgacaggcctggctgaccgctaggggctttcaggtgactggtttgcagtctgatacggaatcctcatttcaggatctcaagctgccccctatcaaggagctaaacgaggaatggaaagagaattcactttttgcaaatgttctagagccagtgctcgatcgggatagatggtcctgggatcggcatcacgtggattttgacttgtacaaaaagcctcccccatttctggaactgttgccttcccccgcacctaaacccgttactgtacgaaaaaaaaaaggtaattcaccgattagctag

SEQ ID NO: 60881 - DNA, 390 bp, Artificial Sequence
  Description of Artificial Sequence: Synthetic coding sequence
atgcccgtttattgtaagtaccaatttcacaagactcccgttcataaaacgaagggcgagccccacggtacacatgtctatttccaggacataaacgtcattttcctaggcgctctccaccccagcgatttgcgcgagtatctcgaggggcctcccatggtcgtggaagtccacgacagagataggaagtcagaggaatgcagccagaaacctgtactatttggcgaggacccacttgactcttatcttaacttccaagcgctgatcagcccaagggaaaccgagaataatccatttgaatcccagaacaaaatgtggtacccatacgggatcgcacaggtgtcttttgccgatctcctcctgggccacaaatacctgaatctcgcgtag

SEQ ID NO: 60882 - DNA, 1068 bp, Artificial Sequence
  Description of Artificial Sequence: Synthetic coding sequence
ctcggcgtgaaaggactgccactataccctgacccgagcagggtcccaggaacaaaaacacaaaataacctggaatccgattatctggcacgggacggtccatccagcaactcttctttccactcaagcgaggaggagggtacggacctggagggggatatgctggattgcagcggttctcggccactgctgatggaatccgaggaggaagacgaaagttgtcgccctcctcccggaaagcttgggggagcggtgcccttcgcgcctcccgaagtgtctcctgagcaggcgaaaacagttcaaggaggtcgaaaaaatcagtttcaggccttcacgcaacccgctacggacggcctctctgaaccggacgtgttcgccatcgccccatttcggtcctcacgagttccaaacgatgatatggacatttttagtaaagcgccatttgtttcgaagagttctatggctccctcccagcccgaagagtcagacgtttttctcagggctccgtttacaaagaagaaatccatggaggaactgaccgttatccagtgcacttcacaagagctgcctgcccagacagggctgttgagccagaccggcgacgtcccactgcccgctgggcgtgagagggccgtgtatacatctgtccaggctcagtattcgaccgcaggtttcgttcagcagtccaacctgctcagccatagtgttcaggccgctgaccacctagatagcatttccccgaggggctcctgtttggagtcaggcggtcatagtaacgaccgtaacaaaggcccacagcttcagaaagaggcggtcagcggtcctatggcgggaaagccttttcgcccacagtccctctcgaagtacagccggcactacagtcccgaggatgagccttcaccagaggcacaaccaatcgcagcctataaaatagtttcacagactaacaaacaatccatagctgggagcgtctccatcacatctctatctagtcgcacaacagaattgcctgctgcggatccttttgctctggctccgtttcccagtaaatccggtaaaaaaccatag

SEQ ID NO: 60883 - DNA, 462 bp, Artificial Sequence
  Description of Artificial Sequence: Synthetic coding sequence
atgcactacgtgcacgtgcatcgtgtaactacccagccaaggaataaaccccagacaaaatgtccttccggcggacaatcccagggcccacgcggacagtttctggataccgttctggctgccatgtgcccaattgccatgcttcttactgcagatcccggtatgcccccaacctgcctgtggcacactcctcatgctaaacacaaggagcacctgtcaatccacctcaacatggtgccgaagtgcgtgcatatgcacgtgactcacacacacaccaacagcggtagccggtacgtgggtaagtacatactgctaatcaagtggtctctggctatgtatttcgtgcaggggtctacattgtccaccgtgacaaagatgtcccacggaaaggccctccccgactcagacacgtacatccagttccccaatcagcaaggccctcacactccatccatcccttag

SEQ ID NO: 60884 - DNA, 366 bp, Artificial Sequence
  Description of Artificial Sequence: Synthetic coding sequence
atgcagaagcaactcctccccctggctgctggccaaagatgcgattactctcagcgagagtcatgctgtcaatcaccgcatcgggcagagagtgctggagaccgatcaaccgacaatggactgcacagaggcgcagaaagaagtttttgttgcgccctggatccactgcctcggcgacctcctgcagggaggagaggtcgcgacaggtcttcttcagcctgccccggagcaagagctagagtatggccccctggcgcatgtgcgagtttccgagatagtcacaaacgtttcatcatgcgcagaactgcactgttccacttcacccctacatcatttcacctcagatatactcttcggaagctatag

SEQ ID NO: 60885 - DNA, 384 bp, Artificial Sequence
  Description of Artificial Sequence: Synthetic coding sequence
atgctcccttcttcgacgccagggccaggccacgcaacagagacttgccctgcccctccgggacccgagcgaagccctgcagccagagccccagctgccgcttctagtctgggccctgtctcaacagccggacgggctcctcgcggactggacatgagcgcccaagaacctccgcaagggaggcgcttccccattgaggccggagattcacggggtctggccgctgctccagaaagccaggattcaccggaggcagttgccacagagcataatccagtgcgcccacttcgaaggtgccccggatgccactgtcttactctgctgcatgtgccaatcgacgtgtatctagctatggggggaagtcctagagctagggcaacctag

SEQ ID NO: 60886 - DNA, 408 bp, Artificial Sequence
  Description of Artificial Sequence: Synthetic coding sequence
atggttccagccccacccttcctgggagtgctggaaaaccctgttcctcagtgggacctgtccattcttgggagtattagaatccgcgtttctcacaccgaagtgcaagggagtgggtcctctcgatcgcccgaggcgctcaggaaggagtcactggaggtagagtggaccctcgtcctactggcaatcccccctcgcatccaacctagtcagcaggacggcggaccacctaagtgctgcgacctgctgagagcagcccttttgggtaggcactgcccgttgtgtgtgcccgctggtgaagtctttagtcagaaaagagacaatgaacaggacaggtcagagtttattggccagaccttgaagcttctggtgaaacggaatgtctctttagaactgtcttgcagatag

SEQ ID NO: 60887 - DNA, 717 bp, Artificial Sequence
  Description of Artificial Sequence: Synthetic coding sequence
atgcccggtcggaccggactggctggcgaaatgcccgtcggctggggccctggtcgggctggtgcttctgagcctaatgagtcaacctgcgcacccgaggctttggacggccatctaggtgtcgcccgacgcgagggccctatactagggacacttcttgggcgaggtaagggtcactgtcaggccctgtcacagctcggccactgtccatcaccggcttggaataactactctgggatgatggacatcggcgtggctccatcccgggtcgggcctagcggtcactgcggggtgctgagatcgcattcacgcccaggagagctggctgttgttatgaaccataaagttccccgacaccgccctgtctcaagcgtgggaactgagctcctctgggtgcgctgtgctccaaaaatggtgcagttgcctatctgctgcttgcttctgaccccagcacctggaatcggacccagagctcacggacacctccatacaaaccttgagactcgaggcctcccaagggggactcgggagagccagcaagcagagggcgagggcgaggcaattcaagaaggtagaggagcatgcaagcgagctcaacgcaaagagggcgagggtccccgaggaccgtgcgtagtgagggctggtggcgtaggctggggcactagacaggtcgcaggggaacctccattggtcgactgctccacagccggaacttag

SEQ ID NO: 60888 - DNA, 315 bp, Artificial Sequence
  Description of Artificial Sequence: Synthetic coding sequence
atggggcttggcgatagaaggggccgtagacgcgcttcggcaagcgcagctttccggaccgcctcctcttcttcctgcaactgctctcgttgttcgtctgctgatacccggtcaagtacttctatcccactggtacccgacaaactgtccagcgggcgtcgcggaagcgcaggatgcagagccactcaggagttacaatgccctaggggaccctcccgactgccgggaagcaagcgcggagccagccacgccccatttttaagcagatatctggggctgggtcatctcgatatgagtcaggggagaggtttgtag

SEQ ID NO: 60889 - DNA, 198 bp, Artificial Sequence
  Description of Artificial Sequence: Synthetic coding sequence
atgcctgccaagggcaagaaagggaaaggacaagggaaaagtcatggcaagaaacaaaagaaacccgaagtggacattctatccccggcagccatgctgaacctatactacatcgcacataacgtcgccgattgcctgcaccttaggggctttcactggcccggagccccaaaaggaaaaaaagggagaagtaagtag

SEQ ID NO: 60890 - DNA, 645 bp, Artificial Sequence
  Description of Artificial Sequence: Synthetic coding sequence
gccacaatggtctggttttgtaattccgccgattgtcagttcagcgtatttgccttaaccactattggttggattctgtcctctactagtaccggcctggtcgaatggagaatttggtacatgaaggacacttcgctgtaccctcccggaatagcctgcgttggcatctttcgggtttgcatatatcggcgaaggacaaattctaccacaaccaagttctgctaccgttattcttaccaggatacatttcttccgttcgagatctccatggcccagagatttcttctgaccgcttccatattcggcttctttggtcgggctttcaatatgtttgccttgaggaatatgtccatgagaatgtttgaagaggacacctacaactccttcgtagtatccggtattctcaatatcgccgcaggcgtgttcaatctaatcgctgtgctgcagaattacgacgcagtgattaactcgcaagggattacttttcttccgtctctgcagatgcctttcaaacctgacgtccaggaagtgggcacagccatacaggtcgcaggaatcggtgtcctacccatgttgttgacgggcatgttttcactcttttacaagtgcccccctatgctataccagatcttccccaccacttag

SEQ ID NO: 60891 - DNA, 345 bp, Artificial Sequence
  Description of Artificial Sequence: Synthetic coding sequence
atgtacacatctttaaagagtaccttcgtagcttttgccgatggtcggggtaccacagagtctatgcctagcccccctctggcgaactcaaatcacgagagccccgttaaccaattgggaaatatgcagaacatgagactaggcccaagtttcattctgactggtatcttcctgggcaatggtagaacagaggctagccccttttttacagatgagtttgcgctgtcgaaaattttcccagagtataagcgaaacctattcggcaagtttcaaaccaatatggcattctccttggaactcgatcccccaagtctattgctgagtgtggtcctgttcatgttttag

SEQ ID NO: 60892 - DNA, 1086 bp, Artificial Sequence
  Description of Artificial Sequence: Synthetic coding sequence
atggcgccacagcgggctgggccagggctgggcaagccttcttcaaagaaaagccgtgcgctgcggggtggccctggtgtcccaagggctagacagcggtcccctcgcgctgccgctgaactgaataccgaagtgcctaaaccttctgcaaaagatgtggagatcctggagcaggaatctgaggtgcttgagcccagcgtggaacaagatgcagagtctccgggtctgagcacagccgcaggatttgaatctccagagcctggccgtgacgatcctggtcccagtgaggcccagagagccgaagttcaaggtcagcaccccccaccagggcctaaaacttccagcagcagatccgggagcgaagccccacatcttcgctttcctccttgcccagaagcacctcagaggcctccagaggaacgttttatggagaccccgattgaaagggagatccgacgcagctgtgagagggaggaaagtctgcgacgaagccgtgggctctccccgggtcgagctggaagagagctggtcgagctgagagtgcgccctgtccttaatctgccaggcccagggccagcattgccaagggcactggagagggccagagccggtgcccaaatgcagagagatatcgaaagagaggcacaccgccaggctgcgctagccaggcccgcagtgccggagccccgtgccagaagtccccctcaacctctaggggagttaaaaagattctttgaagctgccgctggctctggaagttctgcaggagccggtgacggcgctggtcctcagcgcctgccggagcctgggggacggccacgaagcgcagtacaggggggatgccgtgtgttaggcagcgcacctccaccattcacccccagcctcctggagcaggaggttcgggcagttcgagaacgcgaacaggagctgcagaggcagcgacgctctgtctacggaactgccgagtttaaggagccaacaccatcacttacggctagtaggggagatgggaagttggtggttatatggcccccaagacgaaaggtgtccgaaaacggactggagcaggaagagcggaaaccatag

SEQ ID NO: 60893 - DNA, 366 bp, Artificial Sequence
  Description of Artificial Sequence: Synthetic coding sequence
atgaccgaccggaaccgggacaaaaagagcacctcaccgtccaacagcgataccgagatgaaaagcgaacagcttcccccttgcgttaacccagggaatccagtgttttcatgtatgctcgatcctaagacgcttcagacggccacaagcctgtcaaagccacagatgattatgtataagactaactcaagtcactatggggaattccttcccatcccacagttctttccgtgtaactatactccaaaggaacaggtcttctcatcccatatacgcgctaccgggttttaccaaaacaacacgctaaacaccgctcccgaccgtacaagaaccctggactttcctaacattcaacacacactctag

SEQ ID NO: 60894 - DNA, 561 bp, Artificial Sequence
  Description of Artificial Sequence: Synthetic coding sequence
atggaacagcccaaagacggcgcaggccctgagggaaataatctttcgctccccagctcgggcacagagccctggccaccagctccactaccggcaccccctccgcttctcctgaacagcaccgacccgacgcacctcggcctccccgagtctgtggctagcgtgaccgtaccaataagactggacaccctgagttgtcttctgcacagtgctctgctgggagcctacaccttccagcaggcgctgccctcgtgtccttgctgtagtcaggcgggacactcccagcctggagccgtgcgacggccacccaggggaaggggtggttgggaggtgcgccatagaccaggctggggcagagggctccaccgccgagggcttggaagagcagaacagccagagcgtggcagagccggaggccctggggctggccctagaacccctcccatgactctcccaagcccacccactctgcccgcacaagatgggaagaaagaagcacggggtcccgaaccccctctggaaactcctctggccgcagaagattgggaaaccgagtattag

SEQ ID NO: 60895 - DNA, 357 bp, Artificial Sequence
  Description of Artificial Sequence: Synthetic coding sequence
atgcaatccctgcggccagagcagacccggggactgttagaacccgagcgaactaaaactctgctacccagagagtctcgggcatgggagaagcctcctcatccagcgtgcactaaagactgggaggccgtggaagtaggcgcaagctcacatgactccgacgagaaagacttgtcaagccaggaaactggattgtcccaggaatggtcatcagtggaggaagacgacgagtccgaaggttcccagggtttcgtagagtggtcaaaagcaccacagcagactacaattgtccttgtagtttgcgtgctgttcctgtttttggtgctgacgggaatgcccatgatgtttcatatttag

SEQ ID NO: 60896 - DNA, 315 bp, Artificial Sequence
  Description of Artificial Sequence: Synthetic coding sequence
atggggaggattccaggtggatgctcttccaaggcgttcatcggcagggcccaatggttgacccctgtcattcctgccctgtgggaagccaaagggctgaccctgctatcccgtttagaatgctctgacgtaatcatggaccattgtagtccccagctcacggggctgaggatgaaaggattccttgctcagacccctccgctggagtttcccgtgcatcaataccaaccaggcgaccatgtgctgattaaatcttggaaaagagaatcattgaaccagctgcggagaacctcaagcggtacattagatgaatag

SEQ ID NO: 60897 - DNA, 381 bp, Artificial Sequence
  Description of Artificial Sequence: Synthetic coding sequence
atgaaaaagtggaaaagtaggcttttccctaggccacccaactggttgtcaggaaagtatctgaggctacccagctcagccatgtttctgattgatttttgcctgtgtgtcccttggaccaccccatttcagtgtaaaatcctgatggttgagtttattgttgggttctacgacttttgcttagcgcttgaggtccagtatcggacatcgaagttatttttgtgcggtcagccctcccctagacggagtttgggaatccaacagcaggctctaaagcttgcttgtctttccccaactctgctggaaagttcatcctgcgttgatcccccaggtaataccgccggtagccgaatgccgagctcatctaactgcattaaatag

SEQ ID NO: 60898 - DNA, 663 bp, Artificial Sequence
  Description of Artificial Sequence: Synthetic coding sequence
gtggagggggaggcccctggcctcttcctttcttcacaagagcagcgcgcaagagatacggaaggacctcgtcagggtgacttggaagccggactcggatggggctggcccctgcatccaggatcaaaccagggggctccccgacaaggaggtagtattggcagtggcacccgcccttgcccatgcccaccactttcacgggagggtggagctctggccagcccacgcgttgcgctctcccagctgcagtgtggcctgctaggatccgcagagcagtcatttttgcaattagagcaggagaatcactctttaaagcggcaaaaccaggagctgcgcgaacagctaggtgccctactcgggcctggccagcaattcctccccctgtgtcctgaacacagcagttgtacagccctggcctggccccctgacccagctggcacgcagccacttggaaaccgagcacccctgcagttgctaaggcgcgaactgtgtcaggggcaggaggcgtttgtgcaacagtctcagaacgaactgcagcagataagactttgcttcgagcgaaaaaaaatggtcatcaccgaggtgtgggataacgtggctgagatgcacatggctttaaacaaccaggccaccggtctcctggtgggtccccatcgagcttag

SEQ ID NO: 60899 - DNA, 363 bp, Artificial Sequence
  Description of Artificial Sequence: Synthetic coding sequence
atgtacagtttccctaccactgtcgtggaggaaatactgtccctgtccttacagttaatagctttcccgaccgtgtcatgtgaaattctgctggagattacaagccagactaacaaaaagcagacctgggagacttgttacgcacactctgccgaagaaattgggattattgcgggaaagaggatccataagactcaagctgtcccatacatttgcttcctgcttcggcaccaattcatcagtcagtcctcacacgtcagggtcgaggccctgtacagcttgctatttctcggtaccctgctccaggttgggaagggccaggaagtgttactgaaagacgcacttagagctagagcaccatag

SEQ ID NO: 60900 - DNA, 2568 bp, Artificial Sequence
  Description of Artificial Sequence: Synthetic coding sequence
atgtggagtaccggccctgaggccagggatggggattctagtgtatcctccggacgtctatcatgtagttcaggtggccatgacgtgtgcgttagttggaaggagagaccccctcaagtcctcggcccacagcaaaggcctaggaaatccgacgctagattggagcagctgcgcgataaaatacgcgctcaggcctggcaacagggcagttgtgccagcctgggtacaagtgcgccatcttccgcatcccgtcttcacaaagctagcactcttatgctccgcagaaagggacaggaagcaaaaaatcctcctcccgcacccgagtgcagcgggttttcaatcctttccgctgccgaaaggcgggtcgaagccaaggcaagtcacggccaaggcagggagctctctagagtctctcagcaccaagtgcctgtcctgagggaaaagcctaagcgcgtgaagtcttcctcatgtaagcgggaaaagactccgaagttgccttcaccaaggagagcagcaaaggacaagcataaggatgaggacagcgagctggtaggtgtctatgcatggagaaaaggacaggctctggttaggagtctactagggccaccaccagtcctccgcagacaccacagtaaagacccttcccgcgatcccgcactgacagtcgacctgggggacagcgaaaaagtgatcgctgccaaatgttctcctgtgtgcgctcagttacctgacgcaacgtctgcttacagcgatcagcaagtttcaggcaatacccccagcctggcatcatttgaccagcccgcaacaatacagacagcaatggcaatcctccaagatctacgtcagcaaatccaggctgggttggaactagcgcaggctagaaagggcggacaggagctagggccatcaaaacgtagactgcaggacgtggctggcaggggctgttgcagggacccaaacgcccaaagcagtttttccaaaagtccatgggctatgactgaacgcaagcattcctcactcgaaagagctcgctctgtacacacctgggagccatggtcaagcagcacagcccgagaatcttgtccacagcgtgcatggggcgcacaggggcaggaccgctccttccaacgacctgagagtccccatgagagattagggcacttctcgcagaggccttggtccgcgcttgccggacaggcttgtagtccccagagagcttggggcgcacaacgccaagggccttcttctcagcgtccaggttctccccctgagaaaaggagccccttcccccagcaaccgtggagtgccgtagctactcagccttgtccacggagggcatggaccgcctgcgagacttgggaagaccctggcccacgactaagaaacccactggagagaccttccccccctgcccagcgtccctggagttccagcggagtccagagggctggtcctcaaggcaaaggcagggggattggctctcccgtcagcgctgctaaacatgccctacctagacccaccgggtcgtttcctcaaaacccgctcggtaaggagaaggacaccctccgcccttgccccagaagtaggggattactgggaccaagtcacagctcagagtcacttcgggagtttatgcgccagaaggctcaggcacgcaggcgccaggcccttgaagagaaagccagcgccttacgtactcgcgaactccggagtagacggctgcaggaagtttaccgccagcaaagagaagcagtgctcgggcgagccgtgcctgttgttagtcggactacacctggcatcgtgacatttgttccatcatcagcccagagcggcggactggaggcctccgggtccctcgaaagcccagtgctggagtggtcaaaggtgacgagcgggatggtgctgggaggccaggaggctcccggaagcttctgcctgtgcctaaatcgggcttggaatcacgcagaaaccctggacccccctggaatggggggtccacaggatggcagggatgctcccgtcttgctgtctgcctcccccagcttgggatccctcgagttgcaagacctgactactcggtatctgccccgaggcatgtgcatttaccttgaccctaaagaggcggagcatcttggaacatccagtagcctgcatcttcggcataagcaggcacaattgcaggccctagagaccaccgcaaaagtgctaaagcaacgagtggactcactcaccgcgaagctccaaggagctgaggccctcgacactgtccgggacccggctgtcggattgctgcgcagctgcccccatagcctgccagccgcacccactcttgcaactcccacactagccacccctgcctgtcccggagcgcttggaccgaattggggccgtggtgctccgggagagtgggtgagtatgcagccacaaccactcctgccccctacatacttcctcgacggtgaaaccctgtcctggggcccaagctgggagcaacagcaaagtgtgtcacctcgggcacattgtgaaagcaagccaagaggagtgtcccaggctcctctactcctgtag

SEQ ID NO: 60901 - DNA, 2829 bp, Artificial Sequence
  Description of Artificial Sequence: Synthetic coding sequence
atggtggtttcagccggtccatggtctagcgaaaaagctgagatgaacattctcgagataaatgagactctccgaccgcagctcgctgagaagaagcagcagtttaggaacctgaaggagaaatgcttcttaactcagttggcgggtttcctggccaatcaacagaaaaagtacaaatatgaagaatgtaaggaccttattaagttcatgcttagaaatgagagacagtttaaggaggaaaaacttgcagaacagctgaagcaggcagaggagctccggcagtacaaagtattggtgcattctcaagagagagagctgactcagctgagggaaaaactgcgcgaaggccgagatgcatcgaggtcactgtacgagcatctgcaggcactgttgaccccatacgagcccgacaagtcacaggggcaagacctgcaggaacagctggcggagggttgccgcctcgctcagcacctggtgcagaagctgtctcctgagaacgacgaagacgaggatgaagacgtccaggtggaggaagcagagaaggtgctcgaaagctctgcaccaagggaggtacagaaagccgaggagagcaaagtgcccgaggattcacttgaagaatgtgccattacttgtagcaatagccacggtccatgtgattccaatcagccccacaagaatattaagattacgttcgaggaagacgaggtgaactcgacactggtggtggatcgtgagagctcacatgacgagtgccaggatgcgttaaatattttgccggtgccgggtcccacatcgtccgccaccaacgtgagtatggtggtcagtgcaggtccattgtctagcgagaaggccgagatgaacattttggaaattaacgaaaaactgagaccgcagttggctgagaaaaagcagcagttccgaaacctgaaagagaaatgcttcctgacccaacttagtggattcctcgccaatcagcaaaagaaatataagtacgaagaatgcaaagatctgatcaagttcatgctgagaaacgagcgccaattcaaggaggaaaaactggccgagcagctgaaacaggcagaagagctcagacagtacaaggtcctagtgcacgcgcaggagagggagctcactcaattaagagaaaagctgcgggaggggcgagatgcgtccaggtctctaaatgagcacctccaagccctcctgacgccagacgaacctgataaatcccagggccaggacctccaggaacagctcgccgagggctgccgtttggcccagcaccttgtgcagaagctcagccccgagaatgataatgacgacgatgaggatgtccaggtcgaagtagctgaaaaagtgcagaaatcgtcagcccctcgagagatgcagaaagccgaggagaaggaggttcccgaggatagcctggaggaatgcgcaattacgtattccaactctcatgggtcgtacgactccaaccaaccacaccgcaagaccaaaatcacatttgaggaagataaagtggactcaacactgatcggctcctcttcacatgtggaatgggaggatgccgtacatatcatacccgaaaacgagagcgatgacgaggaagaagaggagaagggccctgttagccctcgtaacctccaggagtccgaggaggaggaagtgccacaggagagttgggatgaagggtatagtacattgtctatccctccggagatgctggctagctatcagagctacagctccacttttcacagcctggaagaacaacaggtgtgtatggctgtggacatcggcaggcaccgctgggaccaggtgaagaaggaggatcaggaagccaccggacccagattgtcccgcgaactgctcgacgaaaagggccctgaggtgctccaggatagtttggataggtgctactccactccctcggggtgtttggagttaacagatagctgccaaccctacagatcagcgttctatgtgttggaacagcagcgggtgggcctcgccgttgacatggatgaaatcgaaaagtaccaggaggtggaggaggatcaggatccttcatgccccagattgagcagagagctgctcgacgagaaagaacctgaggtactccaggattctctcgataggtgttactctacgccttcgggatacctggagctgccagacctgggacaaccatattccagcgcggtgtactctctcgaggaacagtatctgggcctggcactcgacgtggaccgaatcaaaaaggatcaagaggaggaggaagaccaggggcctccatgccctcgcctatcccgagaacttcttgaagtggttgagcccgaggtcctgcaagactccctcgataggtgttacagcaccccttcatcatgtctggaacagcccgatagctgtcagccttatggtagcagcttctatgctctggaggagaagcatgtggggttctctctcgatgtcggagaaatcgagaagaagggcaaaggcaaaaagagaagaggcagacgctctaaaaaagagcgtcgcagaggacgaaaggagggtgaggaagaccaaaaccccccttgcccgcgattaaatggggtgcttatggaagtggaagaaagggaagtgctacaggacagtttggaccggtgttatagcaccccatccatgtatttcgaattacccgattctttccagcattacaggagtgtgttttattcatttgaggagcagcatatatcctttgcactctacgtggacaaccggtttttcacgcttactgttacctcccttcatctcgtgttccagatgggggtcattttccctcagtag

SEQ ID NO: 60902 - DNA, 267 bp, Artificial Sequence
  Description of Artificial Sequence: Synthetic coding sequence
atggctgtgtccaccgaggaactcgaggctacagtccaagaagtgttagggagattaaaaagccaccaattcttccagtccacatgggatacagtggcctttattgtgttcttgacattcatgggaaccgttttgctgcttttgctccttgtagtggctcactgctgttgttgtagcagccctgggcctcgacgcgaatccccaaggaaggtgtctccctggaaggagcggcctaaaggtgtggacaatctggcactcgaaccctag

SEQ ID NO: 60903 - DNA, 267 bp, Artificial Sequence
  Description of Artificial Sequence: Synthetic coding sequence
atggccgtgagtacagaagagcttgaggccaccgtgcaggaggtactaggtagactcaagagtcaccagttctttcagtcaacttgggacacagttgcttttattgtatttctaaccttcatgggcacagtgctcttactgctgctcttggttgtggctcattgctgctgttgcagctctccagggccaagacgagagagtccaagaaaagttagtccttggaaggagcggccaaaaggggtcgacaatcttgcattagagccctag

SEQ ID NO: 60904 - DNA, 252 bp, Artificial Sequence
  Description of Artificial Sequence: Synthetic coding sequence
atggccgtatcgaccgaggagttggaggctactgtgcaggaagtgctgggtagactaaagagtcaccagttctttcaatcaacgtgggacacagtggcgtttatcgtgttcctcacatttatgggcaccgtccttttgctgctgctcctggtcgttgctcactgttgctgttgctcctcacccggacccaggcgagaatcaccgaggaaagagcgacctaaaggagttgacaatttagcattggagccttag

SEQ ID NO: 60905 - DNA, 615 bp, Artificial Sequence
  Description of Artificial Sequence: Synthetic coding sequence
atgcaaagcgccttggtgggttcttggcacaataatgggttctatggtcactatcgtagccaatttaagagcgagagcgcacgcgaataccatttggctgctaaacctcagccaccagctgtcttcctccagagatgccaggagccagcccagaggcacttcttttcaaagcacgataatcgcaccagcttcgacaaaggtccatattgcctcctgcagggcatcggccgtcgcaaggacctggaacggttgtggcagagacacaccttccttcgctgggctccctgtgaaatcgagctgcgacagcaggggcctttggagagtagttatcaggctgatttcaggccgggtcccggtctgagtggactacctcagcacctgattcactttgtgcaggtgcagccctctcacacacgcactacctatcagcaaaacttttgctgccctagtcagggcggacactatggatcttacaaggtgggtccacaggctcctgtaacagacgtgctcccggaccttccaggaattcccaggcctaaacttctccaacattacctgcacgcaggggttagcgagtgcctgaactggtctagagccctgaacaaggactcatag

SEQ ID NO: 60906 - DNA, 1140 bp, Artificial Sequence
  Description of Artificial Sequence: Synthetic coding sequence
atgcagagtttcctgactctgctgaaggaacatgaggatacatgtgcacccccagcagagctcgttacccttgcagggaggctgtgtagggatttccaggatgacctggcccaactgcagcctttagtgacagcgattctagattctcaacttaggctacacctgctcgacaacgcagacgtggccctcgcttgcgccagagtgctggaccaacaggagcagcagcaagctgcatgtaggctgctggaaggatgccaggttcccggagggtcacaggaactcgtccagctgtggaatgacattcactacaggctggtaatgcgccgtcttggggtggccgcactcactcctgttcagaaattcagatgtagaaagcgtaatccccctcctccttcactgtgccctgagggactcaaatcccgtaactttcccagagaagtccgggagaagcttcacaattttgctgtgggcgtgaacaccaacccctctaaagccgagcgtgaaaacctggccttggaaacaagcctgacaccagaacaggtctacaactggtttgcgaactaccggaggaggcagcgcgctctgccacagcatatgaagccagcccagcaagccaccgcggaagatcctggtgccagagaacgcggacccgatttactacagccgagcggcaatccccgagtcgactctggatttgttgacagaccacagtggtctgaagagagagaagagaagggccctccccagagtccccaaactacacagggcccatgggaacccctcgcattggcaccagatttccctgctgatgaaacagtgagcaaaccattagatgtttctggccacccccagagcgtccagttggaggaaggcctgggaacctcctcaggtaggactgagctgagagtgggctcctttctggtcacccagccacccctgcaagcgccagaatttattctgacacagagtcccccagagctggctccggctccaagtgccttcccaggcccagtcagtgccatggagctgtcacaggctctgccgagctcccaggtgcaatgctcggatagccaggcatccggggacgctttttggggcgctcgtatgctacttgagttttccggatcatccctggggtag

SEQ ID NO: 60907 - DNA, 366 bp, Artificial Sequence
  Description of Artificial Sequence: Synthetic coding sequence
atgtctctgcacggaatcctggcctccgccggtacaattggggctgtggcggcatggctcatgagctacaaaccggctctctttggcttcctgttcttgctcctcctgctctctaactggctagtcaagtacgagcacaaacttaccttgcccgagccccaacaggacgaaatattgcaacgactgttgttctccgagatgaagatgaaggtcctagagaatcagatgttcatcatttggaataaaatgaatcaccacggccgatcctcgcggcatcgcaacttccctatgaagaagcatcggatgcggagacatgagagcatctgcccgacactcagcgactgtaccagttcctctcctagctag

SEQ ID NO: 60908 - DNA, 756 bp, Artificial Sequence
  Description of Artificial Sequence: Synthetic coding sequence
atggacaccactctgaggatggtcaggactgcctgtcaacatcgggcaccacagatttctcacaagaccggctgctcccacatcagtatgcactctcccggaggactcaccaccacaaagatggctgggccacttcctcgtgtgtcagactccctgttcagcgctatggaactggctaaaatgtccgacatgactaagttacaccaagctgtcgccgctggggattactccctcgtcaagaaaatcttaaaaaaaggtctttgcgaccccaactataaagatgtggattggaatgataggacccctctacactgggccgctatcaaagggcagatggaggtgattagactgttgatcgagtacggggctaggccgtgtctggtcaccagcgtgggttggacccccgcacactttgcggctgaagctggacacctgaatattcttaagacactgcacgccctccacgccgcaatagatgcccctgattttttcggtgacacccccaaacgcatcgcccagatttacggtcagaaggcctgcgtggccttcctggagaaagcggagccggagtgccaagatcacaggtgcgctgctcagcagaaagggctacccttagatgagagagatgaggactgggatgccaagaagagagagctcgagctttctttgcctagtttgaaccagaacatgaataagaagaacaaaaagagtcgcggtcccacaagaccttccaacaccaaggggagacgcgtgtag

SEQ ID NO: 60909 - DNA, 378 bp, Artificial Sequence
  Description of Artificial Sequence: Synthetic coding sequence
atgccccctcaccctgcgatcttcttttactgccttcttcggcagggtctgacaatgctacccaggcttgtcctgaacttctgggcacaggctgttcatctccctcgcccaccacgggtgcttggcctacaagcaggaggcactgctccaggccagaaaaagctcttcctaacaagccattttcctccagcatctccgctgcctctgtgtttctctctgcagcagaacttcaaaaagcacagccccagaagccctcctggcatactgggctcactctatccaggattttgctctcctattgctacttctccctttgccaagggaactagaggcttgagggtggtaggttccagcggtcgccttagtgccagcagctag

SEQ ID NO: 60910 - DNA, 390 bp, Artificial Sequence
  Description of Artificial Sequence: Synthetic coding sequence
atggccgctgctacttgggataaggagtctaaatgccgactgtcacgcggtcattgccaccatcggagacaccaaagcttgcccgtaggattgactttgcgttattccgcgccagcctcgcatcagccgaaatgcttcacttccaagcacgggacgcgtccctctcagcgaaaaccgagcctgagggtatctgggcactactccccccacagcctgttccccggtcatggcagaaggggagcttgtgttgctcggtcccgacggtttgccggacacatgcagttaacatggaaactcaagagaaagaagccagggaggactgcttccagcgaagagcacaagaagcagggccgtggatgcgcaggacgacgattgattaaaagtacgtag

SEQ ID NO: 60911 - DNA, 711 bp, Artificial Sequence
  Description of Artificial Sequence: Synthetic coding sequence
atgcacacttacgtgtatagctacactagaatttgcatccatatgtatatacatatacatgcctatgcttacatatgtattttcatatatacacatatgcacacctatgtatactcctacaccagaatttgcattcatatgtatattcacatccatgcctatgcatacatctatgtctatagctacactcgaatctgcattcacatttgcatcttcatttacacccatatgcacacatacatgtacatacacatccacgcatatgcttatatctatgtttacagttacacacggatctgcattcacatttgtgtgtttatctgcactcatgcctacatctacgtttattcctatgtgcaatgcatgcacatgtgtatacatatgtacacttgtatgcacatgtgcatttttatttgcacgcatgcttgcatttgcgtgtttacgtccactcacgcttgtatttgtgtcttcacgtgcacccatgtgtacataagcgtgtttacctgcacacacgtgtacatatgcgtgtttatctacatctgcattcatgtgtatatccacatttatatttgcatacacatctgcgtctattcctatattcacatgtatacctatatccacacatatacatacacctatacccaactcttctttaaccatctgagcatcgacgaacactccctgtttctgtacctcggctactgggagtag

SEQ ID NO: 60912 - DNA, 450 bp, Artificial Sequence
  Description of Artificial Sequence: Synthetic coding sequence
atgcgcctgctcccacggaccagtatcccacggcgtcagcccttcagccgatggcgtaagcagaatctgaaaactccagtaagtctcaattgttcgcgcagctgcaagctcctggagggaagaggaatgccagcaatctttatcatagcattacctcctcctaatactatcggcggacctgcactaattatttcattgcaggtttatcccgcagccccagagcggcaaagacccgcacggaggggacatgatgatggaggaggttttgtaaaaacaaaaatgggcatctgccgggagaagaaagagaggtcggattgttattgtgtgtatatcgaacgggaagatatccgcgatagcatcctgaaaaaaacatgtacactgaacaattgcttcgcagagatgcttttgatctgtagctttgccccagctacactgcctcaacctctgtag

SEQ ID NO: 60913 - DNA, 444 bp, Artificial Sequence
  Description of Artificial Sequence: Synthetic coding sequence
atgatctacgacggcaataaccaactgctcaacgcttctaaggtcggcgaagttctgcggggaggaacaaggcagatatactaccaggtggtaaacttcagcagcctctggcctttatacaagtatgcggataaactgcatgtaatcttactctacaagactttgcaccagctggtggtggagcctgtgaaggtggctgcctggtactacgagtccgccaggctgttgaatacgtacggactgctggggatgaacgtagcagggatttcatggcatctctatatctttcacttggtgtgtactgacaccagtgtctcgtcatcagccccactgccatgccccctgccccttatccaccagatgttgatcatcttcgtttggcgcctattgagggcctgtctgtattgttctagcctcgccttgattatatggagctactcctag

SEQ ID NO: 60914 - DNA, 1242 bp, Artificial Sequence
  Description of Artificial Sequence: Synthetic coding sequence
atgcggggtgggcacagtccagccgcagcccctgcccacactggaggaagacgcggagggggagcccctgcaccccaatgcgtccgttccccggctgctttatcccgtcgtcaccagcctgggaggttgctgctgcacgtctgcagccccgtaccctggaccgggaccgccaccgaaggtcaatcggttggcacatgtttgcctggccaattcactcgcccactcgaccgccacagacaccgcggatccgaatgctggcatttgagcagtggatcagtccatccatccccagggccagcacccgcacaaagggtacgcgttttggcacccgtgttccgaatctgtagtccgttacccaggaccgggaccgccacggagggacaggagtgctggcacttgagttcagggagtgtacatccctcccccggtccagccccaccccagcgagtaagatccgttggaacctgccttcctgatttgtttactcgcccacttgatagacaccgccatcggggatcagaatgctggcacctgtctagcggcagtgtacacccttcgcctgggccagctcccccacagagagttagggtcctcgcaccagttttcagaatctgctcaccagtgccgtggactgggacagccactgaaggccagagcgtggggacatgtctacctgacctttttacacgccctctggaccgccaccggcacagaggatcggaatgctggcacctatcctccgggagtgtccaccctagccccggtagcgcacccgctcagagggtgagagtcctggcaccggtgttcaggatatgcagccctgtgccatggactggtactgccacagagggccagtcggtgggtacctgcctgcctgatttattcactccccgtttagaccggcaccgccatagaggatccgagtgctggcacctctcttcagggtccgttcacccatcaccaggccctgcacccccacagcgagttcgggttctggcccctgtattccgcatatgttcccctctgccttggatcggcacagggacagagggccagagcgtgggcacttgcctgcccgacctgttcacacggccacttgacaggcatcgacacagaggatcggagtgttggcatctgagctccggctcagtgcacccaagtccagggctggctccagctcaacgtgtggagtgctggcacttatctagcggctcgccaagtctgccactctttgtggaatag

SEQ ID NO: 60915 - DNA, 435 bp, Artificial Sequence
  Description of Artificial Sequence: Synthetic coding sequence
atgatcagggcggcactgctcgagccgcagcctccaaagctgaaacaatcctctcatttaagcccccaaggcgcagggacaacaggtgccggaccccatacgccactgacttttctctatttcttccgacttgagctgttacaggccgctctgccgcctcaaccacctaaggtcctggtaagacagcctgggggaaaagacagtctcgctgagtcccctttcgatctgagcaccggaagaaacgcaccttgtggcggagccctgggaaacttgagacacctacagtggggaggcgcatggcccctcctcttccttggcggtacctgggattcggtctatcaggctggttcaaccttagcgttggggagagtcagtgtgagcctatttttctttcttcccaataaattccacagccacccctccagacacctgtag

SEQ ID NO: 60916 - DNA, 366 bp, Artificial Sequence
  Description of Artificial Sequence: Synthetic coding sequence
atgaagggctacagagacaatgcggttgagtccaccttcacatcgcggttttatggaagtgagaaatggcttcaaataacatacctcaagacacagatgccctctggaagcgcagggaacattgaagatcttacaagcttctttatatttctccggcaaagcttggccctgctccccagactggagtgtagcgggacaatctccgctcactgcaacctgtctctgccgggaagcagcattagtcatgcgtcagccttcagagtagcgggaattaccggtgtacactgtcggacgcaattgatcttcgtctacttggtggaaactggattccaccacatgctcgcacgcatggtctctatcagctag

SEQ ID NO: 60917 - DNA, 399 bp, Artificial Sequence
  Description of Artificial Sequence: Synthetic coding sequence
atgcttagcccgttatggcttcagatcagcaaaagaccacggcctgaagtctctgtgagcaacgcatgcttcagcagtgcgctaccaacctctaaccctacatctctgaccctcaaacatcacaacatcttcgtgttgagggtggcgctggaaataatccaatacagtgtccatgggggtcggaaccgcaagccattagaggtgacgtccttggcctattcttgccctgagaactggtggcaaaaacagataggggtgcaaccgcctgatgtgcacgccagcgctctgagcccaaagccctgcgtgagctggtctaggcctctgtctcttctgtcctcaacgattctcttctggaaaactcacgacgaacgcgcagacttcagtaagcttcactcctag

SEQ ID NO: 60918 - DNA, 465 bp, Artificial Sequence
  Description of Artificial Sequence: Synthetic coding sequence
atggaaatcatgcctatgaatatcgtaagcattatatcacctctgattgacgtttccccagggagacgcggacgccttaagaacgccggaggtggaatacggctcgccgaacgggtgaataggcgggctgataggaacgtgttgcggagggaaaaaggcttagccctgggacgggtgacctttcctagggcaggaagaggaagccgggtctccgcccctgcccgttctgagccgggtcccgcagccgtacccggtggcgtgagaagggctgatgaccgtaagtttccacccggagcttctcagcccgcatttagaagcaggagatttcaggcagcagctggaggtccctcatatgccaacgatcccacaagttcagcgaaaccagtgaagttgcttccccgtgaacgggcagggctgaaggtgacaaatttcagtcagagccgtgagagagaagggtcagcctag

SEQ ID NO: 60919 - DNA, 387 bp, Artificial Sequence
  Description of Artificial Sequence: Synthetic coding sequence
atgtcctgccatcaatcaccactggtgtttgatgttgggcagtgccgccaacacgacctggccggacagattttgatttaccactcgctgacaccggctggcccactaggacgccctcctgacgtcccacatagtccccacctggccagtccaaccgggagtcggcagcggaccgtaggcggtacatgtgatactgcactctttctgtgttcttgcttctcatcatcttttttcagtttgctggtgacactcttctttttcaccctctcgccgcataagactagaaattttgtgattctgctgatctttctgtacagcgtttgcctgcacacagatggctatctgagagcatctgagctctccttgcccccttccatcatctcctag

SEQ ID NO: 60920 - DNA, 414 bp, Artificial Sequence
  Description of Artificial Sequence: Synthetic coding sequence
atgcttggggtggaagaccttgtgggtgcaggcaggtggggcagagggcctgagaatttgccagactccggcggtcggttggcagaacaggcattgcaaggtccttcacatcctttctcctgtctgccaccaccagaacaaatactgggggcttggcgcgcactgaaggaagaactgcttagccgggcaccatctcaattcacactgtgcaccgaagtcctgcagagttctaacctgagccctacgcctgccgtaagtcctttcgtccagagttcagtggaaatggagaagtttctggtccctctgtccatgttcttgtccggcgagcgcacctggaaactacttctgcaggtagacttcctgaaccagggaggagaatactacagaaactggaggaaaagacggaggacttag

SEQ ID NO: 60921 - DNA, 1122 bp, Artificial Sequence
  Description of Artificial Sequence: Synthetic coding sequence
atgttccttgccgacgtgccaacatctctgcatttccaatcgatgctgaagagccagtggcagaacaagcccttcgataagattaagcctcccaagaaactgtcgctgaagcatcgagccccaatgcccggatccctccccgatcccgcaagaaaggaccgccataagttggtaagtagcttccttacaaccgccatgcttaaacaccacaccgacatgtcctcttcaagctacctggccgctacacaccatccccctcactcaccgttagtcagacaactgtcgacgtctagcgatagccccgcacctgcatcaagctcgtcgcaggttaccgcttcaacttcccagcagccagtgcgacgtagacgcggagaatcatcttttgatatcaataacatagttatccctatgtcggtagccgctacaaccagggttgagaaactccagtacaaagaaatcctcacccccagctggagggaagtagaccttcagtctttgaaaggatccccggacgaagagaacgaagaaatcgaagatctctcagatgccgcatttgccgctctgcacgcaaagtgcgaagagatggaaagggcccgatggctctggactacctccgtgccccctcagaggagaggctcccggtcttatcgatcctctgacggccgtacaactccacaactggggagcgccaacccatctaccccacagcctgccagccctgacgtctcatcttcccatagcttgtcagagtacagccacgggcaatccccgagaagccctatcagtcctgagctgcactctgccccactgacccccgtggcgcgagataccccaaggcaccttgcttccgaggataccaggtgtagcactcccgagctgggcctcgacgagcagtctgttcaaccttgggagcgtcggaccttccccctcgcacacagcccacaagccgagtgcgaggaccagctggacgcccaggagcgcgcagctagatgcacgagacgcactagcggatccaagaccgggagagagacagaagccgctccaaccagccccccaaccgtccccttgaagagtagacacctcgtggcagcagccacagcgcaacgccctacccaccggtag

SEQ ID NO: 60922 - DNA, 3318 bp, Artificial Sequence
  Description of Artificial Sequence: Synthetic coding sequence
atggccgctatggctcctgccttgacagacgcagctgctgaggctcaccacatccgtttcaagctcgccccaccctcttccaccctctctccaggatcggccgaaaacaatggcaacgccaatattttaattgctgccaacggaacaaagcgaaaagctatcgcagctgaagacccaagccttgactttagaaacaaccccacaaaagaggatttaggcaaactgcagcccctggtagcaagttatctgtgctctgatgtcacttccgtgcctagcaaagaatcattaaaactgcagggggtgtttagcaaacagactgtcttgaaatcacacccgcttttgtcacagagttacgaattgagagcagaactccttggtcggcagcctgttttagagttttcactcgaaaacctgagaacaatgaatacctcgggccaaacagctctcccccaagcccctgtgaacggcctagcgaaaaagctcaccaaatcaagtacacatagtgaccatgacaactcgacatcgttaaatggcggaaagcgggctctgacatcgtccgccttgcacggaggcgaaatgggaggctccgaatccggggacctgaaaggcggtatgaccaactgtacactgcctcatcgttccctcgatgtggaacacacaactctttattctaataatagcacagcaaacaagagctcagtgaactctatggagcagccagctctgcagggctcttcccgcttgtctcccggaacagactcctcatcaaacctgggaggcgttaagttggaggggaagaagtccccccttagctccattctgttctctgctctggatagtgacactcggatcactgccctgctgagacgccaggcagacattgaaagtagagctcgaagactgcagaagcgcctgcaagttgtccaagccaaacaggtcgaacgccacatccagcaccaactgggaggctttctcgagaagaccctgagcaagctgccgaacttggaatccctgcgaccccgttctcaactaatgctcactcgcaaggccgaggctgcgcttaggaaagccgcttccgaaacaaccacatcggaaggactcagtaacttccttaaaagcaattcgatatctgaggagcttgagagattcaccgcaagcggtatagctaatcttaggtgcagcgagcaggcattcgactcagatgtcacagacagttcaagcggaggagagtccgacattgaggaagaggaattgacaagggccgatccagagcagaggcatgtgccgctccggagaagaagcgaatggaagtgggcagcagaccgagcagctatcgtgagtcgatggaattggctccaggcgcacgtttccgatctggaataccgtatccgacagcagacagatatctataaacagattagggcaaataagggtttgattgtgctgggggaggtgccgccacccgagcacacgaccgacttgtttctgcccctttcgtccgaggtcaaaaccgatcacggcaccgataaactcattgaatcggtttcacagcccctggagaaccatggagctcccatcatcggccatattagtgagtctctctccacaaaatcatgcggggcactgagaccagtgaacggggtgataaataccctccagcccgttttagctgaccatatccccggagactcttctgatgcagaagagcagttgcacaaaaaacagaggctcaatttggtcagctccagtagcgatggaacctgcgttgctgcccgaaccagacccgtactgtcatgcaaaaaacgtcggttggtgagacctaatagcatcgtgcctctgtccaaaaaagtgcatagaaacagcacaataaggcccggatgcgacgtcaacccttcctgcgcactgtgtggatcgggcagcatcaacactatgccacccgaaatccactacgaagccccactcctggaaaggctcagccagctggacagttgcgtgcaccccgttctagcctttcccgatgatgtgcccaccagcctccactttcagagcatgctcaaaagtcaatggcagaacaagccctttgacaaaatcaagcccccaaaaaaactgtccctgaagcacagagcacccatgccgggtagcttacccgacccagcaaggaaggacaggcacaaactcgtttcatcgtttcttacgaccgccaagctcagtcatcatcagactcgccctgatcgcacccaccgtcaacacctggacgacgtcggggctgtcccgatggtcgagcgggtgacagcacccaaagccgagaggctacttaacccaccgcctccagtgcatgatccaaatcatagcaagatgcgcctacgagatcattcatcggaacgttcggaggtgttaaagcatcatacagacatgtcaagttcatcctacctcgcagcaacacatcacccaccgcactcccccctcgtccgccagctgagcacatcttcagattccccagcacctgccagttcgtcttcacaggtaacagcaagtacttcccagcaacctgtgagaagacgtcgcggagagtcttcctttgacatcaataacatagtgatccccatgagcgtggccgcaacaactagagtagaaaagttgcagtataaagagattctcacgcccagttggagggaagtcgacctccaatcacttaagggatctccagacgaagagaacgaggagatcgaagatcttagtgacgccgcattcgccgctctgcacgctaagtgtgaagagatggaaagggccagatggttgtggactactagcgtgccaccacaacggagaggttcccgttcctaccgcagtagtgatggtcggaccactccacagctgggttccgccaacccatcgacaccccagccggcatccccagacgtgtcttctagtcattcattaagcgaatattctcacggacagtctccacggagccctatcagtcctgagctccattcggcacctctcactccagttgctcgcgacaccccccgacacctcgcatccgaggacactagatgcagcacacccgagctgggcctggacgagcagtctgtccaaccctgggagaggaggaccttccccctcgcgcactcgccgcaggcggaatgtgaggaccagctggacgctcaggagcgggctgcaaggtgcacgagacggacatcaggttcgaagaccggaagagaaactgaggcggcacctacctctccacccactgtgcccctgaaaagtcgtcacctggttgccgcagccaccgctcagcggcctacccatcggtag

SEQ ID NO: 60923 - DNA, 486 bp, Artificial Sequence
  Description of Artificial Sequence: Synthetic coding sequence
atggggcaccgccctaacctaggtcagccaccacaccctaatgccgttgccgcagccctgcacgcctccctgtgcccagccaacaggggcacctgtcccctggggaaacctggctaccctggctgtctgtggtttcagcctctgctgctgtttccaggctgtctctgctcccctgacggaccgttccctcgtgcagtgttcacatcagctggtaaaggacctctgcagaccgacctgggccgaggacgtgtcccacccagagaccaacagactcctaaatctgggccatgccccagggcacctgtggcctctaaccgccagtccgggggtagcgcggtgagcgccccactgagcggggcacggagagcttggaagtctgctttcgcagccccaccacgatcccggctgcggcctcagaaaggcgttccctggaccgagaagcgagctcgcggaggaggacgtgctggtccatgcagaaggacttag

SEQ ID NO: 60924 - DNA, 372 bp, Artificial Sequence
  Description of Artificial Sequence: Synthetic coding sequence
atgcgttcagaaaaaagtaagggttgttggcgtgacggaggagatgcccacccaggggaaaaggcaagccagtcctcgggaattacaggcgtaagccatcgaacgagactgacatccgtattgctgcgcaatacccagcggagacgacatcgtaggggtgagcaccatgtaatggtagatacggagatcggggtgttgcaacctcaggctaaagagctgttggagccccctggagatggacgctgcaaggagcttattttcagtcagtccctttggcgggaatgcgggccaggcgatactctgatcctggacttctggcccacggagccttgcacacaggaagacttcatctcacaagtcagcctgcagtag

SEQ ID NO: 60925 - DNA, 630 bp, Artificial Sequence
  Description of Artificial Sequence: Synthetic coding sequence
atgctgagtagtcagctctgttgcgttcactccctgcccccaaccgccaatccagccgctctctgttctttggcccagcaaatgtttaccaatattcgcagcccctgtagtggaccccagggttccccaggtctgccaaggagaacgcacattcatctttggccccactcagcacacatgtacttcttggtgacatccagtttactgcctttccctctcatccagcccggatgttcccgcacccgattcaagaccctctgcagcctgcggcacacgtccgccccaacggaggaaggacatgggccagtccgccgtccatgtggcatgcattgtcttagtcatctgccacaccctagaggtcgtccccagggccacccaactcatatgagacccgctctccaacaggccttactgagccacccctccctgttacttccctggagatcctcccccgacagtgctgtgcaggttggcccatccatgatactgcggagaattcccatggcaggacatctatgcttcccccattggccccagctcttagattctcgagattgttgtacatacacatgcattaacactcccgtgcttaattcgcacatggtgcaggaaggagtgtgcggacaatag

SEQ ID NO: 60926 - DNA, 642 bp, Artificial Sequence
  Description of Artificial Sequence: Synthetic coding sequence
atgtcaccaaaatgcgcggaaaccgcccagcagcttcgctgcttgaccgagaacgtccaacgtcccctgtgtccaacgatgccagcatgggggaggccttctctgggactgcttagagtgtctccagcatgtcagcctaagggaggacgaagttgtgggtgtagtcagccattacttaaggtcggtctctgggtcgaaatgtgggctgcctctgggagacactcatataaatgtatcccagcgctacgcacaaccttcctgctgccatctccgttccttcgtacacctatgcaaaagaggggcaggcagttaacgaaagatagggaagggtactgctcctggcatctgatgggctccatctgctgtatacccctgggctgttgtcctggctggatcgggaaagagctggccggtcgtctgtcgtcggtcttgactacctggctgggcggtggtagaggggcatggcaggagcagtcagctggaccaggcaattggggtttggttcacgtctgtacccatgtatgtgtgtgtgttcgagcctgttgggtgggacgcgaggaggcggttaaacctcacccactcctcagtgctgctgtgctcctgtgcgtctcagcagccaggggatgccaccataccagctag

SEQ ID NO: 60927 - DNA, 612 bp, Artificial Sequence
  Description of Artificial Sequence: Synthetic coding sequence
atggattccgctcctgctggctcgttctctgcaagctcttttttcgatctcagtgttactgtgaccagggctaagaactctcgcggaccctcttccagcccttccgagctgcagggagcgcattgtctgacctcctcactggcagcagcctgcagcgtggcatacagcgccctgtggagcagttcacctctcaggtccccgtggtcaatatccagtatcacgatgcccagactgtcttctgaagagagttccgcttcactgctggccggagcggacgggaggccgccacggctgctgtttctgcctttctgggtaaacctactacgtttagtcctctttcttcgtcccaggaggcccctgctgggatttctcgccgcacccaggtccgagcccgcatgccccgtgacatcccccgagagctgggcttgcgtgagtgaggcgggaggcgttggtgcctcacccggtgtacctgcttccgcggcttgcgtgggtccctcgtctagctccaggcggctcatttgtttgaggaccttggtctcctgcgcacggtcttttcatcgtactctgcaaacccctagcctccccggaatttcactcggaatggctgcttag

SEQ ID NO: 60928 - DNA, 666 bp, Artificial Sequence
  Description of Artificial Sequence: Synthetic coding sequence
atggccgctgctgggcctctgtgcacagagcgggttagcgtgctgtcccagcccaatagtggagtcgaggacccaaccccagcgggagggcgagggcaaggaaggaggagaggacgggaagaactcgagtcaatcggcgcaggcccaggcgcatcagtcagaatactcccggcactgcgccctgggctaggtggagtgtggggtgctggagctgctagtctggtgtttcaggccggtcccggaagttcgtggctaggatggccggacctcgacctggccctgtatagggggtgggcgtgccgaagtgaggggactgccaacgtggctttcccgggaacagcttcacccggttttagcagagccaggcagacccgcgacctgcggaaaccggcactgaagaccccgagccacacggcctcacagttggctgccgaggctggtaatccatcaggcggatgtccctccatgaggtgtcaaagacgagttggtgcactggtccccacatggaaggggggttggcgggatggctggagcggttccggcggtcgcgcaaaagagcgaatcctggccttcagtttccctgcaggaggaggcattcgtggagagcgagtgcaagcggctagtaacacacggatttgggaagagccagggtctacgcctaattag

SEQ ID NO: 60929 - DNA, 378 bp, Artificial Sequence
  Description of Artificial Sequence: Synthetic coding sequence
atgcagccagtgatttcagcactgaacattcagacacagacagtgcaaactcacccggcaccacgcaatacttccgagcattgtacactccccgcttgcgacgctcaagaggaacatagagatacagtggatggctccatcgcgaggaccgagagcgcatcaggagaaatatggcggcaaactcacatggatggtgagcaccacgtgaacaccaaggcagaaatctcagtcatgagtgcaaaccagggtgctcctcgcataaccagcaagcctccagaggccagaagagaagctagggaccggagcctgcccagtgccttttccttgagggggctgactgatactctgatcctcggattttgtcctccagaactctag

SEQ ID NO: 60930 - DNA, 369 bp, Artificial Sequence
  Description of Artificial Sequence: Synthetic coding sequence
atgaaagtggcccttttgaggttctttagccctccaaatatgtccgttacacataaagaagcacacgagcggaaatgtcctgaaaaacccgaactttggaaagccggttccaccgttcctctgactgcacccgaaaagactgaccccttcccattatgccccccacttagtctcacatgtccccagcagcagtcctgcatcccgagttcatcgcaagatgtgctgaactcgctgtgggtcagttcacactgtttgcagcttaagatatccaagacaaagacccactgtttgcctacccaaaacgtgctgccttttctgctgccaacacccgtgagcatagtgtgcagactgcccggtctagacccgtag

SEQ ID NO: 60931 - DNA, 459 bp, Artificial Sequence
  Description of Artificial Sequence: Synthetic coding sequence
atggaagccgaggcctggggaagtcaagctagagccggtctcggagcggcagagaattgtcttgagggaggaaatcaggcttttctccttgagcgcgtgaccggcactaaggggagaggacaaggtcaacctctggaaagagctggggaggagggggaagctggtggggatccccgaagggatcccggtgaggtagtggctaaatcaagggtgcgcgcacggccacatctcagcctatatccggctctgcccggtgtggccctggcccttctttgttgtccgttacaggatcggtgcctgcggctggtgccagcctgcccaaccgctgggcctcagcatccccaggttttaccttgggcactgcagaaacagggggtggttcggtcgggaccctgggccacagaagaaatggtctggggaacacggaccggcgtcggcggactcactgctgtcttttag

SEQ ID NO: 60932 - DNA, 879 bp, Artificial Sequence
  Description of Artificial Sequence: Synthetic coding sequence
atgcagccttctcgcgaagccttggagcttcgtggtttgccaaagagcgtttccacagtaagcagtactaaaccccctctcaccaccccctcctcaactaacccttcaaggcaactggcacttgaagattgcgttcaactccgtgcagccttggacctggggtacgggcctgaatgttgctgtcatcacctccccgaggtcgcccacaagtccagtgcaagcgccggtgcgccatcagctcgcttgcccctgcagccgcacagtctcggcaccaggacaaagctaccaccgtcactgtgtctgcccggtcccggtcgcacacgcctgaccacggaaccattccccggagcgcctttctgctctgactcatgcagccctgctctttgctgtgtactccttactccgggaagggggcgaggatctgtcgctccactgggaagtagccaagatggcagaggcggatgctgccccaccgatacagttcccgctgcgcaggggatggacgcctcttggaccgttgcccctgctcaggagtggctaggacacccactgcagtcgtgcccccagagtgctagtagggggcatctgcccctaccgctgcctactcccactaccccttgtatcagccagccaccaggtcgaaggtgccggccacattgcggcaaggagctatttagggcacccggtgctctacattttttaccaaggcggcatccagctgcagtgcgtcaccgctggaccagggcgtgccccgagggccctaggatgcacatccctcaagggtggctgctgtcaagcccctcactgctgactgactggtttagcatggatagttttaagcccccatcactcgccagtggccagatctctaagacttag

SEQ ID NO: 60933 - DNA, 900 bp, Artificial Sequence
  Description of Artificial Sequence: Synthetic coding sequence
atgccagagggcagtgtttccgccatgcgaaccagcccaaagtccagctggccgtggtgttgtagctggtcgtgtgcttggtcatctagttcccccccatggaggtcaccacccagcgctactgggaccctgtgtcgaagttgttcactagcgccttccggtgacctggaagttctcaagagccaggagactggctgccgggatcccctgcagctgcccggtctgctcggaccctgcgccttatcgccaatggtgggcagcccctctggacgcgtcaagcttgttgggagacgatctgtggtgcaatgctctaggtgctgcatagacccccttatattctttgtgttcgtctttatcctgttctgctttgtgttcgagatggagagttgcagtgttacgcaggctggggtgcagtggtgcgacgacctcggctcacttcagcctccccctcctggcttttcctgcctgtcgctgccaggatcttgggactataggcaccctccacctcacccagctaatttctgtatcttttccagagacgaagtgagtacacccacccaggcgggtgttaagttgctgaccgctagcgatctgcctacgctggcgtctcaatctgttgccattacaggggttagccatcatgcgcagcctaatccgctgatcttttgcttctcatccagcacagtccgaaaggctttcgatcgtggccctcggaggtggcagcatggtggcggtctcaccgtgtgggtggtggttaaggccctcgagtcccaattgcagagggaggacgtggatctgagggacgggcagtgtcacctacatcgccgactggaggcgccagcttggggcaatctgcttggtaaggagggatcgaagaggggaactatgaagcaaaattag

SEQ ID NO: 60934 - DNA, 843 bp, Artificial Sequence
  Description of Artificial Sequence: Synthetic coding sequence
atgactagcctaactcacgggatgcacctaactagctccacttcttgcagctgccagtcatccgggacaagtttcacaagctgctcctgccgcagcagcggaacgtcttccacaagccgaagctggtggagctccggaacttcctcgactagttgtagctggtggtcttccggcaccagttctactttctgttcttgttggtctagtggcacctcttttacatcttgctcatgctggagctctgggacctcttctactccctgctcatgtaggagctccggtacctcgtcaacatcttgttcctgctggtctagtggcaccagcagtacgtcctggagctgtaagagcagcggcaccagctctacctgttatatgtgcctttcttcgggcacaagcagcacaagttactccagttggagttcccagacctccagcactagctctatgtgcctgccaagcaggacttccagtatcttttactcgtgcctgccactagggcaccacctgccattctgttcggtgagaccacttggtccacccaccacatcacccctctcgaacttgtggattcttagccatccattctatttggggggagtgtggcccctcaataaccacttacacatgaacctgctgggttacttcaacaatctccatttgtggtcccttggtctacaacctctcccaccaccaggatctcctctagtccacctaccacccccacccctgggctggcctttgctgtccgaactcctgcaagacctgaaccagctaccttacccactattgcccgtaggccctagacctcggcctccgcatgtactcctgggtatctttatctag

SEQ ID NO: 60935 - DNA, 477 bp, Artificial Sequence
  Description of Artificial Sequence: Synthetic coding sequence
atgcttgatggcggacgcaacggcagattgcttgagttgtcttcattactacccgagcggggaggtggaccttctctgtgtagaagtcccgcttcgacggagaaagaggttggcgcttgtggaacccttgctagtctgaggagaggcctgtggaaatgctcattgtgtcccggacctgctctcctgttggggggaagctgttgcttgatctgttctctcagcttactccttcttagcacccctacttttttttcaaggaacttcgagcctagcttcagcccctcccccatcgagaaaccaagcgccccaagctcagggcagagctctcagttgcagacccaagtccaaccccctgctgagcgaggcgctgcctctatgccagggcctgcgtcccttccactgagcactggcccttctcagccattgagatgtagtcctagagtgctctgttcgagggtcctcgcgctaagacgctag

SEQ ID NO: 60936 - DNA, 480 bp, Artificial Sequence
  Description of Artificial Sequence: Synthetic coding sequence
atggctacagtcgatcctgctggactagcactgcatcctgcttgtcctcgcgtgtggggcccttctgaccaacatcgccctcctcaagaaggaagccatttgcccgcacgcagacgtggcctggccaggaatcaatcgtgccagcatccagacttgggccctcctgcctctcgaactgaaaaggaaatgtccgctgtggctgccccaggctgcgcagcactcctccaacctcctcagcagacatcagtccaaagttttaagggcatgtctctgtccgttgaggcagggctttgcggggagcctgcaggtaagctcctgggggaagggggaggccaacgggaagcttccctggtaggcaaaaaaggctgggaatggcgtcggcaccggggacgtacactcagcgaagaggatcaaggggctagaccctttagcccaggctcatgcgctctgagaggcgaccgcgaagggggtatagggtag

SEQ ID NO: 60937 - DNA, 618 bp, Artificial Sequence
  Description of Artificial Sequence: Synthetic coding sequence
atgcgcgagcctctgattcccccatgcaaagcagcctcgctctccgaacaggaacaggtccgcggtgaatgtggaatgatgaccgcgcagggaattctgggaccacgcggaaagagtaaactgccggtgcttcctgaccctcggttaatttgtaggtacatgtgttcttgtcgagagattccaggagttatatccacgcccgtgccacactccgcaggaccacaggtgacaagatttcacagcccatcgccaccccacatctctgaactttcccagaccctgcacgccccattccaaggtagttggcctagaccatgccacgcactcagcggacccagggcaatggttccaaatcagctgcatcccggtactccctgcccggctcacgtgcctcattcctgcaccatgcctgccggaacctgtccactgttcactggagcaccagctgcagccgaagctggtctaaacccaggaccagccctgcgggctcccacctcctgttccagcagcacatggcccaaaccgttcatgacagtctgcctgctccccacctcaagtatgttgacctctcctggaacgggaggctgtatacgggcaagaatcttggaacctgcttag

SEQ ID NO: 60938 - DNA, 453 bp, Artificial Sequence
  Description of Artificial Sequence: Synthetic coding sequence
atggctgtaaccttccagatgcttgctgtccagcaatctaccagccatgcaattcagagttggcactcactgcggccatcttgtcagagacgcccagatagcagttgtacacgactgtcgggaatgaccagcgccgctactcggaccagcgagaccgcgatggacgctacccggctgtggggaactaggtggaaggtgagaacccgcagaatggttgctagcacgagccgattccaggccaacgtggctgctaccagaaagccatcaaaagcagccggttgctctctcaactcggttttggggaagcctgtgctgggtgaaccagccttttgggatctcccatcggtgccagtggctcctgcgaccccctccgaggccgctgctcccgaatcagagtgctggcgggctcatagggatctcccgtaccccagtggggatctagccctgcagtag

SEQ ID NO: 60939 - DNA, 528 bp, Artificial Sequence
  Description of Artificial Sequence: Synthetic coding sequence
atgacccgtccgctgcccgaaagtatcaggcttctcagacacacaggcctggtaccacccaccccggtgccacttggttaccctcaccaatcgttcgtgagccagccccaccctttttcaaaacaacctagcccatgtccccgacaaagcccccaaggcgactttggctgggtttcacccggagcctcacgttccattacgggtccctcctctcccgctgctccatccctgatatccctgggaagcctcgggagccacctgcagggagcccgaccccacccacggcagtcctctctcggagattttggtcttgttacaccgggaaccccctgctgtcgactgtgcccccctctgctccttccgcaaggccgtccaccgtgggtgctctgcgcaggcgtcagcaaagagctgggcccaaaccctgtcttgccttcccccatcgtggaacaaaggctgggacacggagcagacatggtacctccaccagaccaggaggagtggaatgtggtcatgtcccagagtacttag

SEQ ID NO: 60940 - DNA, 528 bp, Artificial Sequence
  Description of Artificial Sequence: Synthetic coding sequence
atgaccagacccctacctgagtcaatcagactactgaggcacactggcctcgtcccaccaactcctgtcccactgggctacccccaccagagttttgtgagccagccccaccctttctcaaaacaaccgagtccttgtcccagacagtccccccaaggcgattttggttgggtgtcccctggggcttcacggtccatcaccggcccttcctcaccggcagctccatctctgatatccctgggttccctggggtcccacctacagggtgcaaggccccacccccgacagagctctctcggagacttcggtttggtgacaccaggtaccccatgctgccgtctctgccccccactgctcctcccccaaggcagacccccatgggtgttgtgtgctggggtcagtaaggaactgggccctaacccagtgctgccaagccccatcgttgaacagagacttggacacggtgccgacatggtgcccccacccgatcaagaggaatggaacgtcgtgatgtcacagagtacttag

SEQ ID NO: 60941 - DNA, 591 bp, Artificial Sequence
  Description of Artificial Sequence: Synthetic coding sequence
atggccgctgcttcggttccacccgaaagctcaattatccaccctgcatcaagcgcgataaagaggaccgatggtggtaggctagagcttgaaattcggatagggatttttgcccagttctggtccgcatgcctactgttccctcgctgtagtcagccgaggcagcccaggagctggggcccaagggtcaatgcatttgccctgtggccggctacaagaagacctgcacacactggtcggagagtgaccccagccagagcctgcagccacaccagcggaactggggctggtagaaaacggaagggtggagagacgtcatttcagagagagtggagcgaaaatcggagggaaaaaggacaaggaaagattcggtcacctgctcctgagcctgctggtggcgaggcaagttccagccccgcaccggaggaacgcggtcccagccactgctcccaggcaaatgttagtcccgctagctgcactctcccagggaagaccagaatccactctctgtgccgggaaggtaatgcgggtcggactcccagccaaccaccactgtcgggctacaagacccccaataaaagaaatctgtag

SEQ ID NO: 60942 - DNA, 423 bp, Artificial Sequence
  Description of Artificial Sequence: Synthetic coding sequence
atggggctggaggccaaaaacagcccatgttgtcaccagcacggcgacttcgtaccctaccccattctgtcggcccgtgtctttcagcctgaagtggaagaggccacactggccgctcacgccatttcccatgattgtgtctgtagtgggggaggcgtactgctgcctcacgattggcgaaacaactatatgattctgcttaaccctcaggtcctggccgatgaaagaggacaccaacggccagttgccttcctggcctataaggtgaatggccagtatattatggaagggtttgcttcatcattcctgttcaccatgggcggtctgggcttcatcatgctggaccaatctaatgcccctaacattccaaaacttaaccgatttttcttcttttacagccttgattccagcgttagttactag

SEQ ID NO: 60943 - DNA, 462 bp, Artificial Sequence
  Description of Artificial Sequence: Synthetic coding sequence
atgcatctgaaaaaccctccaaaccctccccacctcccacctgtcgagagcgcccgaaacaagacaattctgctgcagcagcttagcgcactgccagattcgcccctctgggggctgggaatgactcgggttttcctcgccgatctcacagaagcgtctctggcgctctgctcattaatcagcttgaaatgccttcctggagactctgggaaatccggcaaggttagcctgggtctggccggatgctcaggtatccagacctccgtggcgccttcatctcaacaacagaaaaccgctagctgcgggacaggaggccgatgttgtggaccccatcccgcttctccgagaaaaggggctggatctcacagtactgcaagagcatggccaagcaaaggtgaggcccagctcttttcgccaccagcaagtgctggatgcagcggaacgcagccaggggtcacatag

SEQ ID NO: 60944 - DNA, 549 bp, Artificial Sequence
  Description of Artificial Sequence: Synthetic coding sequence
atggccgtgaccggtgtccagtgctccgagcgctgtaagcaaacccgcagggtggattcatccagcgggaaatggctggccacaccactgatctgggaaaaattaaattggcctagccgctcacagagccaaaatctgcatcctttccggattctgcccaacggcttgacattaccgggagcccaggagcgaccaggctatctgctagcagcgttgcccaatccctgcgcccctaggccataccaggtccactgggtgcacgttgccgtgctcatcgcagtactgctgcagcaactgccccagtctcggtgtctcaggctgccactgcctgggggtggaggcggacagagagctctgcagggcaggcttaaaacacaagccggaaaacggggtgtgcgcaaaagaggagggtggcgcgagagagagcgcccaagtgcagatccgggtgagagaggactgagggtcggggctcaagtgcagaatccacgcgctcctcgaaaaatttttgccattccagcaacctcaaaagtccaactgaggccaatgtag

SEQ ID NO: 60945 - DNA, 435 bp, Artificial Sequence
  Description of Artificial Sequence: Synthetic coding sequence
atggcggatggcggaggaggcggttctgggggtgcgggaccagcgtccacaagggcgtcccgcggactgttcgactccttcagaagagactgcaaagcggatgtggacacaaaacccgcttaccaaaacctatctcagaaagccgataatttcgtgtcaacacaccttgataaacaggaatggaatccacctgcaaatgacaatcagcttcatgacgggctgaggcagtctgtggtacagtcaggacggtctgaagccggtgtagatcgcatcagctcccaggtagtcgacccgaagctgaaccacatcttcagacctcaaatagagcagattatacacgagtttctggtggcgcagaaggaagccgcagttccagcgttacctcccgagccagagggccaggacccacccgctccatcccaagatactagttag

SEQ ID NO: 60946 - DNA, 861 bp, Artificial Sequence
  Description of Artificial Sequence: Synthetic coding sequence
caaagatgttgtcggtgctgttgtcgatgcccttgctgcgggcagggcccacgctcgggttgtaaaatccccgctggtgacgctcgtgtgagagacggcgctggaggttcggtacacctttgtgccctctttggtctgctgccacgagtttggctggagagattctacccttgtctgtggcctcttgtgccaggcagagggcagtgtcgaccaggcgattccgctaccaacaactccacccagaaggtgcaaaaagaaacccagggcagatttcatctgctaggtgacccttcccgcaacaactgtagcctgtctattagagatgccagacgcagagataacggcagttacttcttttgggttgctcgcggaaggactaaattcagctataagtattcccctctgtcagtgtacgtaacggcactgacacaccggccagatattctgataccggagtttctgaaatctggccaccctagcaatcttacctgtagcgttccttgggtgtgcgaacagggaacacccccaatatttagctggatgtcagctgcgcctacatcgctggggcctagaactttgcactcttcggtgctcacaataatccctcggccacaggaccatggaacaaatctcatttgccaagtgacatttcccggtgccggagtcaccaccgaacgaactatacagttatccgtgagctggaaatccggaactgtggaggaggttgttgtactggccgtgggggtcgtggcggttaagatcctattactatgcctgtgccttatcatccttagtttccataagaaaaaggctgtgagggccgtggaagtcgaggagaacgtgtatgccgtcatgggttag

SEQ ID NO: 60947 - DNA, 834 bp, Artificial Sequence
  Description of Artificial Sequence: Synthetic coding sequence
atgccagagtcggtgacagtccaggagggcctgtgcatttttgtccactgctccgtgttttacctcgagtacggttggaaagattcgaccccagcttacggtcactggtttagggagggtgtgtctgtagaccaggaaacgccggtcgctactaataacagtacccagaaggtgcagaaggaaacccagggccgtttccacctcctgggagatccatctcgtaacaattgttcactgtccatccgggatgctaggagacgcgataacggttcatacttcttctgggttgctagagggcgaactaaattctcttacaaatattcccccctgtctgtgtacgtcaccgcattaacccaccggccagatatactaatccctgagttcctgaaatctggtcatccaagcaacttaacatgtagtgtgccctgggtgtgcgaacagggcactcctcccattttctcatggatgtcagcagctccgaccagtcttggtccgagaaccttacactcatcagttcttaccattatcccccgacctcaggatcatggtactaatctgatatgccaggtcacgtttccaggggctggagtgactacagaaagaactattcaattgtccgtatcttatcccttaatgaacccggtgatcgaggcatccttggaagacggaaccgggaaaagcgggaccgtcgaagaagtagtggttcttgcagtgggagtcgtagcagtgaagatcctgctgttatgcctttgcttgattattctgtcatttcacaagaagaaagcagtgcgtgctgtggaggtggaggaaaacgtctacgcagtcatgggttag

SEQ ID NO: 60948 - DNA, 543 bp, Artificial Sequence
  Description of Artificial Sequence: Synthetic coding sequence
atggccgagtctttgccacttgaaatgcttacctatatcctgtccttccttcccctgtcagaccagaaagaagccagcttagtcagttgggcctggtatcgcgctgcccagaacgccctgcgcgagtctctaggccttcgcggaatatgttgcatttccctaaccaatttggacggaagtctggccagtcaccaagtcctccagtcagtcgcttaccacctcggcccacacctgcagagtctctctcttggaggtgggtccccaacagaggcatcaagtgtggcactcattctgggctgcccagccctgtgcgtgctagacctgtccggatgtaactcactgtttacttccggtacactgttggctcaacctgaaatggcccagtctgtgcagcaagcgctgtcaggcctgcgggagctgaatctcgccggtttgcgggatctcgccgatctgagctttaatcaacttagctcctgtgcacccagtcttgagcggctctccctagcttattgtcatctaacttttgaactggggccagcctag

SEQ ID NO: 60949 - DNA, 702 bp, Artificial Sequence
  Description of Artificial Sequence: Synthetic coding sequence
atgaggctcctgccactgctccgaactgtactatgggccgctttcttaggaagtccactcaggggcggttcgtctcttagacatgttgtgtattggaacagcagcaacccttccttacggcgtgagggatacaccgtgcaggttaacgtcaacgattatcttgatatctattgtccccactacaactctagtggagtgggcccaggcgctggaccgggtccaggagggggagctgagcagtatgttctgtatatggtgtctagaaacgggtaccgaacgtgtaatgcgagccagggattcaaacgttgggagtgcaatcgccctcacgcgcctcactccccgatcaagttctctgagaagtttcagcgttatagtgcctttagtctcggctatgagtttcatgcagggcacgagtactattatatttcaacaccaacccacaacttgcattggaagtgtctccgaatgaaggtcttcgtctgttgtgcttccactagccactctggcgaaaaaccagtccccacattacctcaattcacaatgggtcccaacgtgaagatcaatgtgctggaggactttgaaggcgagaacccacaggtgcccaaactggagaagagtatcagcgggacaagccctaagagggagcacctgccccttgcggtgggaattgcgttcttcctgatgacatttttggccagctag

SEQ ID NO: 60950 - DNA, 495 bp, Artificial Sequence
  Description of Artificial Sequence: Synthetic coding sequence
atggaggatgagcggatcctcgataacttaggtgcagaaggccgacatggaagcgagtgggagtggcgccgatggcactttggtggctgggtggaagaagaacaccgccaccggtggccccgaggagtatggtccacggacaaaagtcccggtggggtacaaccacagtgccttagtcaggaggtcagtgctcttgtatcaggaactcaatcctccctgcgtaatgggctaggggacaaatggtcagcctgctgcactagggccctaggccagatggagcagacgaagcagtctaagcgacgcgctggtagggaggatagattctctgtggcgttaggtcggtgtcggggtaatgagcacaaaaccttgagtcacgtgcctggtgcatctgatgccgctcagaagccaagagccaagccttgcagtaggggaatcggcgcttctgttctcttacagaccatgcatctgtctttcattaccctgggcttcagatag

SEQ ID NO: 60951 - DNA, 1323 bp, Artificial Sequence
  Description of Artificial Sequence: Synthetic coding sequence
atgtctatgctcgctgagagaaggagaaagcagaaatgggccgttgacccgcagaacactgcttggagcaacgacgactcaaaatttggtcagcggatgttggagaaaatgggatggagcaaggggaaaggattgggagcgcaggagcagggcgctacagaccatatcaaggtgcaggtcaagaataaccacctcggtctcggagccaccatcaacaatgaggataattggattgctcatcaggatgactttaatcagttgctcgctgagttaaatacctgccatggacaggaaacaaccgattcaagtgacaagaaggaaaagaaatctttctccctggaagagaaaagtaagattagcaaaaaccgggtccactatatgaagttcactaaaggtaagtcctggaaggcgctgaccctgtcccaaaaaagaccttacgttgacgaggcagaacgcctcaggttgcaacatatgcaggattaccctaattacaagtaccgaccacgccgaaaaaagcaggcaaagagactgtgtaagcgggttgatccgggttttctactgtcatcgctgtcacgggatcagaatgcactgccagaaaagaggtcaggcagtcgaggtgcgctgggcgagaaagaggatcgcggtgaatacagccctggcactgctttgccgagcctgagggggtgctatcacgagggaccagctggcggtgggggaggcggtaccccttctagtgtcgacacatacccttatgggctgccaactccacctgagatgtcaccactcgatgtgctagagcccgagcagactttctttagctcaccatgtcaggaagaacacgggcatcccaggaggattcctcacttgcctggccatccatattctccagagtacgccccttctcctttacattgttcccacccgctggggtccctggccttagggcaatccccgggagtcagtatgatgtccccagtcccaggctgtcctcccagcccagcatactatagtcccgctacttatcatccactgcatagtaatctgcaggctcatctagggcagctcagcccccctcctgagcatcctgggttcgacgccctggaccagctatctcaagttgagctgctaggtgatatggatagaaacgagttcgaccagtacctgaatacgcccggacacccggacagcgctacaggagccatggccctatccgggcacgtccccgtcagccaggtgactcccaccggaccaacagagacctctctgatatctgtgctcgcagacgccacagccacctactacaactcctacagcgtcagctag

SEQ ID NO: 60952 - DNA, 888 bp, Artificial Sequence
  Description of Artificial Sequence: Synthetic coding sequence
atgctaccggacttcaaactctattataaggcaacagtgaccaagacagcctggtatcgctatcagaatcgcgacatcgatcagtggaaccgcactgaaccttccgagattacaccacatatttataactatctgattttcgacaagccagaaaagaacaaacagtggggcaaagactccctgtttaataagtggtgttgggaaaactggcttgccatctgtcgtaagctcaaattggatccttttcttaccccctacacaaaaatcaactccagatggataaaatacctgaacgttagaccaaaaaccattaagactgttgaggagaacctgggcataacaatccaagacattgggatgggaaaggatttcatgtctaagactcccaaagccatggcgactaaggctaagatagataaatgggacctgatcaagcttaagtccttttgcacggccaaggaaactactatccgggtcaatcggcagccaaccaaatgggaaaagatattcgcaacgtatagctccgataaagggttgatttcgagaatatacaatgagtttaaacagatatacaagaaaaaaacaaacaatcccataaaaaagtgggccaaggatatgaaccgccacttcagtaaggaagatatatatgccgcaaagaaacacatgaagaaatgttcaccatcactggcgatcagggagatgcagattaaaactacaatgaggtaccacttgacacctgtacggatggctgtgataaaaaagtcaggtaataatagatgctggcgcggatgcggcgaaattggaacactgcttcactgttggtgggactgcaaattggtgcaacctctctggaagtctgtgtggcgattcttgcgggacctcgagtag

SEQ ID NO: 60953 - DNA, 372 bp, Artificial Sequence
  Description of Artificial Sequence: Synthetic coding sequence
atgcagtccgaaaaaccccagggactgtttctgcagctgaatccaaatgcgtctagcacagaaactcagctgttagtgcctgccctcgaaagcagggacacactgccacctactcattgtttcatggcgggtacagagagtccgttgggcaacccatggccactaagtctaccccctccctgttggaccggctgtttgctccccgcacccagaggacagcgaaagcctggcccactgggcctctcaatattcatctcccttggaaacaagagacacagatcaggcaaccatgtagtgagagaatccgaacagcccttatctcagggcaatccccatcaagggtggggacccgataccaggaagggcaggtag

SEQ ID NO: 60954 - DNA, 372 bp, Artificial Sequence
  Description of Artificial Sequence: Synthetic coding sequence
atgcaatcagaaaaacctcagggactgtttctccagctgaaccccaacgccagttctactgagacacagctgcttgtgcctgctctggagtccagggatacacttcctcctacccactgttttatggctggtaccgaatcaccgcttggtaatccatggcctctatccctcccccctccctgctggacagggtgcttgctgcctgctcccaggggccagcgtaaacctggtcccctggggctatccatattcatttcactcggcaataagaggcatcggtctggtaaccatgtggtcagggagtcagagcagcccctgtcacagggaaacccgcaccaggggtggggtccagacaccaggaaagggcgatag

SEQ ID NO: 60955 - DNA, 855 bp, Artificial Sequence
  Description of Artificial Sequence: Synthetic coding sequence
atgttatccgtggtggaaaacgggttggacccacaggcagcaattcccgttatcaaaaagaaattggtggggtcagtcaaagccttgcagaaacagtatgttagtctcgacatggtggtgaccagtgaggatggcgacgctaatacaatgtgtagcgccctggaggctgtatttattcacggtcttcacacgaaacacatccgggcagaggccggaggcaagaggaagaaatccgcgcatcagaagcctctgccacagccagtcttttggcctctgctgaaggcagtgactcctaagcacatcatcagcgagctagaacatcttacattcgtgaacatggatgttgggagatgtcgcgcttggctgcggctggctttgaacaacggccttatggaatgttacttgaagcttctgctacaggaacaggcaagactccagctgcaacgaaaggaatctctggacagcatctcccatagtagcggttctgaagatatcgaggtgcaccacagcggccacaagatccggcgaaatcaaaaaccaaccgctagttcacttagccttgataccgccagctctagccagttgtcatgtagcctcaattcagatagttgtcttctgcaggaaaatggatccaagtcacctgatcattgcgaagaacccatgtcgtacgatagcgacctgggaacggccaacgcggaagatagcgaccagagcctccaggatattaagatttttagctgggcacagtggctaaccccagtgattcccgcattatgggaggcagaagcaggcggaagccaatcacaggagatagagacatttcttgctaacacggtcaagcctcatctctactag

SEQ ID NO: 60956 - DNA, 516 bp, Artificial Sequence
  Description of Artificial Sequence: Synthetic coding sequence
atggattggacccctcgtctgccttcccgacatatcatttcagaattggagcatttgaccttcgtgaatatggacgtcggccgttgtcgcgcttggctcaggctcgccctcaacaatgggctgatggaatgttatctcaagctgcttctgcaggaacaggcacgattgcagctccagagaaaggagtctttggactcaatctcccattcttctggtagtgaagacatcgaagtccaccactccggtcacaaaatccgaaggaaccagaaacccaccgccagcagcttgagcctcgataccgcctctagttcccagttatcctgctccctgaattccgactcctgcctcctacaggaaaacggttctaaatccccagaccactgtgaagagcctatgtcatacgactcagatctcggaaccgccaatgccgaagacagtgatcagtccctacaggagaagacgcgggctggaagccagcgcatgacttcgaccgggctgccgggaagtaatccatag

SEQ ID NO: 60957 - DNA, 576 bp, Artificial Sequence
  Description of Artificial Sequence: Synthetic coding sequence
atgcccgcagctatagcacctaaggatgacctttctatccggtttctgaagccgtggcttggcgagggcatcctgctttccggcggagacaaatggtctaggcatcggagaatgctcacacctgcgttccacttcaatattcttaagccctatatcaagatcttcaaccgtagtgtgaatattatgcatgacaagtggcagcacctcgcttcggaagggtcctctcgcctcgacatgttcgaacacatctctttgatgactttggactctctccagaagtgtatattttcctttgacagtcactgtcaggaacgtccaagcgagtacattgcaacgattctagagcttagcgcactcgtcgagaagcgcaatcagcacattctgcagcacatggacttcctgtactatctgtcacacgacggctggcgattccgtcgcgcttgcaggcttgtgcacgatttcaccgatgcagtgatccaagagcgccgacacaccttacccacacagggcatcgtcattagtagcagaactaagccgagcccgagattatggattagtttaatgtgtttttgctag

SEQ ID NO: 60958 - DNA, 4098 bp, Artificial Sequence
  Description of Artificial Sequence: Synthetic coding sequence
atgtcatctggcaggagacgaggatccgctccctggcatagcttctctcggttctttgcaccacgatctccctcacgagacaaagaagaggaagaagaagaaaggcccggaacatcccctccaccagccccaggtagatctgcagccagtgtggaaaacgaacccatgtccacctctcaaaaaaaagagaacgtactgtccagcgaggcagtgaaaattaggcagtctgaagataagcgcaaccatgccgagaagcccgtcactctgccggtgcaggaggatcctaaaaaagcttacgatctaagttcttcaactagtgacactaaaattggagagtcagaccgacagcccaaggaatccttctttcaatttttggggaacctcttcaacatctctggaaagtcttccctgggagaagccaaacagagcagttttaaggacgaccaggataagacagagaaagatctgcaaaacccgtctgaccatcatgaagacggcattaagcgggagcgggaaatcttcagcggatctctgcgaactcagacccacccaaccgaggaacaggactcgaattcaagtgagctgagcgatgccttttctctcgacaccacacaggattctgatcaggagacaaccaacttactcaagcaaatcgatgggaaaccagaaaaacccagcgtcacatatgctacctacaggggacctaggcacatcggaaagtacctgaagcagcagaccggcttagctactgtcaatacactcgaccgagagaacgagagctccgattccagtaccaaccggcacatcgacccgggttctgaaattgaagctggtgtgctgccattgctgctcagcgccagtacagattcttctatgaagggaaatctgctagagggaccactggaagattccgactgttccaaaacatcttttaataaggagaactcccttactaacaacccggagctgcagaatatcgctagttctaataatttattgaacaagaatgcatggggctccattgagcgtaataggagtagcccttcctcagtaaccaacagctcctatgacggcgagtctgacagtcaacatcacctatcctgtgagcccgtttcccagaccaatcggaacttggtttgttcggcactcttgactgggtccaatcaccgaaaggttccatgttctccagacttccagcgtgtcacaaccaccgagaatacgattaaggagaatagcactgtaatgtcaaataggactttggtgcagcgggaggagctggtcgaaccccaaggacctgccatttccgatttctcctgtagtaaatccgatggctctgatacaaccgagcaggagtccacaaatctgccttcgcccaacaagtctattcgccatgaacacctccaactcccagaatctgaatgctctgacaaacagactatcgacagttcctctaagcaagccgcaactcacactaacataattgcactccagcgccatgcagtaaccgacacagaattcgttaatgaaggtaagagactgagcgctcaggattcccagaagaacgttgccgtcagagagatacgcagggagacggaatccgcaagtgccggagagtctattgcctcctcccatgtgaaggcccctgaggataaaattgagtccctccctaaagacaccgatcagtattttgaaactaaagctaaaaagttagatttcagaagtcatgataaaatcccccacatcagaatgaacaaaaaggacttggcatctctgaattacatctccgaatccgctgtggtggcttccctgggaaacgaaaacgcgcctgaactgaaatttgagctgaacaggagtcatatctctgagacccccctggacagcgaaagtcctcagcaggccgaggtcagcccagacgcaaaaactagcctgtctctggactgcaagaagttgaatttttccatctcccctcctacttttgtgtccggcgtggggatgctttctaagttagacatcccagacctgatgaatgaaggcagtcccgtgcccattgaaaccggtaatgttaacattgttggtatcagctaccagcctcgaaaatgtaaggaagagaatgtgaagaaccacgtggaggccgctggaagaaagagcccacccccatccttttgcctcgagtacacatctgcgatattcgaattcaaggaggtgttgtcaaattctgaaaagtgccaagtgctccctggttctgaagctagtggcccacatctcaccggactagagctgttatcttttgacagcggcaacctcagcaaggattgcagctccattcttagccaagatcccaatcgagtggagctggtgtccagtaacacaaaggccaacatgagtatcatcgagaaaagcgactcactgtcactagaagcaaagacggctaacatcgtatccaaggccgagatcgacggccagaacaatgttctggtcgagagccactcgggtcgcggaaagacaatttcactgagcaaagtgagcctctctaaggtggagcccagaaacataagccaggacaaaatgagttcattccccctcaagattacccacgtccccgaaaagccgatcttatccgagctgacctttttggaggtggaacagggtaaaaggttccaatcaattaatcataatgagattggagagaaatgcagcgacgccggactcaaagagaactgtcaggctgaactgtctcctgccgcttctaaatatgaggataagcccgaacccgaggtggatgcgttggggtcacctcccgctctgctgaaaagcaacatttcctggatacttccccctattcacgatgaaaagatctcccgccagatggctcagaattgtgaggctcatacctgtgtgtttcatcagagtctagacatttgcggtactaagaaaatatccggccacagcgagatggctgaattgagcctaaccaatatctcccccaaatttcaagagacgggcagcatgaaggtgaactcgccttttctggattccgattcctctcttgagaaaaattcctcagcatctgaggacagctcctttttgaaggttcccagcgtgctgaaactggaaaagaagtcatcttcttatcgcaaaaaggagaatatccattttctcaatggcggtattgacagtgtttccagttcctctagctatccggaagaggtctccatgattgtgaacagccacaagcctcagaataatcttgactccatccaggtcacaaaggacctcacgcacgaaggtacatcagtcacaaacttgctttatcctacaacatcttatctggagttcgagaccagcgtttcaatcggcacggaagtgacaccctttcaggagcacttcggcatctacactgggaaaatcagcattgattttcctacagctgcccagttcgataaccttgtggaagccgagacgggggctgttgcaggaccggcagcctccgtgaattcatccggccagcagtgctcggaggcctctgccgaacacatcgaggccaggaggagagcccatgaccagctgctcgatcttaaatcatccttactgaaaaaggctgataccctgatcggtgagatctttaactccgtccgcgaagaactgaagttcaaacatacggtgtccacctgccaagagcacattgctatcgaaggcatcatgaacctgggtaccctgaaagaagatatttctgaaaagaacccatccgaagtgactctaactgaaatccagcaaaccgaaggcctggaggaacagggaatggaaaacatgtctgaggttaaagaaaagccatgcgtgtctccaaccgtcggcgaaaagaatttacttgtcgaccccaactccatgaacgtgagttgtctgctggaggacaaggcacgggagttagtcaatgaaatcatctacgttgcacaggagaaactccggaacgatacctttgaggataccgaagacacatgggattctgaactgcaggccaacactagtaagattctgaattccgatagtgtgaaacctcacgacgtggtgcgcgagtttctagtctccgaacagcctgtctag

SEQ ID NO: 60959 - DNA, 372 bp, Artificial Sequence
  Description of Artificial Sequence: Synthetic coding sequence
atggcaacccatcggagcaccctcgcaggttattccccgtgttcttcccctcagagggccgcacccaccagaaatcagaaggccgagaaggccaggaatcgccaggccagccccattcccacccgcctgccacgcaatccttcccttgcctctactgggagacaggggacaccaatgagcaggaagaagcaggggtccgactgtttggtgtacccaggccacccacctggtctttggccagtgattagctgccaccttgggttgagtgcactgtcttcagaaatttggacaagtaattgtctgtgtctggcagcgttaccatgcgacactggtctggagagcttgactgtggtgtgttggagtgggatctag

SEQ ID NO: 60960 - DNA, 375 bp, Artificial Sequence
  Description of Artificial Sequence: Synthetic coding sequence
atggtgagggctacgcgaggctactgggaagcgaagggaaagtggcagacatggttacgatttcgtaagaagtctagcaagtgcagagaggcccgtaccttcccctccttcaaatttctcaaaggaagccagtcttcgtttagctctctccttcagatgcctttgcagtcatttactgcagctcacacgtatagaaggcgcaattcaccatcccagaaggacgatcgcgctctcggcgctggagtccccctggtactcgctgaaagccttgacgcgtgtgaagtcaaacccgacctgggcaaggccgctctatggactctcctggccgttcctcacactcagctgggcttcctcaggaagcagcatagactgtag

SEQ ID NO: 60961 - DNA, 402 bp, Artificial Sequence
  Description of Artificial Sequence: Synthetic coding sequence
atgggatggcccctgtctctgtcacccagcgggttcagggaagtggagtggggcattctgttcgtgtggcagtggctgctgagtagctggcatttgagtccctttcccgtccccaccagcccgtctactccgtgtttaccttttctctgccatcctctgcccgtcttgcacggcaactgcaccgggctcagtgtgttcgcctgcatgtgcgcacccgtctatacgtgcatagaacgctacatatgcgggggacggggagaacgaggaggcggaggagtgaaactgagggcctgtagccaggacaccgcacattggagcctgagctctgcgccttccgtgctcgtgcgcttgagagaagagggaggacgtgcactagtgaagccagattgtccaagcctatag

SEQ ID NO: 60962 - DNA, 534 bp, Artificial Sequence
  Description of Artificial Sequence: Synthetic coding sequence
atgaccacgagcataaggcaattcacgagttctagctctatcaagggaagcagcggactgggaggaggatcctccaggacatcttgccaactatcgggcggtctgggtgcagggagctgtagacctggaagcgctggaggcctcggtagtgcactgggcggaagtagctatagcagctgctattcttttggatccggaggcggttatgggtcttcttctttcgaaggagtggacggattgcttgtggggggtgagaaggccaccatgcaaaatttgaatgaccggctcgcctcctacctcgacaaagtgcgggcacttgaagaggcggacaccgagctggaggtaaagattagggactggtatcaacggcaggcacctgggcctgcacgagattattctcaatactatcggatcatcgaagagctacagaacaagcctccttggaccatgcccacctcctgctacagaatgacgatgcccatctggctgttgctaacgtcggcaccgaagtcttggcagaacgagggcagatag

SEQ ID NO: 60963 - DNA, 981 bp, Artificial Sequence
  Description of Artificial Sequence: Synthetic coding sequence
atgccccatctgcccctggcttctttccggccaccattctggggcctgcggcactcaagagggttgccgagattccacagcgtgtcaacgcagagcgaaccccatgggagcccaatttcccggagaaatcgcgaggctaaacaaaaacgcctgagagagaagcaagccacgcttgaggcagagattgctggcgagagcaagtcgcctgcagaatcaatcaaggcctggcgccctaaggagctcgttttgtacgaaatacccacgaaacctggtgagaaaaaggacgtgtcaggccctctcccccctgcgtattcaccaagatatgtcgaggcagcctggtatccatggtgggtgagggagggttttttcaagcctgagtatcaggcgagactccctcaggccacaggcgaaactttctccatgtgtataccgccacccaatgtgaccgggtcactgcatatcggacacgctctgacagtggcaatccaggatgcccttgtgcgttggcatcggatgcgtggggaccaagtactctgggttcctggcagcgaccatgctgggattgcaactcaggcggtggtggaaaaacagctctggaaagagcgtggggtgcgaaggcacgagctttccagggaggcctttttgcgggaggtgtggcagtggaaagaggccaagggcggagagatttgtgaacagctgagagccctgggtgcctcactggactgggacagggaatgcttcacgatggacgtaggttctagtgtggcggtgaccgaagccttcgtccggttatataaagccggactactgtaccggaatcaccagctagtcaattggagttgcgctctcagaagcgcaatcagcgacatagaagtggagaataggcccctgccgggtcacactcagcttaggcttccaggctgccctactcctgttagcttcgggctcctgttttccgtcgcgtttccagtggacgggtag

SEQ ID NO: 60964 - DNA, 3192 bp, Artificial Sequence
  Description of Artificial Sequence: Synthetic coding sequence
atgccacacttacctcttgcctcattcagacctcccttctggggtctcaggcacagccgcggactccctagatttcatagcgtgtcaactcagagcgagccccatggctccccaatttcccgacggaacagagaagccaaacagaaacgactgagggagaagcaagcaacgttggaggccgaaatcgcaggagaatctaaatccccagccgagagcattaaggcctggcgacccaaagaactggtgctatacgagatccccaccaaaccgggagaaaaaaaggacgtttccggacccctcccacctgcatacagcccgcgttatgttgaggccgcttggtatccctggtgggtaagagaggggttctttaagccggagtaccaggccaggctaccccaggctacaggcgagaccttttcaatgtgtattccccctcctaatgtgacagggtcactgcacattgggcacgcactgactgtggcaattcaagacgccctggtcagatggcaccggatgcggggagatcaggtcctttgggtcccaggaagtgaccacgctggaatcgcaacccaggccgtggtggagaagcagctgtggaaagaaagaggagtgaggcggcacgaactgtctcgagaggctttcctgagggaagtgtggcaatggaaagaagccaaagggggagagatatgcgaacaactgcgggcactgggcgcatccttggactgggatagggagtgcttcaccatggacgtgggttcttctgtcgccgtgactgaagctttcgtgcgcctttacaaagctgggctgctgtaccgcaaccatcagttggtgaactggtcttgtgccctgcgttccgctatcagcgatatcgaagtggagaacagacctctgcccggtcacacacagctcaggctccctgggtgccctaccccggtgagcttcggtctcctattttctgtcgcattccctgtcgacggcgagccagacgcagaggtggtagtgggcaccactcggccagagactttacctggcgatgtggctgttgcagtccacccagacgattcccggtacacacacctgcacggcagacagctaagacatcctttgatgggccagcccctgcccctaattactgactatgccgtgcagccccatgttgggactggagccgtcaaagtgacgcctgctcactctcccgctgacgccgagatgggggctcgccacggcctgagtccactgaacgttatcgccgaggatggaaccatgacaagcctgtgtggtgattggctgcagggcttgcacaggtttgtggcacgcgagaaaattatgagcgttctgtcggagcgtggcctctttcggggtcttcagaatcatcctatggttctcccaatttgctcccgttcaggtgacgtgatcgaatacctgcttaaaaatcaatggtttgtaaggtgtcaagagatgggggctcgggctgccaaggccgtcgaatcgggagccttggagctgtcacctagcttccaccaaaagaattggcagcattggttttcccacatcggagactggtgcgtttctagacagctgtggtggggccaccaaatccctgcatacctggttgtggaggatcatgcgcagggagaagaagattgttgggtcgtgggaaggagtgaggctgaggcgagagaggtggccgctgagcttacaggacgacctggtgcagagttaactctggaacgcgatccggacgtccttgacacctggtttagctctgcactgttccccttctccgcactcggctggccgcaggaaactccagacctggcgaggttttacccattgagtttactggagaccggatcggaccttttgctgttttgggtaggtaggatggtcatgctgggtactcagctaacaggccaacttccgttttccaaagtgcttttgcaccctatggtgcgtgatagacaaggcagaaagatgtcaaagagtctcggaaatgtcctcgatccacgcgatatcatctccggggtggagatgcaggtcctgcaagagaagcttcgctccggtaacttggaccctgcggaactggccattgtggccgctgcacaaaagaaggacttccctcacggaatccctgagtgtgggacagacgccctcagattcactctatgttcacacggtgtgcaagccggagatcttcacctgtccgtaagcgaggtgcagtcgtgcaggcatttctgtaacaaaatctggaacgcactgcgatttatactgaacgcccttggcgagaaatttgtgccccagcctgcagaggagctgagcccctcttcaccgatggatgcctggatactttctcgcctcgcattagcagcccaggagtgcgagagaggcttcttaactagggagctcagcttagtaacacatgcactccatcacttctggctgcataacctgtgtgacgtgtaccttgaggcagttaagcccgtcctttggcattcacctaggcccctgggccctcctcaagtcttgttcagctgcgctgatcttggactgaggttgctggcaccactcatgccgttcctcgccgaagagctgtggcaaagacttcctccccgacccggatgcccccctgctccctcaatttctgtagctccatacccaagcgcgtgttctctggaacattggcgtcagccagagcttgagcgcaggttctccagagtccaggaagtcgtgcaggtattgcgcgctctccaagctacctaccagcttacaaaggcccgacccagggttttactgcagtcgagcgagccgggagatcaggggcttttcgaagccttcctggaaccactgggcaccctgggctactgtggtgctgtggggcttcttccacctggcgctgcggctccatctgggtgggctcaggctcccttgtccgataccgctcaagtgtacatggagctacaaggcttagtggatccacagatccagttgccccttttagctgccagacggtacaagctccagaagcaactggactccctgacagctcgaactccaagcgaaggagaagccggtacgcagaggcaacagaagctaagcagccttcagttagagctctctaaattagataaggctgcgtctcatctgcgtcagttaatggacgaaccccctgcacctggtagccccgagctgtag

SEQ ID NO: 60965 - DNA, 348 bp, Artificial Sequence
  Description of Artificial Sequence: Synthetic coding sequence
atgccccatttgcccctagcgagcttccgacccccattctggggtttgagacacagtaggggcctccccagattccattctgtcagtacccaaagcgagccacatggctctcctatttcgcgacggaatcgggaggctaagcagaaaagattacgagaaaaacaagcaaccctcgaggccgaaatcgccggagagtctaagagcccagccgagagtattaaagcatggagaccgaaggagctcgtgttgtatgagattcctaccaagccaggggagaaaaaggatgtgagcggaccactgcctccagcatattcaccgaggtatgtggaagccgcatggtacccctag

SEQ ID NO: 60966 - DNA, 2772 bp, Artificial Sequence
  Description of Artificial Sequence: Synthetic coding sequence
atgtgcattcccccaccaaatgttactggctccctccatatagggcacgccttaactgttgcaatccaggacgctttagtccggtggcataggatgagaggcgatcaggtcttatgggtgccaggctctgaccacgccggtattgccactcaggccgtcgtggaaaagcagctgtggaaggaaagaggagtccgaagacacgagttgtcccgggaagctttcctgcgcgaggtctggcaatggaaggaggccaaagggggagagatctgcgaacagttgagggccttaggagcctcactggactgggaccgagaatgctttacaatggacgttggctcctctgtagccgttacagaagcattcgtgagactttacaaagcaggactgctgtatcgtaatcatcagttagtaaactggtcctgcgcccttcggtcagccattagtgatatcgaggttgaaaatcggccacttcccggtcatactcagctcaggctgcctggctgtccaacacccgtttcatttgggctactgttttcagtcgcgttccctgtggacggcgaaccagacgcagaggtggttgtcggaactacacgacccgagacccttccaggtgatgtggccgtcgctgtgcatccagatgactcccgatatacccaccttcacggcaggcagctgcgccatcccctgatgggccagcctctgcccctaatcaccgattacgccgtccagccccatgtgggtacaggcgcagtaaaggtgacccctgcccatagcccagctgatgccgaaatgggggcacgccacggcctttcaccactcaacgtgatcgctgaagacggtacgatgacgtcactttgcggtgactggctgcagggactacatcgctttgtggcccgtgaaaagatcatgtcggtgctttctgaacgcggactctttagaggactgcaaaatcatcctatggtattaccgatctgttctcggagcggggatgttattgaatacttgttaaaaaatcagtggttcgtgagatgccaggagatgggagctcgggctgcgaaagctgtagagtcaggagccttggaactgtcaccttcatttcaccagaaaaattggcagcattggttctcacatattggcgactggtgcgtttcccggcagctttggtgggggcaccagattcctgcgtatcttgtggttgaagaccacgcgcagggtgaagaagactgctgggtggtggggagaagcgaagctgaggccagagaggtcgcagccgaattgacaggtcgcccaggtgcggagttgacactcgaacgagatcccgacgttctggacacatggttctcatccgccctctttccatttagcgctttaggatggccccaggagacccccgatttggcacggttttatccactgagcctgcttgagaccggcagcgatctgctacttttttgggtaggtcgaatggtcatgctcggcactcagctgaccgggcagctgcccttttcaaaggttctgctgcaccctatggtgagagacaggcaagggagaaaaatgagcaagagcctcggcaacgtgcttgatcccagggacatcatttctggtgtggaaatgcaattattacaggagaagttgaggtcaggcaacctggatcctgcagagctggcaattgttgcagctgctcagaagaaggactttccacacggaattcccgaatgtggtaccgatgccctgcgctttacgttgtgctctcacggggtgcaggccggtgatctccatctgagcgtctctgaggttcagagctgtcgccacttttgtaataaaatttggaacgcgttgaggtttatcctcaatgctctgggcgaaaaattcgtcccgcaaccagccgaagaattaagtccatcgtccccgatggatgcatggattctctctcgcctcgctttggcggctcaagagtgtgaacggggttttctgactcgggagctgtctcttgtaactcacgcactacaccacttttggcttcacaacctgtgcgacgtgtacctggaagcggtgaagcccgtactttggcactcccccagacctctaggtcccccacaagtgctattttcttgtgcggacctgggcctgcggctgctcgcccctctgatgccgtttttagctgaagagctctggcagagattaccccctcgccctggatgtcctcctgcccctagcattagtgtggcaccttacccttctgcctgttctctggaacactggaggcagcccgagctagagcgtcgcttcagccgagtccaggaggtggtgcaggtgcttcgcgcactgcgtgccacttaccaactcacaaaggcccgaccaagagtgctcctgcaatcttccgaaccaggcgatcaggggctgttcgaagcgttcctggaaccccttggcaccttggggtattgtggtgcagttggactgctcccacccggaaccgcagccccttccggctgggcccaggcccctctgagcgatactgctcaggtctatatggagctgcagggacttgtggatccacaaattcaattaccacttctggccgctaggcggtacaaactgcaaaagcagctcgactccctcacggcacgcacaccatccgaaggggaggctggtacccagcgccagcaaaaactgtcaagcctgcagttagaactgagcaaactggataaagctgctagccacttaagacagctgatggacgagccacccgctccaggctcccccgaactgtag

SEQ ID NO: 60967 - DNA, 3282 bp, Artificial Sequence
  Description of Artificial Sequence: Synthetic coding sequence
atgggtggaaaggcatggccgagacgggctgtagggacagctgggggaccttgcgcagaacagatttcagcaccatttcagacactcctgatgccccatctgccactggcttcctttcgacccccattttgggggctccgacacagcagaggcctccccagattccattctgtgagtactcagagcgaacctcatgggtctcccatctctcggagaaatagagaggctaaacaaaaacggctgcgggaaaagcaggcaacccttgaggccgagatcgctggggaatccaagtctccagcggaatccatcaaggcctggagaccgaaggaactggtgctgtacgaaatccctaccaagccaggggagaagaaggacgtgagcggccctcttcctcctgcttattcccctcgctacgttgaggccgcttggtatccctggtgggtccgggaaggctttttcaagccggagtaccaggcgagactcccccaggccactggagagaccttctccatgtgtatccccccacctaatgtgaccgggtctctgcatattggtcacgctcttaccgtggcaattcaggatgccttagtgaggtggcacaggatgaggggtgatcaggttctttgggttcccggatctgatcatgccggtatagccacccaagccgttgtcgaaaaacagctttggaaggagcgcggagttaggcggcacgaactttctcgagaagcttttttacgagaggtatggcagtggaaggaggccaagggcggagaaatatgcgagcagctcagagctctgggggctagtttagactgggaccgagagtgtttcacaatggatgtcggctcttccgtcgccgtgactgaggctttcgtgagactgtataaagctgggctgctgtacaggaatcaccaactggtaaactggtcatgtgcattgcggtcggcaatcagtgatattgaggtggaaaaccgccctctaccgggtcacacccaactccgcttgccaggctgtcctacgcctgtgagttttgggcttcttttctctgtggcctttccggtggacggcgaaccagatgctgaagttgtcgtgggcaccactcgacctgaaacactgcccggagacgttgccgtcgcagtgcaccccgatgacagccggtatacccacctgcacgggaggcagctgaggcaccctctgatgggacagcctcttccgctcattaccgactacgcagtgcagccccatgtaggcactggcgctgtcaaagttaccccagcccattctcctgccgacgcagaaatgggggctcggcatggcctttcccccttgaacgtaattgccgaggacgggaccatgactagtttatgtggcgattggcttcagggtctgcatcgcttcgtggctagggagaagatcatgagtgtgctctcagagagagggctgtttaggggcctgcagaatcatccaatggttcttcccatttgcagtcgatccggagatgtgattgaatatctcctcaaaaaccaatggtttgtcagatgccaggagatgggagcgcgagctgccaaagccgtcgagtccggggctctcgaattatcccctagttttcaccaaaagaactggcagcactggtttagtcacattggcgactggtgcgttagtcgccaattatggtggggacatcagattccggcataccttgttgtggaggaccacgcccagggcgaggaggattgctgggtggtcggtaggtctgaggcagaggcaagagaagtggccgcagagttgactggtagacctggtgccgagttgacgttagagcgcgaccctgatgttctcgacacttggttcagttcagccctgttccctttctcagcattgggttggcctcaagaaacgccagatttagctcgattctacccattgagtctcctcgaaacaggttctgacctcctgttattctgggtcgggcgaatggtaatgctcgggacacagctgaccggtcaattacctttttcaaaggtgctgctacatcccatggtcagagataggcaggggaggaagatgtcaaaatcactgggcaacgtgcttgaccctagagatatcatatccggggtggagatgcaagttctgcaggaaaagttaaggagcggtaatcttgatccagctgagctagccatcgtggccgctgctcaaaaaaaggactttcctcacggcatcccggagtgcggcacggatgcgctgcgctttacgctttgctcacacggcgttcaagccggagatctgcatctgagcgtttcagaggtgcagtcttgtcgccacttttgtaataaaatctggaacgccctaaggttcattctcaatgctttaggggaaaagtttgtgcctcagcccgcagaagagctgtcgccatcatccccaatggatgcatggattttgtcccgcctggcactggccgctcaagagtgtgagaggggcttcctgactcgagagctcagccttgtaacccatgctctgcaccatttttggttacacaacctttgtgacgtgtatctcgaggccgtgaagcctgttctgtggcactcaccacggccactcggccctccgcaggtgctgttcagctgcgccgacctagggcttcgccttcttgcacctctgatgccctttctggcagaagaactgtggcaaagacttccacctaggcccggatgtcccccagctcctagcatatccgtagctccctatccctccgcttgttctctcgagcattggcgccaaccagaactggaacgccgtttctccagggtgcaggaagtggtccaggtccttcgggcactgcaggctacgtatcagttgaccaaggcgaggcccagggtcctgctccagagctccgagcctggagaccaaggacttttcgaagcattcctcgaacctctgggcactctcggatactgtggggcagttggtctcctgcccccaggcgctgcagccccttctggctgggcccaggcaccactgtccgataccgcccaggtgtacatggaactccaaggactggtggatccccaaattcaactgccacttctggcagcccgtcggtataagttgcagaagcaactagacagcctcacagcgagaaccccttcagagggcgaggccggaactcagcggcagcagaagcttagctcacttcagttggaactgtccaaactggataaggccgctagccacctgaggcagctcatggacgaacccccagctccaggatcgcccgaactttag

SEQ ID NO: 60968 - DNA, 2772 bp, Artificial Sequence
  Description of Artificial Sequence: Synthetic coding sequence
atgtgtatcccacccccaaatgtcaccggcagccttcacataggacatgctttaacagttgcaatccaggatgccctggtccggtggcatcggatgcgcggagatcaagtattgtgggtcccgggatccgaccacgctggaatcgccacgcaggccgtcgtagaaaagcaactgtggaaagagagaggtgtcaggcgtcatgagctttcgcgcgaagctttcctgagggaagtatggcagtggaaggaggctaagggtggcgaaatctgcgagcagctacgtgcgctaggtgcgagcctggactgggatagagagtgttttacaatggacgtggggagctccgtcgccgtgaccgaagccttcgtgagattatataaggccggacttctctacaggaaccatcagcttgttaactggagttgcgccttgagaagcgccatcagcgatattgaagttgaaaatagacccctccccggtcacacgcaactacggctgccgggatgccccacccctgtgagcttcggactgttgttcagtgtcgcctttccagtcgatggggagcccgatgccgaagtagttgtaggaaccacaaggcctgaaactttacctggcgacgtagcagtcgccgtgcacccagatgactctcgatatacccaccttcacgggcgacaacttaggcaccccctcatgggacagccgcttccgctaattacggactatgctgtccagccccacgtggggacaggtgcagtaaaggtgaccccagcccactctcctgccgacgctgaaatgggcgcaaggcacggcctcagccccctaaacgtgattgcagaggatggaaccatgacttctctatgcggcgactggttacaggggctgcatcggtttgtggccagggaaaaaatcatgagcgtcttatctgaacggggtctgttcaggggtttacaaaatcaccctatggttctgccgatctgttcccgaagtggcgatgtcatagagtatctgctgaaaaaccagtggttcgttcgctgtcaagaaatgggtgctcgagctgctaaggctgttgaatcaggcgcactggaactgagtccttcatttcaccagaaaaactggcagcattggttttctcacataggagattggtgcgtgagcaggcagctgtggtggggccatcagatcccagcgtatctggttgtagaggatcacgctcagggggaagaagattgttgggtggttggtcgaagcgaagccgaagccagagaggtagctgcagagctcaccggacgcccaggcgcagaactgacactggagagggatcccgacgtcttggacacttggttttcctccgcactctttcccttctcagcactcggctggccgcaggaaacccctgaccttgcccgtttctaccccctgtctctactggaaaccggaagcgaccttttgctgttttgggtcgggcgtatggtcatgctgggcacccagctgaccggccagctcccctttagcaaggttctcttgcaccccatggtgcgcgatcgccagggacgcaagatgtcaaaaagtttgggtaatgtgctcgatccgagagacattatttctggcgtggagatgcaggttctccaggaaaagctgcggagcggaaaccttgatcccgctgagcttgccatcgtggcagcggcacagaagaaagattttcctcatggcatcccagaatgcgggaccgacgcactgaggttcacactctgcagccacggagtgcaggccggtgacctgcatctttcagtaagcgaggtgcaaagttgccgacacttttgcaacaaaatttggaacgcgctccgctttattctgaacgccctgggcgagaagttcgtcccccagcccgcagaggagctatcaccttcctcgccaatggacgcttggatactctcacggttggccttagccgctcaggagtgtgaacgcggtttcctcacccgcgagctgtctctggttacacacgcgctccaccatttctggcttcacaacctctgcgacgtgtacctagaagcagtcaagcctgtgctgtggcactctcctaggcccctgggtcccccacaggtgctcttctcttgtgcggatctcgggcttcggctcctggcccctctgatgccattcctcgccgaggaactgtggcaaaggctccctcctcggcctgggtgtccgcctgccccaagcatctctgtagccccatatcccagcgcttgctccctggagcactggcggcagcctgaactcgaacggcgattcagtagagtgcaggaggtagtccaggtacttcgcgcattacaggccacctaccaactcacgaaggctagaccccgtgtgctgttgcagtcttcggagcctggtgaccagggtctctttgaagccttcctagagcctctcggcacactaggctactgtggagctgtcgggctgctgccgcctggtgctgcagcgccatccggatgggcccaagctccactgtcagacactgctcaggtctacatggagctccaggggcttgttgacccgcagattcagcttccccttttagctgctcggaggtataaactccagaaacagcttgactcactcactgcgagaactcctagtgagggcgaggccggaacacagcgacaacaaaagctgagcagtcttcaactggagctgagcaaactggacaaggccgcttcccatcttagacagctgatggatgaaccacctgcaccgggatcacccgaattatag

SEQ ID NO: 60969 - DNA, 774 bp, Artificial Sequence
  Description of Artificial Sequence: Synthetic coding sequence
atgccacatctccctctagcttccttcagaccaccattctggggtctgagacacagtaggggccttccacgcttccactcagtgtccactcagtctgagccgcatggttcccccatctcacgaaggaatagggaggccaaacaaaaaaggctcagagaaaagcaggctaccctcgaggccgagatcgcaggggagtcaaaaagtcccgcagagagtataaaggcatggaggccgaaggagttggtcctttatgagatcccgaccaagccgggagagaagaaggatgtaagcgggccactgccacccgcttactcccctcggtacgtggaggccgcatggtacccctggtgggtgcgagaagggtttttcaagcccgaataccaggcacggcttccccaagccacgggcgaaacattctcaatgtgcataccccctcccaatgtgaccggctccctgcacatcggccatgccttgaccgttgccattcaagacgccctggtgcgatggcaccgcatgcgaggggaccaggtattgtgggttcccggttcagatcacgctggaatcgccacccaggcggtagtcgaaaagcagctctggaaggaacggggagttcgtcggcacgaactaagtcgcgaagcctttttgcgggaggtgtggcagtggaaggaggctaagggcggagagatttgcgagcagctgagagccttgggagcgtctctggactgggaccgtgtattctaccacggttgctggctcctctccgggtgcgattag

SEQ ID NO: 60970 - DNA, 639 bp, Artificial Sequence
  Description of Artificial Sequence: Synthetic coding sequence
atgccgaccacgtgccactgcgtggctataactccccctgactccgggggtagcccctccagtcctgctggtgggtcgccctcccccgcacctgcagctggagccgctgaattaagtcccgctacaccaacaggatccgcaaatccaacaactagttcgtgcgctgggggaactcccgctgctagcctgctgaggtgggttcgctcatgcttcctccgtttggacgacactacaaaggacttcccacacgccctgcagtggaaagggagaagccccgaatgcactcgattgtgcttcgtaagattagcacgatcggctaaagccaggccacattcttcccaacgcaaggggcgatggccggagtgcactagcgcctgtaggctcaggtcccaggatgcgacaaacgtgctcagtcattgtcgtcacttgaacggtaggtcaccagtatgtacccggcgatgtatggctcgaagtgccggttgtagaaaaagtcttccgcacttttcccaatggtacggtttcacccctagctgggctcggtggtggcggaggaaactggagggatcagaaaatatgcgaccccagagaggccacaggaagggattttctccggaatgtgtgcggagctggctgtggtag

SEQ ID NO: 60971 - DNA, 1233 bp, Artificial Sequence
  Description of Artificial Sequence: Synthetic coding sequence
atgggagcggtttcatgtcggcagggccaacacacacagcagggcgaacatactcgtgtggctgtgcctcacaagcaaggtggcaacatcaggggcccatgggctcgaggctggaaatctttgtggaccgggttggggacaatccggtcggaccttgaagagctctgggagctgcggggacatcactacctgcaccaggagagcctgaaaccagctccagtacttgtcgagaaacctcttccagaatggccagtgcctcagttcatcaacctgttcttgcctgagttccctatacgtcctatcagaggacagcagcagctcaaaatcctgggcctggttgcaaagggcagctttgggacggtgctcaaagtgctggattgcacacagaaggcagttttcgcggtgaaagtcgtgccgaaagtcaaagtgctacagcgagacacagtcaggcagtgcaaagaagaggtttcgatacagaggcagatcaaccatcccttcgtgcatagccttggagatagctggcaaggcaaaaggcacctattcatcatgtgcagctattgttctacggacctgtacagtctgtggagcgccgtgggctgcttcccggaggcctcaatccggctgttcgccgcagagctcgtcctggtcttgtgctatctgcacgacctgggaatcatgcaccgcgacgtcaagatggagaatattttgttggacgagagagggcatcttaaactcacggactttggtcttagtcggcacgtgccccaaggggcacaagcctacaccatttgcggcaccctgcagtacatggcccctgaggtgctctccggcggaccttataatcacgcggcagactggtggtctctcggggtgttattattctcactggccacagggaagtttcctgtggcggctgagcgggaccatgtggccatgctggctagtgtgacacacagtgacagcgaaatccctgcctctcttaatcagggattgtcactgttactccatgagttgctctgccagaaccctctgcaccgcctgagatacctgcatcatttccaggtgcatcccttcttccggggagtggcttttgaccctgagctgctgcagaagcagcccgtgaattttgtgaccgaaacacaggccacccagccttcttccgccgagacaatgccatttgacgactttgattgtgacctcgaatcgtttctactttatccgattcctgcgtag

SEQ ID NO: 60972 - DNA, 447 bp, Artificial Sequence
  Description of Artificial Sequence: Synthetic coding sequence
atgggagccgtgtcctgtaggcagggccagcatacccagcagggcgagcacacccgtgtggccgtcccacacaagcagggaggaaatattcgtggcccttgggcccgtggttggaagagtttgtggactggactggggaccataaggtctgacctggaggagttgtgggaactgcggggacaccattacctgcaccaggagtcacttaagcccgcaccagtgctcgtggagaagcctttaccagaatggcctgttccgcagtttatcaatctgttcctccccgaattccccatccgccctattaggggacagcagcaattgaaaatactcggactcgtcgctaaggggtctttcggtactgtgctgaaggtgctggactgtacacagaaagcggtgttcgccgtaaaagtagttcctaaggtaaaggtgcttcagggcattccatag

SEQ ID NO: 60973 - DNA, 516 bp, Artificial Sequence
  Description of Artificial Sequence: Synthetic coding sequence
atgggcgctgtttcatgtaggcagggtcagcacacccagcagggagagcacactcgggtggccgtacctcataaacagggcggaaacattcggggaccatgggcacgcggatggaaatcactctggaccggcttggggacaatccggtctgatctagaggagttgtgggaactgagggggcatcactatctacatcaagaaagcttgaaacccgcacccgtgctggttgagaaaccgctccctgaatggcctgtccctcagtttataaacctttttcttcccgagtttcctatcagaccaatccggggtcagcagcagcttaagattctgggcctggtcgctaagggttctttcggcactgttctgaaagtgctagactgtactcagaaagctgtgttcgctgtgaaggtagtccccaaagttaaggtcctccaaagggacaccgtcagacagtgcaaagaagaagtctccatccaggtgatctccatgacctgggcctcttgcattgaaatgtag

SEQ ID NO: 60974 - DNA, 516 bp, Artificial Sequence
  Description of Artificial Sequence: Synthetic coding sequence
atgggagccgtgtcttgccgacaaggtcagcatacccagcagggcgagcacacacgtgtagctgtcccccacaagcagggcggaaacatacggggaccctgggctagaggctggaaaagtctttggacaggtctgggcactataaggtcggatttggaggagctgtgggaattgcgagggcaccactaccttcatcaggaaagcctaaaaccagcacccgtgcttgtggaaaagccccttcccgagtggccagtcccccagtttattaacctcttcctcccagagttcccaattcgcccaatccggggacagcaacagctaaagattctgggcctcgtagccaagggctcctttgggacagtgctgaaagtgctggattgcacgcagaaagctgtcttcgccgttaaagtggttccaaaggtgaaagtactgcagagggacacggtgagacagtgtaaggaagaagtgtcaattcaggtgatcagtatgacttgggctagttgcatcgagatgtag

SEQ ID NO: 60975 - DNA, 441 bp, Artificial Sequence
  Description of Artificial Sequence: Synthetic coding sequence
atggccgcttcccggctcgaattgaacctggtgcgtctgctgagccgttgcgaagctatggcagccgaaaaaagagatcccgacgagtggagactagagaagtatgttggcgctctggaggacatgcttcaggctctcaaggtgcacgcatcgaagcccgcaagtgaggtaatcaatgaatattcctggaaggttgacttcctcaaagggatgctgcaggccgagaagttgacctcaagcagtgaaaaggcactcgccaatcaatttctcgctccgggtagagttcccacgactgccagggaacgggtacccgcaactaagacagtccacctgcagagccgcgctcggtacacatccgagatgcgttccgaactcttaggaacagcagaggctgagcctgaaatggatgtgcgcaagcggaccccctgtcatacacactag

SEQ ID NO: 60976 - DNA, 780 bp, Artificial Sequence
  Description of Artificial Sequence: Synthetic coding sequence
atggctgctagcagacttgagctgaacctcgttaggttactgtctcggtgcgaggccatggccgctgaaaaacgggatccagatgaatggagactggaaaagtacgtaggggctcttgaggatatgctgcaggcgctgaaggtccacgcttcaaaacccgctagcgaggttattaacgaatacagctggaaagtagacttcctcaaggggatgttacaggccgagaagctgacaagttcttccgagaaagccctggccaaccaatttctagcccctggtagagtgcctacaaccgcccgagaaagagtgcccgctacaaaaaccgtccatttacaatcacgagctcggtacaccagcgagatgcgaagcgaactgctaggcactgcagaggctgagccagagatggacgtgagaaaaaggacgggcgtcgcaggcagtcagccggtgtcagagaagcagctcgcagccgaactagacctcgtcttgcaacggcaccagaacttgcaggagaaattggcggaagagatgctagggctggccaggtcgttaaagactaatactctcgccgcacagagcgtgataaagaaggataaccagacattgtcccatagtctcaagatggcggaccagaaccttgagaagcttaagaccgagtcagaaagattagagcagcacactcagaagtctgtcaattggctcctttgggcaatgctcattattgtgtgcttcatattcatctcgatgattctgttcatcaggataatgccgaaactgaagtag

SEQ ID NO: 60977 - DNA, 2661 bp, Artificial Sequence
  Description of Artificial Sequence: Synthetic coding sequence
atgcgccctgactgtaatagccagaagccctcacaggccctatcaattcgggataccagttccaaggacccatggcctgacatcgaaccacagcttcctgcaacccctgccgcagtctggggagtttttaccttctcatggcgcggtgctggcgcattaggacccaggcgtggtcctagacggctaaataacaaaagaggagcagccaaacgccaggaggacaaaaccatgtctaagggcccagggcctggagggagcgccgcatcaagcgcccctcctgccgcaaccgcccaagtacttcaggcccagccagaaaagccacagcattatacctatctaaaggaattccgtacagagcagtgcccactcttcgtgcagcacaagtgtactcagcatcgcccttacacctgtttccactggcactttgttaaccaacggaggcgcaggtccatcagacgaagggatggcacctttaactactctcctgacgtttactgtaccaagtatgatgaggcgaccggattgtgccctgaaggtgatgagtgcccatttctacaccggaccactggtgataccgagagacggtaccatctccggtattacaagactgggatttgcattcacgagacagacagtaagggcaattgtactaagaatggtctccactgcgcgtttgcccacggaccccatgatctgaggagccccgtgtatgatataagggagctgcaggctatggaagccctacagaatgggcaaaccacggtggaagggtctattgagggccaatcggccggagcagcatcccacgctatgatcgagaagatactgagcgaagaaccaaggtggcaggagaccgcctatgttttgggcaactataagacagagccctgcaaaaaacccccaaggctgtgccgccagggatatgcatgcccttactaccacaacagcaaggatcggagaagaagccctcgaaaacacaaataccggtcttctccttgccctaatgtcaagcacggagacgaatggggcgatcccggtaagtgcgaaaacggagacgcttgtcaatattgccatacccgcacagagcagcagttccatcccgagatttataaaagcacaaaatgtaatgatatgcagcagagcggctcctgtccacgcggacccttctgcgcatttgcccacgtggaacaacccccactgtcggacgatctgcagcccagctccgctgtctcctcacctacgcagccaggaccagtgctgtatatgccctccgccgctggtgactcagtgcccgtttccccaagtagtcctcacgctcccgacctgagcgccctgttgtgccgaaactcctccttaggatccccgtcaaacctctgcggaagtcctcccggatccattagaaagccccctaaccttgaaggaatagtgttccctggggagtcagggctggctcccggtagctacaagaaggctccaggctttgaaagggaagatcaagtaggcgcagagtacctgaaaaatttcaagtgccaggcaaaactgaaacctcactccctggagccgaggtcccaagagcaacctttattacagccgaagcaggacatgttaggtatcttgccagccggatccccgctcacaagctcgatctcatcgtccatcacttcctcactggccgctactcccccttcccccgtcggtacgtcttcagtgccaggcatgaacgctaatgccctgcctttctatccgacaagtgacacagtggagtcggtgatcgaaagcgctttggacgatctggacctgaatgagttcggagtagccgctctcgaaaaaaccttcgataacagtaccgtcccccatcctggctcgattaccataggagggagtcttctacagtcctctgcccctgttaatattcccggaagcttgggtagtagcgcctcatttcatagcgccagcccatccccacctgtgagcctgtcgtcacactttttgcagcagcctcagggtcaccttagccaatccgaaaataccttcttgggtacttcggccagccatgggtctctcggactcaatggtatgaacagtagtatatgggagcactttgcatctgggtctttctctcctggcacttcaccagccttcctgtctggcccaggggctgccgagctcgcgaggctgaggcaggagcttgacgaggctaattcaacgatcaaacagtgggaagaaagctggaaacaagctaaacaggcctgcgatgcctggaagaaggaagccgaggaagctggtgaaagagcaagtgctgctggcgcagagtgcgaactggcgagagagcaaagggatgccctcgaggttcaagtgaaaaagcttcaggaagagttggagagactgcacgccggaccagaacctcaggctctgccagctttctcagacctggaagccctgtctctgagtaccctgtactccttgcaaaaacagttacgtgcacaccttgagcaagtggacaaagcagtttttcacatgcagagtgtgaaatgtctgaagtgtcaagaacagaaacgggcagtgttgccttgtcagcacgctgctttgtgcgagctctgtgctgaagggagcgagtgccctatctgtcagcctggaagggctcacacccttcagagctag

SEQ ID NO: 60978 - DNA, 510 bp, Artificial Sequence
  Description of Artificial Sequence: Synthetic coding sequence
atggtctctagcaaaggactctggaaagagcgcccttccgctcacacatcggagtgcttctccaccacagcttgcccagtggctttcattttattggtgtggaactcccaaacacccgcaggactccagtcactttgtacaggcagacatccatctctttcggctcgagcccagagagccggaccaagggccagcagggaagagggaaccttctggacagagcgcgtgggccaggagcgatggctgatccgaagtggctcttctcaaaatgagagccaggaggaccaaggagccggactgatttcccaggcagggctgaaggccgacaatagacgagagtcatctacctgggccaacgaagtggaagatcgcagaccacagtgcacaccagctctgaatcttaccccatcccacccacacccccctcattcccttacgaccttcctgcggtctgtgataggtatccagattcccccaggattggtggctgccggaggcactgtggcctag

SEQ ID NO: 60979 - DNA, 510 bp, Artificial Sequence
  Description of Artificial Sequence: Synthetic coding sequence
atgggatcctcaaagggtctctggaaggagaagccctctgcccatacctccgagtgtttcagcaccactgcctgccctgtcgcttgcatcctactggtatggaacagtcaaacacccgcaggtttgcagagtctgtgtactggacgtcacccttcactctccgccagagctcagtgggcaggacctcgcgctagccgggaggaaggcaccttctggacagaacccgtagggcaggaacggcgattgatacggagcgggagcagtcaaaatgagagtcaagaggatcagggtgcggaccttatctcccacgagggcctaaaagccgacaaccaaagagagtcctcaacttgggctaacgaagtcgaggataggcggccacaatgcacctctgccctgaaccttactccaagtcatctccatccgcctcaccccctgacaacattttttcggaatgtaatcggcattaaaatccctcccggactggtcgcaatggggggaacagtggcatag

SEQ ID NO: 60980 - DNA, 972 bp, Artificial Sequence
  Description of Artificial Sequence: Synthetic coding sequence
atgaaaaacgtagacagcgacgatttggtgacgggcaccctgcctaaattgaagtctagcaaggagtggctcgaacccaagccactgtgtttcatggaggtgcttgccaaagaggacaccgaggccgctatccagtctatcctgtataaggagaattccgttatcaaggaacttgacaagtatctgcagcatcatgcattcttgaatgccagaaggaaggaaatgttgtacaagaggtgggtggattgcgtggctgatcccctgcagaaaaagatcatagagaaagtgtgcagccataagaaaattaaaaaaagaaggcagggcgagttggacggcttcctcaagcacgtgaacaagaaaggaaacgccttcatcgagcattacgaccctaaggagtatgaccctttttatatgtcaaaaaaggaccctaacttcctcaaggttacaataccaccattccacgacccgctgaaaaaggcacagtatgataaggacaatgaaaaacgaactctgctccagtgcgaaacgggaaagatttacagcatcaaggagtttaaagaggtagagaaggtgcaactgcattctcgattcccacagatatcaaattccaggcactttataactcctaatgagtggctcaagctacccacacgatacatagagtcagaattctgtcgaagaaggcgtctgaaggtaaaggttaacttcaacgactgctccttcgacttaaaaccgctggccagagccccttacctgctggagagccaggaggaggagaaaaccgttatctacaagaacaaaggatcatcattcttggagcgtgagcctctgtgttaccaggaggggaacaatccatccgcaaaggaagccatctctgagggatatttttccagcctgagcctgcaggagagggaagaagatcaggatggcagtccaagtccacgtctggggctattaaaactcgaactttag

SEQ ID NO: 60981 - DNA, 2592 bp, Artificial Sequence
  Description of Artificial Sequence: Synthetic coding sequence
atgttggagagctacgtcacacccattctcatgtcctacgtaaaccggtatattaaaaacctgaagcctagtgacctacagctgagcctgtggggcggagatgtggtgctgtcaaaactggagcttaaactcgatgtcttggaacaggaattaaagctaccttttactttcctttccggacacatacatgagctccggatccacgtcccatggaccaagttgggctccgaaccggtggttattacaatcaatactatggagtgcatcctgaagctgaaagacgggattcaagatgaccatgaatcctgcggctcaaactccacgaatcggtccacagcagaatccactaaaagttctatcaagccacgacgtatgcagcaggcggctcccaccgatccagacctgccacccggttatgtgcagtcactgattaggcgagtcgtgaacaacgtaaacatcgtgatcaacaatctcattttgaaatatgttgaagatgatattgtgctgagtgtaaacatcacatccgctgaatgctacaccgtgggtgaattgtgggaccgtgcgttcatggacatctccgccaccgatttagtgctgcggaaagtcattaatttcagcgactgcactgtatgcctggataagcgaaacgcatccggtaaaattgaattttaccaggatcccctcctgtacaaatgtagtttccgaactcgactgcacttcacatacgaaaacctgaacagtaagatgccctccgttattaagatacatacactggtcgagagtctgaagctgtccatcacagatcagcagctccctatgttcattaggattatgcagctgggtatagccctctactatggcgagatcgggaactttaaggagggcgaaatcgaagacctgacgtgtcacaataaggacatgcttggaaatatcaccggtagtgaggatgaaactaggattgatatgcagtatcccgcacaacacaagggtcaggagctctactctcagcaggatgaagaacaacctcagggttgggtgtcgtgggcctggagctttgtgcccgcaatcgtgtcctacgacgatggtgaagaagatttcgtggggaatgatcccgcatcgaccatgcaccaacagaaggcgcagactctgaaggaccccatcgtgtcaatcgggttttattgcactaaagccactgtgaccttcaagctgactgaaatgcaagttgagagcagctattatagccctcaaaaggtgaaatctaaggaagtgctgtgctgggagcaagaagggaccactgtcgaagccctgatgatgggtgagcccttttttgactgccagattgggttcgtgggatgcagagccatgtgcctgaaagggatcatgggggtcaaagattttgaggagaatatgaaccggtccgagaccgaggcgtgtttttttatatgtggggataatctatctacgaaaggtttcacatatttgactaactctctgttcgactatcgaagccctgagaacaatgggacaagagctgaattcatcctggatagtactcaccataaggagacgtatactgaaattgctggaatgcagcggttcggggcattctacatggattatttgtacactatggaaaacacctctgggaagggaagcaccaatcagcaggacttttctagcggtaaaagcgaggatctgggcaccgtccaggagaaaagcaccaagtcactggtgattgggccactagattttagactggactccagtgctgtccaccgaatcctgaaaatgatcgtgtgcgcccttgagcatgaatacgagccatacagtaggcttaaaagcgatattaaggacgaaaacgaaacgattttgaaccccgaggaagtggccctgctggaggagtacatccccacacggcacacttcagtcactttgttaaaatgtacatgcactattagtatggctgagttcaatcttctagaccatcttctcccagtcattatgggggagaaaaacagctccaacttcatgaatactaccaattttcaatccctaagacccctgccttcaatccgcattttggtggacaaaatcaacctcgaacacagcgtccctatgtatgcggagcagttggtccacgtcgtgtcttcactcacacagccatccgacaatttactccactactgctatgtccactgttacttaaaaatattcggcttccaagccggtctcacatcactggattgctccggcagctactgtttaccagttccagtaataccatctttttctaccgctctgtatggaaagctgttgaagctcccgacctgctggacgaaaaggtcgcagatcgctattacagaagggatctttgaactgccaaatctgactatacaggctaccagggcacaaactctgctgctccaggctatctaccagagctggagccatctagggaatgtgtctagcagtgcagtgatagaagctcttatcaatgagatattcctatctatcgaaatagggagctgttacgtggcccaggtggatctcgaactgttggccagcaacgatccccctacatcaacttcttag

SEQ ID NO: 60982 - DNA, 11994 bp, Artificial Sequence
  Description of Artificial Sequence: Synthetic coding sequence
atgctcgaatcctatgtgacccctattttgatgtcctacgtgaacaggtatattaagaatctaaagcccagcgatttgcaactgagcctgtggggcggagacgttgttctgagcaagctggaactaaagcttgatgttttggagcaggagctcaaattgccttttacctttcttagcggccacattcatgagctacggattcacgtgccttggaccaagctgggctccgaacccgtggtcataaccattaacaccatggaatgcatactcaagctgaaagatggaatccaagacgaccatgaatcttgtggcagtaatagtactaaccgatctacagccgagtccacaaagtcgtcaatcaaacccaggcgcatgcagcaggcagcacctacagatcctgatttgccgcctgggtacgttcagtctctgatcagaagggtggtgaacaacgttaatattgtgattaacaatctcatcctgaagtatgtggaagacgacatagtgctgagcgtgaacattacaagcgctgaatgttacacagttggcgagctgtgggaccgagcctttatggacatctcagctacagacttagtcttgcgcaaggttatcaacttctcggattgcacggtctgcttggataaaagaaacgcaagcgggaagattgagttttatcaggatcccctactatataaatgttctttcagaaccagactccattttacttacgaaaacctcaattccaagatgcctagcgtcattaagatccataccctggtagaaagcctgaagctgtctataaccgatcagcagttacccatgtttatacgaattatgcagctaggtatcgcactctattatggggagataggtaactttaaggaaggcgagattgaggacctgacatgccacaataaagacatgctgggaaacattacggggtccgaggatgagacccgtatcgacatgcaatacccggctcagcataagggtcaggaactgtacagccagcaggacgaggaacagcctcagggttgggtctcatgggcatggagtttcgtgcccgcaatcgtatcctacgatgacggggaagaagactttgtgggaaatgatccagccagcacaatgcaccagcaaaaagcccagacacttaaggaccccatcgtgagcatagggttttattgcaccaaggctacggtaacattcaagctgaccgagatgcaggtggaaagctcctattatagtccacagaaagtgaagtcgaaggaggtgctgtgttgggagcaggaggggaccaccgtagaggctcttatgatgggcgagcccttcttcgattgccaaattggcttcgttggttgcagggcaatgtgtctgaagggcatcatgggcgtcaaggactttgaagaaaacatgaatagaagcgaaactgaagcgtgcttctttatttgtggtgacaatctcagcaccaaaggttttacttacttgacaaatagtcttttcgattacagaagcccagaaaacaacgggacgcgagccgaatttattcttgattcaactcatcacaaagagacctacaccgaaattgccggtatgcagagatttggagccttctatatggattacctctacactatggaaaatacctctggaaaaggttcaaccaatcagcaggatttctcaagcggaaagtcagaagacctggggactgtccaggaaaaatccaccaagtccctagtgattggacccctcgattttaggctggacagtagtgccgtccacagaattctgaagatgatcgtatgcgccctggaacacgagtacgagccatatagtcgactcaaatccgatatcaaagatgagaatgaaacaattctcaatccagaagaggtggcactacttgaggagtatatcccaacgcggcacacatctgtcaccctgctgaagtgcacttgcacaatttcaatggccgagtttaatctgctcgatcacctgctgcccgttataatgggcgaaaaaaatagcagcaattttatgaatactaccaacttccagtcgctgagacccctgcctagcatccggatcctggtcgacaagattaatctcgagcacagtgttcccatgtatgcagaacagttggtacatgtagtctcctcactgacgcagccaagtgacaacctattgcactactgttatgttcactgttatttaaaaatatttggtttccaagccggacttacctctctcgattgtagcggaagctactgtctgcctgtgcccgtgatccccagcttttcaacggccctttacggaaaactcctgaagcttccgacctgttggacaaaaaggtcccagatagccattacagaaggaatctttgagcttcctaacctcaccatccaggccactcgggctcaaaccctgctgttacaagccatatatcaatcttggtcccacctgggcaacgtatccagcagtgcagtcatagaggcactaattaacgagatattcctcagtatcggagtcaaaagcaagaaccctctgccaactttggagggtagcattcagaacgtggagctgaagtactgtagcacttccctggttaaatgcgcaagcgggaccatgggttcaatcaagatttgcgccaaagctccagtcgatagcggcaaagaaaaattgattccgcttctacaggggccaagtgataccaaagatctgcacagcacaaagtggcttaatgaatccaggaagcctgagagccttttggccccagaccttatggcatttaccatacaggtacctcagtatatcgattattgccacaattcaggcgcagtgctgctctgttctatacagggcttagcagtaaacattgacccaatcctgtacacctggctgatctaccagccacagaagagaactagcagacacatgcagcaacagcccgtcgtggccgtcccactcgtgatgcccgtttgccggcgtaaggaggacgaggtgagtatcgggagcgcgcctctggcaaagcagcaatcttatcaagccagcgagtacgcctcttccccagttaagacgaagaccgttacagaaagtcggcctctgagcgtgcctgtgaaagccatgctcaatataagcgagtcctgcaggagcccagaggagagaatgaaagaattcatcggtatagtttggaacgctgtcaaacaccttactctgcaactggaagtgcagagctgttgcgtgttcattcctaatgattctctgcccagcccctccacgattgtgagtggagacatccctggaacagtgcggtcttggtatcacggacaaacttctatgccaggaactctggtgctatgcctaccccaaatcaagatcatttccgctggccacaaatacatggagcccctccaggaaattccgttcgttattccacggcctatcctcgaggaaggcgacgcatttccttggacaatctctctccacaatttcagcatctacactttgctgggcaagcaagtaaccctatgtctggtcgagcctatgggctgtaccagtaccctggctgtgaccagccagaagcttctcgccacagggcctgacactcgccatagtttcgtggtttgcttgcatgtggacctcgagtctctcgaaattaagtgctccaaccctcaggtacaactgttctacgaactgaccgatattatgaacaaggtctggaacaagatccagaaaagaggtaatctgaacctcagcccaacttcccccgagaccatggcaggccctgttccaacctcgcccgtacgaagcagcattggcacagctcccccagatacgtccacttgcagcccatcagcagacattggaaccaccacagaaggtgattcaattcaggcaggagaggaatctccgttctctgattctgtcactttggaacagacaacttcaaatataggaggcactagcgggcgtgtgtcactgtggatgcagtgggtcttgccaaaaatcactataaagctgttcgctcctgaccctgagaataagggaacagaggtgtgtatggtatccgagctcgaggatctctcagccagtatagatgtgcaggacgtatacaccaaagtgaagtgcaagattgaatcttttaacatcgaccactaccggagccgtcctggcgaaggatggcagtctggccacttcgagggagtcttcctgcagtgcaaagaaaaaagcgtgacaactaccaagctcctagatgggacccaccagcagcatggttttttgtcactcacttatactaaagcagtgaccaaaaatgtgaggcacaaactgacctcacgcaatgaacgccgtagttttcacaagctgtccgaaggtctaatggatggatccccccactttctgcacgagattctgctatccgcccaagcttttgatattgttctgtactttcccctgctgaatgccatagcgtcaattttccaggccaagcttcctaagacgcagaaggagaaacgcaaaagccccggtcaacccatgcgcacccacaccctcacttctagaaatcttccccttatctatgttaatacgtccgtgatccgaattttcatccccaagaccgaggagatgcagcccaccgtggaggccaaccaggccgcaaaggaggacactgtggtgctcaaaatcggcagtgtggctatggcgccacaggcagataaccccctgggtcgaagcgttctcaggaaagatatttatcaacgtgcgttaaaccttgggatactgcgagatcccggtagcgagatagaggaccgtcaataccagatcgacctgcagagtatcaatattggcaccgctcagtggcatcagctcaagccagaaaaggaatctgtcagcggcggagtagttacagaaaccgagagaaactcacagaatcctgcccttgagtggaatatggcaagctctatcagacggcaccaagagaggcgagctattctcacccctgtgctgacggatttcagtgtcaggatcactggcgctcctgcagtgattttcaccaaggtggtgagcccagagaatctgcatactgaagagatactggtttgtggccactcgttagaggtcaatattacaacaaaccttgatttctttctatccgtggcccaggtccagctactccatcagctaatcgtcgccaacatgacagggctcgaaccaagcaacaaggcggcagagatctctaagcaggagcaaaagaaagtcgacatcttcgacgggggtatggccgagaccagctccagatactccggcgctcaggacagtgggatcggctctgactccgtcaagatccggatcgtgcagatagaacagcactccggggcttcccagcataggattgccagacccagccgccaatcatcaattgtcaaaaatttgaattttattccctttgacatattcataacggcttccaggatctctttaatgacatatagctgcatggccctgtctaagtccaagtcacaggaacagaaaaataacgagaagactgataagtctagcttaaatctgccagaagtagactccgatgtcgccaagcccaaccaggcctgcatatcaactgtcacggctgaagacttgttaaggtcctcaataagtttcccttctggtaaaaagattggagtgttgtctctagaatctcttcacgcaagcacacggagttcagcaaggcaggccctcggaatcacgattgttagacagcctgggcgtcgaggaacaggcgatttacaactcgaaccctttctgtactttatcgtcagccagccgagcctgctcctttcctgccaccataggaaacagcgggtggaagtcagcatcttcgacgccgtcctgaaaggagtggccagcgactacaagtgtatcgaccccggaaagaccctgccagaagcactggactattgcaccgtttggctgcaaacagtgccaggagaaatagattcaaagtcagggattcctccaagttttatcaccctccaaatcaaagacttcctgaatggccctgccgacgtgaacttggacatcagcaaacccttaaaggccaacctttcgttcacaaaactagaccagattaacctgtttctcaagaagatcaagaatgctcatagtctggcgcactcagaagaaacttccgcaatgagtaacaccatggtcaataaagatgatctgcccgtgagtaagtattaccgtggaaagcttagtaaacctaaaattcatggagacggtgtgcagaaaatctccgctcaagaaaatatgtggcgagctgtcagctgctttcagaaaatttccgtgcaaacaacacaaattgttatcagcatggagacggtgcctcacacctccaagccatgcttattggccagtctgagcaacctgaacgggtccctttccgtcaaggcgacccaaaaggtgccaggtatcatcctgggatcaagctttctcctgtccatcaatgattttttgctcaagacctctctcaaggagaggtcgagaattctcattggcccttgctgcgccactgccaacttggaggcgaaatggtgcaaacacagcggaaaccccggaccagaacagagcatccctaagataagcatcgatcttcggggtggcttactgcaagtattttggggccaggagcatctgaactgtctggtcttattacacgagctactgaacggttacctgaatgaggaggggaactttgaagttcaagtctccgaacccgtgccacaaatgtcgtcacccgtggagaagaaccagactttcaagtccgagcaatcaagcgatgatctcagaacaggacttttccaatatgtccaggacgcagagtccctgaagctgcccggtgtgtatgaagttttgttctacaatgagactgaggattgcccaggcatgatgttatggagatacccagaaccccgagtgttgactctagtccggatcactcccgttcccttcaataccacggaagatcccgacatctctaccgccgacctgggagacgtcctgcaggtgccatgtagtctggaatactgggatgagctgcaaaaggtgtttgtagcattccgcgaatttaacctgagcgagtctaaggtgtgcgagcttcaactgccagacatcaacctggtgaatgatcagaagaaactggtgtcatccgacctgtggaggattgttttaaattctagtcagaatggcgcagacgatcagagctccgcctcagaaagcggatctcagagtacctgcgatccactcgtcactcccactgcgctggccgcttgtacgagagtggattcatgcttcacaccttggtttgtgcctagcctatgtgtttcgttccagttcgcccatctcgagttccatctgtgccaccacctcgatcagcttggtaccgctgcccctcaatatctgcagccgtttgtgtctgaccggaacatgccatcagaacttgaatacatgatcgttagcttcagggaaccacacatgtacctccgccagtggaataacgggtccgtctgtcaggaaatacagtttctggcacaagcggattgcaagctgttggagtgcaggaatgttactatgcagtcagtggtcaagccgttcagcatattcggacaaatggcggtctctagcgacgtggtggagaagctcctggattgtaccgtgatcgtggactccgtgttcgtcaacttagggcagcacgtggtgcactcactgaacaccgccatccaggcttggcaacaaaataagtgccccgaggtggaggaactggtgttttcgcactttgttatctgtaatgatacacaggagaccctccggtttggccaggtggacaccgacgagaacatccttctcgcaagtctgcattcacaccagtactcctggagaagccacaaatctcctcaactgctgcacatatgcattgaaggatggggcaattggcgctggagtgagccatttagcgttgaccatgcaggcacgttcatcagaacaattcagtaccgaggcaggactgcctctttgatcattaaggtccagcagctgaacggtgtccaaaagcagatcatcatatgtggcagacaaatcatttgctcctacctatctcagagcatcgagctgaaagtggtacaacactatattggacaagatggccaggcagtcgtgcgagaacactttgattgtctgactgctaaacagaaactgccctcctacattctcgaaaacaacgaattaacagaactgtgtgtgaaggccaagggtgatgaggactggtctagagacgtctgtctagaatcaaaggcaccagagtactcaatagtgatccaggtgccttcttcaaattccagtattatttatgtgtggtgcaccgtgctgactctagagccaaatagccaggttcagcagcggatgatcgtctttagtcccctttttatcatgcgctcacacctgcccgatcccattatcatccatctcgaaaaacggagtttgggtttgagcgaaacccaaattatccccggaaaagggcaggagaagcccctgcaaaacatcgaacctgacctagtccatcacctgaccttccaggcacgggaagagtacgatccttccgattgcgcggttcctatctccacttcactaatcaagcagattgcgacaaaggtgcaccccggtggcacggtgaatcagatcctggacgaattctacggaccagagaagagcctgcagcccatctggccttacaataagaaggattcggaccgtaacgagcagctgtcccagtgggattcacccatgagggtgaagctgagtatctggaagccttatgtgaggaccttactcatcgaactcctcccctgggccttgctaatcaatgagagtaaatgggacctttggttatttgagggagaaaaaattgtactgcaagtccctgccggtaagatcattatcccacctaacttccaggaggcctttcagatagggatttactgggcaaacacaaacactgttcacaagagtgtggctatcaaattagtccataacctcacatctcccaagtggaaggacggaggtaatggcgaagtggttacactcgatgaagaagcgttcgtggacacggagattagactgggagcctttcctggacaccagaagctctgccagttttgcatttccagtatggtgcagcagggaatccagatcatccaaatcgaagacaagaccaccatcattaataacactccttaccaaatcttctataagccccaactgtcagtatgcaacccccactctgggaaagagtattttcgggttccagacagcgctactttcagcatctgtccaggaggggagcagcccgctatgaagtcctcatcactcccatgctgggatctgatgccagacatatctcagtcggtgttagatgcatcccttctccagaaacagatcatgctcggattcagccctgctccgggagcagattcctcacaatgttggagtctgcccgcaatcgtcagacccgaattccctagacagagcgtcgctgttccactgggcaatttcagagagaacggcttctgcacacgcgctatcgtgctgacctatcaggagcacctcggggtgacatacttgaccctcagcgaagacccatctcccagggttatcatccataaccgctgccctgtaaagatgttgattaaggaaaacatcaaagatattcctaaattcgaagtgtattgcaagaaaataccttctgagtgctccatccaccatgaactctatcatcagatctcatcttaccccgactgtaaaactaaggatctcctgccttccctcctgctgcgcgtggaacctctcgacgaggttaccacagagtggagtgacgcgatcgacatcaactcccaaggaacacaggtcgtcttccttacgggcttcgggtacgtgtacgttgacgtcgtgcaccagtgcggcacggtctttatcactgtcgctcctgaaggaaaagcgggtcctatactcaccaataccaaccgcgcacctgagaagatcgtaacattcaagatgttcatcacccagttatccctggctgttttcgatgatttgacgcaccacaaggctagtgccgagctgctgcggctgacccttgataacattttcctctgtgtggcccctggggctgggccattgcctggggaagaaccagtggccgctctctttgaactgtactgcgtggaaatctgttgcggggatctgcaactagataaccagctttataacaaatctaattttcatttcgcggttctcgtgtgccaaggagagaaagccgagcccatacagtgttctaaaatgcaaagcctgttgattagtaataaggagctggaagaatacaaggagaaatgctttataaagttatgtatcactctcaacgagggcaaaagtatcctgtgcgacatcaacgaattctctttcgaactgaagccagccagactgtacgtagaggatacattcgtgtactatatcaagaccttattcgacacctacctccccaactcaagactcgcagggcacagcacacacctgtccggcggaaagcaggtcctgccaatgcaggtcactcagcacgcacgggctctcgtgaaccccgtaaagctacgcaagctcgtaattcagccagtgaacctgctcgtgagcatacacgcctccctgaagctgtatatcgcttccgaccacacccccctcagtttttcagtctttgaaagaggcccaatcttcacgactgcacgtcaactggtccacgctctcgctatgcattacgccgctggagcactgttcagggccggttgggtcgtcggctctctggacatcctgggctcacctgccagcctcgtgcgcagcattggaaacggggtcgccgatttctttagactaccctatgagggtctgactcggggtccaggagcctttgtcagcggagtaagccggggtaccacaagcttcgttaaacacatatccaagggtacactcacatctatcaccaacctggcaacttcgctagcccgtaacatggacaggctgtctctcgacgaagagcattacaataggcaggaggagtggagacggcagctccctgagagtctgggcgaagggttgcgtcagggtctctcacggctgggcatatccttgctcggtgccatcgcaggtatcgtcgaccagcccatgcaaaacttccagaaaacctccgaggctcaagctagtgcaggtcacaaggcaaaaggagtgatttccggagttggcaaggggatcatgggcgtgtttaccaaaccgattggcggagcagcggagctggtctcccagaccggctacggaatcttacacggagctggcctgtcccagctgcccaagcagcgccaccagccaagtgacttgcacgctgaccaggccccaaattcgcacgttaaatacgtgtggaaaatgctgcagtctctggggaggcctgaagtacatatggcacttgacgtggttttggtgagaggttcgggacaggagcacgaaggctgtcttttgttgacctctgaagtcctgttcgtggtgtctgtgtccgaggacacacagcagcaggcgttcccagtgaccgaaatcgattgcgctcaggactcaaagcaaaacaacctacttacagtgcagctgaaacagccacgcgttgcctgtgacgtcgaggtagacggagtgcgtgaacgcttgtctgaacagcaatataatcggttggtggactacatcacaaagacatcatgtcacttagctcccagttgtagcagcatgcagatcccatgcccggttgtggccgcagaacctcctccaagcaccgtgaagacctatcactaccttgtggacccccactttgcccaggtatttctaagcaagtttaccatggtcaaaaacaaagcccttagaaaaggctttccatag

SEQ ID NO: 60983 - DNA, 12069 bp, Artificial Sequence
  Description of Artificial Sequence: Synthetic coding sequence
atgttggaaagttatgtgacaccaatccttatgtcttatgtcaacagatatattaaaaaccttaaaccgagtgatttgcagctcagcctttggggcggtgatgtggtgctgtcaaagctggaactgaaattagatgtgcttgaacaggagcttaaactaccgttcaccttcctttcaggtcacatccacgaattgaggatacacgtgccctggactaagctgggctctgaaccagtagtcatcacaattaacacaatggaatgtatactgaaactaaaggacggcatacaggatgatcacgaaagctgcggatccaactccacaaaccgcagcacagctgagtcaactaaatccagcattaaaccacgcagaatgcaacaggctgcaccgacagacccagatctgccacccggttatgtacagtcgctgattcggagggtagtcaacaacgtgaatatcgtgatcaacaatttgatcctcaagtacgtggaggacgatatagttttgtctgtgaatatcacttcagccgaatgctatacggtcggcgaactttgggatagggcatttatggacatcagtgcgacggacctagtactaagaaaagtaattaatttttcagactgcactgtgtgcctggacaagcgcaatgccagtggtaaaatagagttttaccaggacccactgctctacaaatgctcattccggaccaggttgcactttacctatgaaaatctcaattctaagatgccgagtgtcattaagatccacacgctcgtggaaagtttaaaactgtccatcacagaccagcaactgcctatgtttatcaggatcatgcaactggggattgccctttattacggggaaatagggaatttcaaagaaggtgagattgaggaccttacctgccacaacaaagacatgctcggtaacattacagggagcgaggacgaaacccggattgacatgcagtaccccgctcagcacaaaggtcaggagctgtatagccagcaggacgaagaacagccccaaggctgggtgtcctgggcctggagtttcgtgcccgcaatagtgtcttatgacgacggcgaggaggattttgttgggaacgaccctgcctctactatgcatcaacagaaagcccagacattgaaggaccctatcgtaagtattggcttctattgtaccaaggctactgtgaccttcaaactgaccgaaatgcaggttgagtccagctactattcaccgcagaaggtcaagagcaaagaagtgttgtgctgggagcaggagggcaccactgttgaggctctgatgatgggcgagccattcttcgactgtcaaattggatttgttggatgtcgggcaatgtgtctcaaaggcatcatgggtgtaaaggatttcgaggagaatatgaatagaagtgaaactgaggcctgtttcttcatatgcggcgataacttaagtactaaggggtttacctatctgacgaatagcctgtttgattatcgtagccccgagaataacgggactcgggcagaatttatcctagactctacacaccataaagaaacttatacagaaatagccggaatgcagcggttcggtgccttctatatggactatctttataccatggagaatacttctgggaagggctctacaaatcagcaggactttagcagcgggaaaagtgaagacttaggaactgtgcaagaaaagtcaactaaaagcttggtgatcggaccattagatttccgcctggactccagcgccgtgcatcggatactgaagatgatagtatgcgctttagaacatgagtacgagccttatagcaggctgaaatccgacataaaggacgagaatgagaccattctgaaccctgaagaggtcgctctgctggaggagtatataccgacgcgccacaccagcgttactttgctcaaatgtacgtgtaccatatcgatggcagaattcaatctgctggatcatcttctccctgtaatcatgggagagaagaacagtagcaattttatgaatacaacaaactttcaatcactcagaccacttccaagcatccgcatcctcgtggacaagatcaacctcgaacatagtgtccccatgtacgctgaacagctagtgcacgtagtgagtagcctaacacagccatctgacaacctgctgcactactgctacgtccactgttacctgaagattttcggcttccaagccggtcttacctccttggactgtagcggttcatactgcttgccggttcctgtgattcctagtttctcaactgcactgtatgggaaattactgaaactgcctacatgttggactaagcggagccagattgcaatcactgaaggcatctttgagctccctaacttaacaattcaggcaactagagcccagacactgctgttgcaggcgatctaccagagctggtcgcaccttggtaatgtctcatcctcagctgtgatagaggcactcattaatgagattttcctaagcattggcgttaaatctaaaaatcctctccctactttagaagggagcattcaaaacgtggagctcaaatactgttctacaagcctcgtgaaatgtgctagtggaaccatgggatccatcaaaatctgtgcaaaggcacctgtggattctggaaaagaaaagctgattcctctactgcaagggccttcggacactaaggatctgcattctaccaagtggttgaatgagtcaagaaagcccgaaagtctcctggcccctgatttaatggcatttaccatccaggtgccccagtacattgattattgtcacaattcaggcgctgtcctcctgtgttccattcaaggcctcgcagtaaatatagatccaatcctttacacttggctgatttaccagccccagaaaaggacttcacggcacatgcaacaacagcccgtggtggccgtcccgctggtgatgcctgtctgtcggaggaaagaggatgaagtctcaattgggtccgcaccactggccaaacagcaatcctaccaggcttccgagtacgcttcaagccctgtaaagaccaaaacagttacagaatctcggcctctctccgttccagtgaaagcaatgctgaatatctccgaatcctgcaggtccccggaagagagaatgaaagaattcattgggattgtgtggaacgccgtcaagcatttgaccttgcagctggaagtgcagagttgttgtgtgttcatcccaaatgatagcctgccttccccctccactattgtgagcggggatattccgggaacagtacgttcctggtaccatggacaaacttccatgccaggaactttggtgctctgcctcccacagatcaagatcatttccgccggtcacaaatacatggagccgctacaggaaatccctttcgtgattcccagacccattcttgaggaaggtgacgccttcccatggactataagtctgcacaacttttccatctacaccctgctcggcaagcaagtaaccttgtgccttgttgagcccatgggatgtaccagcactctagcggtcacttcgcaaaaattactggctaccggaccagacaccagacacagttttgtcgtgtgcttgcacgtggacctggaaagccttgagattaagtgctcgaatcctcaggtccagctgttttatgaactgacagatatcatgaacaaggtgtggaacaagatccagaagcgcggtaatcttaacctgtcgcctacttctcccgaaaccatggcgggtcccgtgcctacgagtcccgtgcggtcttctatcggcacagccccacccgatacgagcacctgttctcctagcgccgatatcggtactactaccgagggggatagcatacaggctggggaagagtcacctttcagcgatagcgtaaccttggaacagactacatctaatatcggcggaacatcaggacgtgtgagcctgtggatgcagtgggttcttcccaaaattacaatcaagctgttcgcacccgatcccgaaaacaagggaactgaagtgtgcatggtctccgaacttgaagacctttccgcaagcattgacgtgcaggacgtgtacacaaaagtgaaatgtaagatcgaaagctttaatattgaccactataggtcatctctcggggaggagtgttggagcctgggccagtgcggcggagtgttcctgtcatgtaccgataaattgaacagacgaactttactcgtacgaccgattagtaagcaggaccccttctcaaactgctctggcttcttcccgtcaaccaccacaaaactgctggatggaacacaccagcagcacggattcttgtcacttacatacacaaaggccgtcacaaagaatgtccggcataagttgacaagccgaaacgagcgacggtcattccacaagctgtcagaaggtttgatggacggatccccccattttctacacgagatcctcttgtcggcccaggcgtttgacatcgtactttatttccctctgttgaacgccattgcttccatctttcaggccaagttgcctaagactcaaaaagagaaacgcaaatctccaggccagccaatgaggactcataccttgacctcgagaaatctaccccttatatacgtaaatactagcgtcattcgcatttttataccgaagactgaagaaatgcaaccaactgttgaggcaaaccaggccgctaaggaagatacggtggtgctgaagatcgggtctgttgctatggcaccccaggctgacaaccccttgggtagatccgtccttagaaaggacatataccagcgcgcattgaatctcgggattcttcgtgacccaggatcagaaattgaagacagacagtatcagattgatctgcagagcattaatatcgggaccgcccaatggcaccaattgaaacccgagaaggagtcggtgagcggtggagtggttacagaaactgaacgtaactcccagaatccggcactcgaatggaacatggcgtccagcatcagacggcaccaagaaagaagggctatccttactccagtccttacagatttcagcgtgcggattacaggcgcacccgcagtgatcttcacaaaggttgtatcaccagagaacctgcacactgaggaaattctggtgtgcggccacagtctggaagtgaatattactacgaacctggatttttttttatccgttgctcaggttcagctgcttcaccagctgatcgtagccaacatgaccggactggaacctagcaataaggcggcagaaatttccaagcaggagcagaagaaagttgacattttcgatggcggaatggctgagacaagtagccgatacagtggcgctcaggatagtgggatcggctcagactctgtgaagataaggatagtgcagatcgagcagcatagtggcgcttcgcaacataggatagctagacctagtcggcagtctagtatcgtaaaaaacctcaacttcatcccttttgacatcttcatcacagcctcccgtattagcctgatgacctacagttgcatggccctgagcaagagtaagtcacaagaacagaagaataacgagaagaccgataaatctagcctcaacctgcctgaagtggactccgatgtcgccaagcccaaccaggcgtgcattagcactgttaccgctgaggatctgctgagatctagtatctctttccccagtggaaaaaaaataggagttctcagtctggaatccctgcacgcatccacccgaagctctgcccgtcaggccttggggattaccatcgttcgacaacctggccgtcgtgggacaggtgacctgcagctggaaccatttctgtattttattgtgtcacagcccagtctactactgtcctgccaccataggaagcagagggtggaagtgtctatctttgatgctgtgcttaaaggcgtggcatccgattacaaatgcatcgacccaggcaaaaccctgccggaggcactggattactgtaccgtgtggcttcagaccgtccccggtgagattgactccaagtctggaatccctccgagcttcatcaccttacaaatcaaagactttctgaatggaccagccgatgtaaacttggacatatctaagccccttaaggccaacctgagcttcacaaaactggaccaaatcaatctttttttaaagaaaatcaaaaacgctcacagcctcgcccatagcgaagaaacctctgccatgagcaacaccatggtgaacaaggatgatctgcctgtcagcaagtactataggggaaagctgtcaaaacccaaaatccatggagatggagttcaaaaaatttctgcgcaggagaatatgtggagggctgtgtcctgttttcagaaaatcagcgttcagactactcagattgtcattagcatggagacagtacctcacacctcaaaaccttgcctgcttgctagcctctctaacctaaatggcagtctcagcgtgaaagcgacccagaaggtgcctggaatcatcctgggtagctctttcctcttgagtattaatgattttctgctcaagacaagcctaaaggaaagaagtcgcatactcatcggtccttgttgcgcaaccgcgaacctcgaggccaagtggtgtaagcattctggaaatcctggcccagagcagagcatccccaagatttcaatcgatctgagaggagggctgttgcaagtcttctggggccaggagcacctcaattgtttggtcctcttgcacgaactcctcaatggctatttgaatgaggaggggaacttcgaggtccaggtgtccgagcctgttccccagatgtccagccccgtagagaagaaccagacttttaagtccgagcagtcctcagacgacctgaggaccggcctgttccagtatgtccaggacgcagagagcttaaaactgccaggtgtgtacgaggttctgttctacaacgagaccgaggactgccccggaatgatgctgtggaggtaccccgaacccagagtgctgactctggtcagaatcaccccagtgccattcaacaccacagaggatcccgacatatccacagccgatctgggggacgtgttgcaggtgccttgcagcctggagtattgggacgagctgcagaaggtctttgtcgcattccgggaatttaacctatccgagtccaaggtgtgtgaacttcaactccccgacatcaacctggttaacgaccagaaaaaattagtgagcagcgatctttggcgcattgtgctgaactcaagccagaatggcgctgatgaccagtctagcgctagcgaatctggctctcagtctacctgcgacccccttgtgacccctaccgcgctggcggcatgtacacgggtggactcctgcttcacaccatggtttgtccccagcctatgcgtgtcttttcagttcgcccacctggaatttcatctatgccatcacctcgatcaactcggcaccgccgcacctcaatacttacagcccttcgtatccgaccgcaacatgccttccgaattggaatacatgatcgtgtcctttagggagccgcacatgtacctcaggcaatggaacaatggttccgtgtgtcaggaaatccagttcctggctcaagccgattgcaagctgctcgagtgcaggaacgtcacaatgcaatcagtcgtgaaacccttcagtatcttcgggcagatggccgtgagcagtgatgtggtcgagaagctgctggattgtaccgtgatcgttgatagcgtgtttgtgaacctgggccagcacgtggttcacagccttaacaccgcaatacaggcctggcagcaaaataagtgtcccgaggtcgaggagcttgtcttcagccacttcgttatttgcaacgatacccaggaaaccttaagattcggccaggtggacacagacgagaatatcctcctggcttctctccacagccaccagtacagctggaggtcacataagtcaccgcaacttctgcacatttgcattgaggggtggggcaattggcggtggagcgaaccattctcagtggaccacgccggaacctttatccgtactatccaatacaggggaagaaccgctagtctcatcattaaggtgcagcaactcaatggcgtccagaaacagattatcatctgcgggagacagataatttgttcctacctgagtcagtccatcgaactgaaagtggtgcagcactatatcggacaggacggccaggccgtcgtgcgggaacattttgattgtctgaccgccaagcagaaactgccttcgtacattcttgaaaacaacgagctgacagagctctgcgtgaaagcgaagggagacgaagactggtcgagagacgtatgcctggagtctaaggcaccagaatatagcattgtcattcaagttccctcctcaaactcctccataatttacgtgtggtgcaccgttttgacactcgagcccaacagtcaggtgcaacagcgaatgatcgtgttttcaccgctgttcattatgcgaagtcacctccctgacccaataatcatccacctggaaaaaaggagcctgggtctatcagaaactcaaatcatccccggaaagggccaggagaaacctctacagaatatagagcccgaccttgtgcaccatctgaccttccaggctcgggaggaatacgacccatccgattgcgccgtaccaattagcacttctctgatcaaacagatcgcaaccaaggtgcaccccggtggcaccgtgaaccaaattctggacgagttctacggaccggagaaaagtctacagcccatctggccttataataagaaggactccgacaggaatgagcagctttcccagtgggactcacctatgcgtgttaaactctctatctggaagccctatgtacgcacactgctgatcgagttgcttccttgggcgctgctgatcaacgagtccaaatgggatctgtggctgttcgagggcgagaaaattgtcttgcaggtgcctgctggtaagattattatcccccctaattttcaggaggcctttcagataggcatatattgggctaatactaacaccgtccacaagtccgtggcaattaaattggtacataacttgaccagtcccaaatggaaggatggcggtaacggagaagtggtgaccctcgatgaggaagctttcgtagataccgagattcgcctaggggctttccctgggcaccaaaagttgtgccaattctgtatctcatccatggtccagcagggcattcagatcattcagatcgaagataagacgacaattattaacaatacgccgtaccagatcttttacaagccgcaactgtctgtgtgtaacccccattccggaaaagaatatttccgggtgcctgattccgctacatttagcatctgtccgggaggcgaacagccagcgatgaagtcaagttctttgccgtgttgggaccttatgccagatataagtcaaagcgtactcgacgctagtttgctgcagaaacagatcatgctgggcttttcaccggcaccaggggcagactcatcacaatgttggagtctgccagctattgttcggccagagtttccaaggcagtcggtagccgtgcctctcggtaactttcgcgagaatggattttgcacaagggcaatcgtgttaacataccaggaacacctcggcgtgacgtatttaacgctttctgaggacccctctcccagagtgatcatccacaacagatgtccggtgaaaatgctaattaaggagaacatcaaggatatcccgaagttcgaggtgtattgcaagaaaattccctccgagtgttcaatccaccacgagctataccatcagatatcttcttacccagattgcaaaacgaaagacctgctgccctccttgctgctgcgagtggaaccgttggatgaagtgaccactgagtggtcagacgccatcgatatcaactcgcagggcacccaagttgtgttcctgactggtttcgggtacgtgtacgtggacgtcgttcaccagtgcgggactgtgttcatcaccgtggcccctgaggggaaggcaggacccattctgaccaataccaacagggctccggagaagatcgtaaccttcaagatgtttatcactcagcttagtcttgccgtgtttgatgacttgacacaccataaggcctctgccgaactgttaagattaacactggataatattttcctgtgtgtcgcgcctggagcgggaccactgccaggggaagagccagtagccgctctgttcgagctatattgtgtggagatctgctgcggcgatctgcagctcgataaccagctatacaacaagtcaaattttcactttgccgttcttgtgtgccaaggagagaaagccgaacctatccaatgctcaaagatgcaatcactgctgatctctaataaagagctggaggagtacaaagagaagtgcttcattaaactgtgcattacacttaacgagggaaaaagcattctgtgcgacattaatgagttttcatttgagttaaaaccagcccgtctttacgtggaagacacattcgtgtactatatcaagacccttttcgacacctacttgcctaactcaagacttgctggccattccacgcacctgtctgggggtaaacaggtgctccctatgcaggttacccaacacgccagagctttagtaaatcccgtaaaactacgtaaattggtaatccagcccgtgaacctcttggtcagtatacacgcttcattgaagctttacattgcctcagaccacactcctctttccttttcagtgttcgagaggggcccaatcttcacaaccgccaggcagctagtacacgcactcgcgatgcattatgccgctggagcactgtttcgtgctggttgggtggttggtagcctggacattctgggcagcccggcaagccttgttcgcagtattgggaatggtgtagccgacttttttagacttccctacgagggtcttactaggggtccaggggcatttgtgtcaggcgtctctcgtggcacaacttccttcgtgaaacacatatctaaaggtacactgactagtatcactaacctggccacaagcctcgcacgcaatatggaccgactatctctggacgaagagcactataataggcaagaagaatggcggaggcagctcccagaaagtctgggcgagggattgaggcagggtctatccagactcgggatttccctgctgggcgctatcgcgggaatagttgatcagcctatgcaaaattttcagaaaacctctgaggcacaggcttcagcaggccataaggcgaaaggcgtgatatctggggtcgggaaaggcattatgggagtctttacaaaacccatcgggggagctgctgagctcgtatctcaaactggatacggaatccttcatggcgcagggctttctcaattacctaagcagaggcaccagcccagcgacttgcatgcagaccaggctcctaattctcacgttaagtacgtttggaaaatgcttcagagcttgggaagacccgaggtccatatggctctggatgtggtgctcgttagaggtagcggtcaggaacatgaggggtgtctgctacttaccagtgaggttttgtttgtagtcagtgtcagcgaagatacacagcaacaggcattccctgttaccgaaattgattgcgcccaggacagtaaacaaaacaaccttctgaccgtccagctgaagcagcccagagtcgcctgcgacgtggaggtagacggggtgagagagcggctctcagaacagcagtacaatcgtctggtggactatatcaccaagaccagctgccatctggccccttcatgcagctctatgcagatcccttgtcccgtggtggctgcggaaccacccccatctacggtcaagacgtaccattatcttgtcgacccgcactttgcccaggtgtttctcagtaagttcaccatggtgaaaaataaagcactgcgaaaggggttcccttag

SEQ ID NO: 60984 - DNA, 4283 bp, Artificial Sequence
  Description of Artificial Sequence: Synthetic coding sequence
atgctagagagctatgtcacgccaattctgatgagctacgttaacaggtacataaagaatctgaagccttccgatctccagctgagcctttggggtggcgatgtagtgctgagcaagttggagctgaagcttgacgtgctagagcaagagctgaagctgccattcacctttctgagtggccacatccacgagctcaggattcatgtgccgtggaccaagttaggatccgagccagtagtaattactattaacacaatggaatgtatcctgaagctgaaagatggaatccaggacgaccacgagtcctgcggctccaattccacaaacagatctactgccgaatccaccaagtcgtctattaaaccgagacgcatgcagcaggcagccccaaccgatcctgacctgccgccaggctatgtccaatctctgattcgcagggtggtgaacaatgtcaacatcgtgataaacaatctgatccttaaatatgtcgaagacgacatcgtcctcagcgttaacatcaccagcgccgaatgctacaccgtgggagaactgtgggacagagcattcatggatatctccgctaccgatctagtgcttcgaaaagtcatcaacttctctgattgcacagtctgccttgacaagcgaaacgcatccgggaaaatcgagttctatcaggatccactgctgtataaatgtagcttcagaactaggctgcacttcacttacgaaaacctgaatagcaaaatgccgagcgtgattaaaatccacacacttgtggaaagcctgaaattgtccatcaccgatcagcagctgcccatgttcattcgcatcatgcaactcggcattgccctgtattatggagaaatcggtaacttcaaggaaggggagattgaagatctgacatgccacaataaggatatgttaggcaacatcacaggttcagaagatgagacccgcattgatatgcaataccccgctcagcataagggtcaggagctctatagtcaacaagacgaagaacagccgcaaggctgggtttcctgggcgtggagctttgtgcccgctattgtcagctatgacgacggtgaggaagattttgtcggaaacgaccccgcatctactatgcaccagcagaaagcacagaccttgaaagaccctatcgtgtccatcggcttctactgcacaaaggcaacagtgacattcaagctcacagaaatgcaggtggaatcttcatactattcacctcagaaagtgaaaagcaaggaagtgctctgctgggagcaggagggcaccactgtggaggccctgatgatgggtgagccattttttgactgccagattggtttcgtcggatgccgcgctatgtgtcttaagggtatcatgggagtgaaagattttgaggaaaacatgaatcgatccgagacagaagcttgttttttcatctgtggagataatctgtcgaccaaagggtttacatatctcactaatagcctgtttgattatagaagtcccgagaataacggtacccgagctgaatttatcctggacagcacacatcacaaagaaacctacacagagatcgctgggatgcagaggttcggcgcattttacatggattatctgtacacaatggagaataccagcggtaagggctccacaaaccagcaggatttttccagtggcaaaagtgaggacctgggcactgttcaggagaagagtaccaagtctctggtgatcggtccccttgatttccggctcgatagttctgcagtgcacaggatccttaaaatgatcgtctgcgcactcgaacacgagtacgagccgtacagtcgcctgaagagtgacatcaaggacgaaaatgagaccatcttgaatccagaagaggtcgccctgctggaagaatacatccccacccgccacaccagcgttacactgctgaaatgcacatgtaccatcagcatggccgagttcaatttattagatcacctgcttcctgtgatcatgggagagaagaattccagcaatttcatgaatacaaccaatttccagtccctacggccactcccaagtattaggattctggtcgataagatcaacctggaacacagtgtccccatgtacgcagaacaattggtgcacgtggtcagcagtcttacccagcccagcgacaatctccttcattattgctacgtgcattgctatctgaaaatctttggctttcaggccggtttgacgtccttagactgtagtggctcatactgcctccctgtccccgtcattcccagtttcagcaccgctctgtacggcaagctgctcaaactaccaacatgctggacaaagcggagccagattgccattacagagggcatctttgaactccccaatctgacgatccaggcgaccagagctcaaacccttttactacaggccatttatcagtcttggtcccacctgggcaatgtgtctagctcggctgtgatcgaagccctgataaatgaaattttcctgtcaatcggggtcaaatctaagaacccccttccgactcttgaggggagcatacagaatgtcgaactcaagtactgctccacttcattggtaaaatgcgcctcagggaccatggggtccattaagatttgtgcaaaggccccagtggattcaggcaaagaaaaactgatccccttgcttcagggaccttcggatacgaaggatcttcacagcactaagtggctgaacgagtcccgcaaacctgagagtctgttggccccagacctcatggcgttcacaattcaggtaccccagtatattgactactgtcataactcaggcgctgttctactttgctcaatacagggactggctgtgaacatcgaccctatcctttacacgtggctgatctaccagccccagaaacgcacttcacgccatatgcagcaacagccagtcgtggctgtgcccctggtaatgccagtttgccggagaaaggaagacgaggtatctatcggtagcgctcctctcgcgaagcagcagtcctatcaggctagcgaatacgcaagttctcctgttaagactaaaaccgtaaccgagagccggccactgtccgtccctgtgaaggcaatgctgaatatcagtgaatcttgcaggagtcccgaagagcgtatgaaagagtttatcggcatcgtatggaacgcggtgaaacacctgacgttgcagctcgaggtgcaaagctgttgcgtcttcatacccaatgacagcctgccaagcccctcaacgatcgtttccggcgacataccaggcacagttaggagctggtaccacggtcagactagtatgcccggtactcttgtgctgtgtctgcctcagataaaaatcataagcgcaggacacaagtacatggaacccctccaggagattccctttgtgatccccagacctatcctcgaagaaggtgacgcatttccttggacgatctccctgcataattttagcatctataccctattaggtaagcaggttactttgtgcctggtcgagccaatggggtgtacctctacactggccgtgacgtcacagaagttactcgcaacaggaccagacacgcgccactccttcgtggtgtgtcttcatgtggacttggaaagcctcgagatcaagtgctcgaatccgcaggttcagctcttctacgagttaaccgacattatgaacaaggtgtggaataagatccagaagagggggaacctaaacctgtcgccaacatccccagagactatggctggaccagtacctacctcaccagtccggagtagcattggcaccgcaccacccgatacttccacgtgttcaccttcagcagatatcgggacaacaaccgagggggattccatccaggcaggcgaggaaagtccattttccgattccgtcaccctggagcagaccacctccaatataggcggaacttcaggccgagtgtctctgtggatgcagtgggtcctccctaaaattacaattaaactctttgcaccagacccggagaataaagggaccgaggtgtgtatggtgagcgagctggaggacctcagtgcgtccattgatgtgcaggatgtctatacaaaggtcaagtgtaaaattgagtccttcaacattgatcattacaggtcaagaccgggtgagggctggcagtctgggcattttgaaggtgtgtttttacagtgcaaagaaaaaagcgtaccctggggcagggttctggtgttcggagcaatgtggcgatgtcttccgttcctttacta

SEQ ID NO: 60985 - DNA, 1248 bp, Artificial Sequence
  Description of Artificial Sequence: Synthetic coding sequence
atgctggaatcctatgtcactccaattctgatgtcttatgtaaatcggtatatcaagaacctcaagccatcggatttacagctctctctttgggggggagacgtggtccttagtaagctggagctgaagctggatgtgctcgaacaggagttaaagctccccttcacattcctgtccgggcacattcatgagctccgcattcatgtgccctggacaaagctggggtctgagcctgtggttattacaatcaacacaatggaatgcatcttaaaactaaaagacggaatccaggatgatcacgagtcctgtggttccaacagcactaaccggtctacagcagaaagcacaaagtcgagtatcaaaccgaggaggatgcagcaggccgcacctacggaccccgatctgccaccaggatacgtgcaatcactcattaggagagtcgtgaacaacgttaacatcgtgatcaacaacttgattcttaagtatgtggaggatgacatcgttctgagtgtgaatattacctccgccgaatgctacaccgtgggggagctctgggatcgcgcttttatggatatctcagccaccgacctagttctacgaaaggttattaacttttccgattgcacggtgtgcctggataaaagaaacgcaagtgggaaaattgaattttatcaggacccgctactgtacaaatgcagttttaggacacgattgcactttacctacgagaatctgaactccaaaatgccatctgtgataaaaattcacaccctggtggagtcactgaaattgtctatcaccgaccagcaacttcccatgttcattcggattatgcagctcggtatagcgctctactatggcgagatcgggaactttaaggagggtgaaatcgaggatctgacctgccacaataaggacatgttagggaatattactggctcagaggatgagacaaggatcgatatgcagtatccagcacaacacaaaggccaggaattgtatagtcagcaagacgaagagcagcctcaggggtgggtcagctgggcctggagttttgtccccgctattgtaagctacgatgatggcgaggaggatttcgtaggtaatgacccagcttctaccatgcaccagcaaaaggctcagacactgaaagatcccattgtgagtattggcttttactgcacaaaagcgaccgtgacattcaaggtgggcttgttctcttgctgtctctatctgtatcagctgtag

SEQ ID NO: 60986 - DNA, 11133 bp, Artificial Sequence
  Description of Artificial Sequence: Synthetic coding sequence
atggtgctcgaatcagtcgtggccgatctcctgaatcgcttcctgggtgattatgtggagaatctgaataagtcacaattaaagcttggaatatgggggggtaatgttgcactcgacaacctacagattaaggaaaacgctctctctgagcttgacgtgccattcaaggtaaaagccggacaaattgacaagctgacgttaaagattccctggaaaaatctctacggagaggccgttgtggccaccctggaaggattatatcttctggtcgttccgggagcttccatcaagtatgacgctgtcaaggaggaaaagtccctgcaggacgtgaaacaaaaagagctgtcccgtatcgaggaagcattgcaaaaagccgctgagaaagacaagccgaaggaagccaagaaggacaccttcgtggaaaagctcgctacacaggtgattaagaacgttcaggtgaagataaccgatatacacattaagtatgaggatgatgtcacggaccccaaacggccattgagcttcggcgttacccttggtgaacttagtctgctcacagctaacgagcattggaccccctgcatcctcaacgaggctgacaagattatttataagttaatacgcctcgactctcttagtgcatattggaacgtaaattgctcaatgagttaccagagatcacgggagcagatattggaccagctgaagaatgaaattctaacttcagggaacataccacccaactatcaatatatctttcaacctatttctgcttccgcgaagctgtacatgaatccttatgctgagtcagagttgaaaacaccgaaattggactgtaatattgagatccagaatatcgccatcgagctcacaaagccccagtacctgtcaatgattgatctgcttgaaagcgtggactatatggttcgcaatgcaccatatagaaaatacaaaccctacttgcctcttcacactaacggccgaagatggtggaaatatgctatcgatagtgtgcttgaggtgcatatcagacgatatacacagatgtggtcttggagcaacatcaagaaacatcgacagctgctgaagtcatacaagatcgcttataaaaacaagcttacacaatccaaggttagtgaggagatacaaaaggaaattcaggaccttgagaaaacattggatgtcttcaatattatccttgcgaggcagcaggctcaggtggaggtaattcgatcaggccagaagttacggaaaaaaagtgcagatacaggagagaaacggggaggctggtttagcggactgtggggcaaaaaagagagcaaaaagaaggatgaagagagtcttatcccggaaactattgacgatctgatgacaccagaggaaaaggacaagctctttacggcaatcggctatagcgagagcacccataacctgacactccccaagcagtatgtggcccatatcatgaccctgaagctagtgagcacgtcagttacaattagagagaacaaaaatatacccgagatcttgaaaattcagataatcggactgggcacccaggtctcccaaagaccaggcgctcaggccctcaaggtcgaggccaagttggagcattggtacatcaccggccttcgacagcaagacatcgtgccctcactggttgcctccataggggacacaacttcctctctgctcaaaatcaagtttgagaccaacccagaggactctcctgcggaccagacattgatcgtgcaaagccagccggttgaagtcatctacgatgcaaagacggtgaacgcagtggttgaattcttccagagcaacaagggcctggacctggaacagatcacctcagccacgttgatgaagttagaggagattaaggagaggaccgcgacgggactgacccacatcatcgagacacgaaaagtactggatctgcgtatcaacctgaaaccaagctacctcgtggttccccaaaccggcttccatcacgagaaaagcgacctgcttatactcgactttggcacttttcagttgaacagcaaagaccagggcctgcagaaaacgactaactcgtccctcgaggagatcatggataaagcatacgataaattcgatgtggagattaagaacgtgcagttgctgtttgccagagctgaggaaacttggaagaagtgtagatttcagcatcctagcacgatgcatattctgcaaccaatggacattcatgtggaactggctaaagctatggtggagaaagatatccgaatggccaggttcaaggtaagtggaggcctgcctttaatgcacgtgcgcatcagtgaccagaaaatgaaggatgtgctttatctaatgaacagcattccacttccccagaagagctctgcacagagcccagagcggcaagtgagctctatacccattatatcaggcggaaccaaggggctgctgggcaccagcttgctactagataccgtggaatccgagtcggatgacgagtattttgatgcagaggacggggaaccgcagacgtgcaaaagcatgaaagggagtgagctgaagaaggcagctgaagttcccaatgaagaacttatcaatctgctgctaaaatttgaaataaaagaggtgattttggaattcaccaagcagcagaaagaagaggatacgatactggtgttcaatgtgactcagctcggcacggaagccactatgagaacttttgatctcaccgtggtaagttatctgaaaaaaatctcgcttgattaccacgaaatagaaggcagtaagcggaagcctctacacctgatttctagcagcgataaacccggactcgatctgcttaaggtggagtacatcaaggctgacaagaatggcccatcgttccaaaccgcctttggtaagactgaacaaaccgtcaaggtggccttttccagcctcaacctgctgctccagacccaagctttagtcgcgtcgatcaattatctcaccacgataattccctccgacgatcagagcatctcagtggcaaaggaggtccagatctccactgagaagcagcagaagaatagcactctgcctaaggcgatagtgtcaagtagggatagcgatatcatcgattttcggctattcgccaagctaaatgcgttttgcgtgatcgtgtgtaatgagaagaataatattgcagagatcaagatacagggcctcgactcgagcctttcactgcaaagccgcaagcagagcctatttgctcgtctggagaatatcatagtgacagacgtggaccctaagacagtccataaaaaggctgtgtctatcatggggaatgaggtgtttcggttcaatctggatctctaccccgacgccactgaaggggatctttatactgatatgagcaaggtagacggagttctgagcttgaacgttgggtgcatccaaatcgtgtatctccacaaattcctgatgtctctgctgaactttctgaataatttccagacagctaaagagagcctgtctgccgcaacagctcaagcggcagaacgggctgccacgtcagtcaaggatctggcgcagaggagctttagggtgagtatcaacatcgacttgaaagcaccggtgatcgtgatccctcaaagctctatcagtaccaatgccgtggttgtcgacttaggcctgattcgcgtgcacaaccaattctcccttgtatcagatgaggattacctgaacccacccgtgattgacagaatggatgtacagctgaccaaactcacgctgtaccggaccgtgatccagcccggaatctatcatcccgacatacagttactccatcctatcaatctggagtttttagttaacaggaacttagccgcttcctggtatcataaggtgccagtggtcgaaataaagggccacctcgactctatgaacgtgtccctcaatcaggaggatctaaatttgctgttccgaatcctgacagaaaacctgtgcgagggtacagaagatctggacaaggtgaaaccacgggtgcaggaaacaggggaaattaaagagcccctcgagatttctattagccaggatgttcatgattctaagaataccctcactaccggggtagaagaaattcggtccgtggatattatcaatatgttattgaatttcgagattaaggaggtggtggtgacactcatgaagaaatccgaaaagaagggcaggcccctacacgaactgaatgttctgcagctgggtatggaagctaaagtgaaaacgtacgatatgaccgccaaagcctaccttaagaaaattagtatgcagtgtttcgacttcaccgacagtaaaggagagccattacacattatcaatagcagtaatgtcaccgacgaaccgcttcttaagatgctcctgactaaagcggatagcgacggcccagaatttaagacaattcacgacagcacgaagcagaggctgaaggtgagctttgcttcactcgatctggtcctgcatctggaggcgctcctgtcatttatggacttccttagcagcgccgcaccctttagcgagccttcgagttccgagaaggagtcagagctgaaacctctggtcggcgagtccaggagtattgccgtcaaggcagtatctagcaacatcagccagaaagacgtgttcgatttgaaaatcacagcggaacttaatgcgttcaacgtattcgtctgtgaccagaaatgcaatattgctgacataaaaatacacggcatggacgcctccataagtgtgaagcccaagcaaaccgatgtatttgcacgtctgaaggatattatcgtgatgaatgttgaccttcagagtattcacaaaaaagccgtgagtatcctgggcgatgaggtctttaggttccagttgacgctttatcctgacgccacggagggcgaggcatacgccgatatgtctaaggttgacggtaagctgagcttcaaggtgggatgcatccagatcgtgtacgttcacaaatttttcatgtcactactgaatttccttaataatttccaaacggccaaggaggccctgagtaccgccactgttcaggctgccgaacgggcagcatcctccatgaaagatctggcacagaagtcctttcgccttcttatggacattaatcttaaagcaccagtgatcattatcccgcaatcctctgttagccccaatgctgtcatcgccgacctcggcctcatcagagtggagaataagttcagcctcgtcccaatggaacattacagtctaccacccgtgatcgacaagatgaatatagagcttacacaactgaagctctccaggactatcctgcaagcctctttacctcagaacgatatcgagatcctgaagccagtgaacatgctcctcagtatccagaggaacctggcagccgcatggtacgttcaaataccaggaatggagataaagggtaagctgaagccaatgcaagtggctttgagcgaagatgacttaacagtgttaatgaagatcctccttgaaaatctcggcgaggcctcttcacagcctagtcctacccagagcgtccaggagaccgtacgggtgcggaaggtggacgtcagctccgttcctgaccatctaaaagagcaggaggattggacagacagcaagctgtctatgaatcagatcgtgagcttgcagttcgatttccacttcgaaagcttgagtatcatactgtataataatgatatcaaccaagaaagcggcgtggcattccacaatgactcctttcagctcggggaacttcggctgcatttaatggcctcgagtggtaagatgtttaaagacggcagcatgaacgtttccgtgaagcttaaaacttgtaccctggatgacctgcgagagggcattgagagagctaccagcagaatgattgataggaagaacgaccaggataacaattcctccatgattgacatctcctataagcaggacaaaaatggctcccagatcgacgccgtcttggacaaactctacgtctgcgcgtccgtggagttcttaatgaccgtggccgacttcttcatcaaggcagtcccccagtcgcccgagaatgttgccaaagaaacgcagatcctgccgagacagactgctaccggcaaagtcaaaatcgagaaggacgattccgtcagaccaaatatgactttgaaggcgatgattacagaccctgaggtggtgttcgttgcctccctgactaaagccgacgccccagcactgacagcctcattccagtgtaacctgagtctgagcacgagcaagctcgagcagatgatggaggcttctgtgagagacctcaaggtactggcctgccctttcttgcgggaaaaacgtggtaagaatattaccacggtcctacaaccatgtagtctcttcatggagaagtgtacatgggcctccggaaaacagaacatcaatatcatggtgaaggagtttattattaagatctccccaatcatcctaaatacagtgcttaccattatggcagctctgtccccaaaaacgaaggaagatggatcgaaggacacctcgaaagaaatggagaacctttggggaatcaagtctatcaacgattacaacacctggtttttgggtgtcgacaccgccactgaaatcacagaaagctttaagggaatcgagcactcattaatcgaggaaaactgtggtgtcgtggtggagtcaatccaggtgaccctcgagtgcggcctggggcatagaaccgtgccgctgctgctggccgagagcaagttcagcgggaatatcaagaactggacttcccttatggcggcagtggccgacgtaacccttcaagtacattattataacgagattcacgccgtgtgggagcccctcatagaacgggttgagggaaagagacaatggaatctccgtctggacgtgaagaagaacccagtacaggataagtctttgctgcccggagacgattttattccagagcctcagatggctatccatatcagtagcggcaacaccatgaatataactatatccaaatcttgtttgaatgtgtttaataatctggcgaagggcttcagtgaaggtacagcctcaacattcgactatagcttaaaagaccgagcgcctttcaccgtgaagaacgccgtgggcgtacctatcaaggtcaaacctaactgcaatctgcgagtgatggggttccctgaaaaaagcgatatcttcgatgtcgatgccggtcagaatcttgaactagagtacgccagtatggtgccttcgtctcagggaaacctgagcatactgagccgacaggaatcatctttctttactctgactattgtgcctcacgggtacaccgaggttgctaatattccagtggcccgtcctggaagaagactgtacaacgtgcgcaaccccaacgcttcgcacagtgatagcgtgctcgtgcagatcgacgccacagagggcaacaaggtgatcaccctgcgatcacccctgcagatcaagaatcatttttctatcgcatttattatttataagtttgttaagaatgtcaagctgctcgagcgaataggcatcgctcgtcctgaagaggagttccatgtcccactcgattcctacaggtgtcagttatttatacagcctgccggtattctcgagcatcagtacaaagagtccactacgtacatcagttggaaagaagagctgcaccgctcccgggaggttcgttgtatgttgcaatgtccaagcgtggaagtgtcattcctgcctcttattgtaaacaccgtggcactacctgatgagttatcttacatttgcacccatggggaagactgggatgtggcatacatcatccacctgtacccaagcctgaccttacggaacctgctcccatattcgctgaggtatctgcttgaaggcacggcagaaacacacgagctggccgaaggaagcactgctgatgtactgcattctcgaatcagcggcgagataatggagttggtcctagtcaaatatcagggcaagaattggaacggccattttaggataagggacacccttccagaattcttcccagtatgcttcagcagtgacagtaccgaagtgactacagtggacctatctgttcatgtgagaagaataggctcccggatggtgctgtccgtgttctcaccctactggctgattaataagactacccgtgtgctacagtaccggagcgaggacattcacgtgaagcatcccgcagactttcgggatattattctgttctcgtttaaaaagaagaacattttcacaaagaataaagttcagcttaagatcagtacatccgcatggagctcatctttcagcctggatacggtgggctcctacggctgcgtcaagtgtcctgcaaataacatggaatatctggtgggagtttcaattaagatgtcatcctttaatctttcccgcatcgtcacactgacccctttctgtacaattgcaaacaagtcttccttagaacttgaggtgggggagatcgccagcgacggttcaatgccgaccaacaagtggaattacattgcgtccagtgagtgtctgcccttctggccagagagcttgtccggaaagctttgcgtgcgcgtggttggctgcgagggttccagcaagccattcttctataataggcaagacaacggaactctgctctcactggaggacctgaacggaggaatcctggtggatgtgaatacagccgagcattcaactgtgattaccttttctgactatcacgaggggagtgctcctgccctgattatgaatcacaccccatgggacatcttgacctataaacaaagtggatctcccgaggaaatggttctcctccccaggcaagccagactgttcgcctgggccgatcccaccggcacacgaaagctcacctggacctacgccgctaacgtgggcgaacacgatctcctgaaggacggttgcgggcagtttccatacgacgcaaatatacagatccactgggtgagcttccttgacggacgccagagagttctgctcttcaccgatgatgtggccctggttagcaaggcgctgcaggcagaagagatggagcaggctgattacgagattacactttcactccactcgttggggttaagcctcgtcaacaatgaatccaagcaagaagtttcctatatcggcatcacctcaagcggggtggtgtgggaagtaaagccaaaacagaagtggaaacccttctctcagaaacagattattctgctggaacagagttatcaaaaacaccaaatttctagggaccacgggtggatcaagttagataacaattttgaggtgaatttcgataaggaccccatggagatgcggctgcccattcgttcaccaatcaagcgggacttcttgtccggtattcaaatagagttcaagcagagcagccatcaaagaagtctgagagcgaggttgtactggcttcaggtggataatcagcttccaggcgctatgtttccggtggtgttccaccccgtggctccgcctaagagcattgccttagattccgagcctaaaccgttcattgacgtgtccgtgattactagatttaatgaatactccaaggtcctgcagttcaaatacttcatggttctgatacaggaaatggcactgaagatagatcaggggttcctgggggcaatcattgcattgtttacgcctaccaccgacccggaagcggaaaggagaaggactaagttgatccagcaggacatcgatgcgctcaacgctgaactgatggagacaagcatgactgacatgagtattctctccttcttcgagcactttcacattagccccgttaagctgcatctcagtttgtctctgggctccggcggtgaagagagcgacaaggaaaaacaagaaatgttcgccgtgcatagcgtcaatttgctgctgaagtctatcggagccacactcaccgacgtggacgacctaatcttcaaacttgcctactacgagattcggtatcagttctataaacgcgaccagctgatatggagcgtcgtgcgccactatagtgagcagtttcttaagcagatgtatgtgctcgtgctcggattggatgttctgggtaatcccttcggtctgatccgcggactgagcgaaggcgtggaggctctcttttacgaaccatttcaaggcgctgtgcagggccctgaagagttcgctgaaggactcgttattggcgttcgcagcctgtttggtcacactgtaggaggcgctgcaggggtcgtgagccgtataactgggtcagtcggcaagggcttagccgcaatcacaatggataaagaatatcaacaaaaacgcagggaggagctcagtcgtcaacccagggacttcggggatagcctggctaggggcggtaaaggattcctccgcggagtggtggggggtgtaactggcatcatcacaaagcccgtggagggcgctaagaaggagggggctgctggcttttttaagggtattgggaagggattggttggagcagtggctcggcctacagggggtatcgtcgatatggcgagttcgactttccaagggattcaacgcgctgcagagtctaccgaagaggtaagtagtctgaggccgccaaggctcattcatgaggacggtatcattagaccgtacgatcgccaggaatctgagggctcggatctgcttgaaaatcacattaaaaagcttgaaggcgagacataccgttaccactgcgctataccaggcagcaaaaaaacaatactcatggtgacaaatcgtcgcgtgctgtgcatcaaagaggtcgaaatcctgggcttgatgtgtgtggattggcagtgtccatttgaagatttcgtattccctccaagtgtctccgaaaatgtgcttaagatcagcgtgaaagagcagggcctctttcacaaaaaggatagcgcaaaccagggctgtgtgaggaaggtgtatttaaaggataccgcaacggccgagagagcctgcaacgctatcgaagacgcacagtccacgaggcaacagcagaaactgatgaagcagtcttcggtaagactgctgcgccctcagctcccttcttag

SEQ ID NO: 60987 - DNA, 11262 bp, Artificial Sequence
  Description of Artificial Sequence: Synthetic coding sequence
atggtgctggagtccgtggtggctgacctattgaatcgattcctgggagattatgtagagaacctcaataaaagccagcttaaactgggaatatggggaggcaatgtcgccctagataatttgcaaataaaggagaatgccctaagtgaattagacgtaccctttaaggtaaaagctggacaaatagacaagctgacactaaagattccatggaagaacctgtatggtgaagccgtagttgccacattagagggtctttacttactggttgtacctggggcaagcatcaaatacgacgctgtgaaagaagagaaatcacttcaagatgtcaaacagaaagagctgagccgcatcgaagaggcactgcagaaggcagccgaaaaagggacgcactctggcgaatttatctacgggctggagaactttgtgtacaaggatatcaagcccggtcgaaagcgcaagaagcacaagaagcacttcaaaaagcccttcaaagggctggaccgatcgaaggataaacctaaagaggccaagaaggatacgtttgtcgaaaagctggcaactcaggtgataaaaaacgtacaggtgaagatcaccgatatccacattaagtatgaagacgacgtgacggatccaaagagacccctcagcttcggcgtgacactcggggagctgagcctcttaactgccaacgagcattggacaccctgcattctgaatgaggctgataagattatttataagctcattcgcctcgatagcttatctgcctattggaacgtcaactgctcgatgtcctatcagaggtctcgggagcagattctcgatcagctcaaaaatgaaattctcacctctgggaatattccacctaattaccagtacatattccaacccatttcagcgtcagcgaagctgtatatgaacccttacgccgaatctgagctgaaaacacccaagctggattgcaatattgagattcaaaatatcgccattgaactgaccaagcctcagtatttgtcaatgatagacctgctcgagtccgtagattatatggttaggaatgctccctataggaaatacaaaccttatcttccactccatacaaatgggaggaggtggtggaagtatgcgatcgatagtgtcttggaggtgcatatccgtcgttacacacagatgtggagctggagcaacatcaaaaaacatagacagctgctaaagtcctacaaaatagcatacaaaaataaattaacacaaagcaaagtgagtgaggagattcagaaggagatccaggatctggagaaaacactcgacgtgtttaacattatcctggcccgacagcaagcgcaggtcgaggtgattagatctggacaaaagttgaggaaaaagagcgccgacactggagagaaacggggtgggtggttttcaggtctttggggaaaaaaagaaagtaagaagaaggacgaggaaagcttgataccggagacgattgatgatctcatgacacctgaggaaaaagacaaactgtttaccgcgattgggtatagcgagtccacccacaatctcactctccccaaacagtatgtggctcacataatgactctgaaattagtgtctacgagcgtaactataagggagaataaaaacatacctgagatactgaagatacaaatcatcgggctgggcacccaggtgtcgcaaagacctggcgctcaggcattaaaggttgaagcgaaactggagcactggtatatcacaggactacgccaacaagacattgtgcctagtttggtggcgtccatcggggacactactagctcactgctcaagatcaaattcgaaaccaatcccgaggactcaccggcagatcaaacactgattgtacagagccagcccgtcgaagtgatttatgatgcaaagactgtgaacgcggtcgtggagttctttcagtcaaataaaggcctcgatctggagcagatcaccagcgcgaccctgatgaagctggaggagattaaagagcgtactgctactggacttacacatattattgaaacacgaaaagtgttggacttgcggattaacctgaagcccagctacttggttgttccccaaacgggcttccaccacgagaagtccgacttgcttatactggactttggcacattccaactgaactctaaggaccaggggctgcagaagactaccaactcctctctggaggaaattatggacaaagcctatgataagtttgatgtagagatcaagaacgtacaactgctcttcgcaagggctgaagagacctggaagaaatgccggtttcagcacccctccacaatgcatatccttcaacccatggatatccatgtggagctcgcaaaagccatggttgagaaagacataaggatggctagattcaaggtctcaggtggtttgccactgatgcacgttagaatcagcgatcagaagatgaaagacgtgctctatctaatgaattccatacccctgcctcagaaatccagtgcccagtcccccgagcgacaagtctcgtctatccctatcatcagcggcggtacaaaggggctgctcggcaccagcttgctcctggacaccgtggagtccgaatcggatgatgagtatttcgacgcagaagatggggagccccaaacatgcaagtcaatgaaaggctccgaattaaagaaagcagccgaggtgccgaacgaagaacttattaacttgcttttgaaatttgaaatcaaggaagtgattctcgaattcactaagcagcaaaaggaggaggacactattctggtatttaatgttactcaactgggaacggaggctaccatgagaacttttgacctcacagtggtatcctacctgaaaaagattagtctggactatcacgaaatcgagggatcaaagcgcaagcccctacatcttatctcgtcatcagataagccaggtctggaccttttgaaagtggaatacataaaagcggataagaacggaccgtcgttccagaccgccttcggaaagaccgaacagaccgtgaaggtggctttctcctctctgaacctactgctacagacccaagcactggtagcctccattaattatctgacaacaatcatcccatctgatgatcaaagtatctccgtagcgaaggaggtgcagatttccacagaaaaacaacagaagaactctactctacccaaagccatcgtatcttccagggactccgacataattgatttcagactgtttgcgaagctgaacgccttctgtgtcatcgtgtgcaatgagaagaataatatcgctgagataaaaattcaaggactcgatagtagcctgagcttacagagccgcaagcagagcctttttgccaggctcgaaaatatcattgttacagatgttgatcccaagacagttcataaaaaggcagttagcattatgggaaacgaagtgttccgattcaacctggatttgtatccagacgccacagaaggtgacctttacacagacatgagcaaggtggatggggtgctatccctcaacgtgggatgtattcagatcgtttacctgcataagtttctgatgtccctactcaacttcctgaacaacttccagacagccaaggaatccctttctgcagctacagcacaagctgctgaacgggcagccacttctgtcaaagacctggcacagaggagctttagagtttccataaacattgatctaaaggctccggtcattgtgatcccacaatcaagcatcagtaccaacgctgtggtggtggatttggggctgattcgtgtgcacaatcaattttccctcgtcagcgacgaggactatctcaacccacccgttatcgatcggatggatgtgcaattgactaagctgacgttatacagaacggtgatacagcccggtatctaccaccctgacatccaactgttacatcccatcaacctagagtttctggtcaataggaacctggccgcttcctggtaccacaaggtccccgtggttgagattaaagggcatttggatagtatgaacgtttccctcaatcaggaggatcttaacttactgttccgcatcctcacagaaaatctatgtgagggaaccgaagacctcgacaaagtaaagcctagggtgcaggagaccggtgaaatcaaagagccgcttgaaatcagcattagtcaggatgtgcatgattccaagaatacccttactaccggggtggaagagattcggtcggtggatatcattaacatgctgctcaacttcgagatcaaggaggtcgtggttacgctgatgaaaaaaagtgagaagaaaggcagacccctgcatgagcttaacgtgctccagctaggaatggaagcaaaagtcaagacatacgacatgacggcaaaggcttatttgaagaagatctccatgcagtgcttcgactttacagatagcaagggcgagcccttgcatatcataaattcatccaatgtgaccgacgagccattgctgaagatgcttttgacaaaggcagacagcgacggccctgagtttaagaccatccacgacagcaccaaacagcgcctgaaggtctcatttgcgtctctcgatctcgttttgcacctggaggccctgttgagtttcatggactttcttagttctgccgctccattttcagagccatcgagcagtgagaaagagtccgaactgaaaccactcgtgggcgagagcagaagcatagcagttaaggcagtgtcctctaacattagtcagaaggacgtgtttgacctcaagatcactgcggagctcaatgcattcaacgtgtttgtttgtgaccagaagtgcaatattgctgacatcaagatccatggcatggatgcctccattagcgtcaagcctaagcagactgacgtgttcgcaaggttgaaagatataattgtgatgaacgttgatcttcaatccattcacaagaaggccgtgtccatcctgggagacgaagttttccgctttcaactgaccctgtacccagacgctaccgaaggcgaagcttacgctgatatgtcaaaggttgatggtaaactctcgtttaaagtggggtgcatccaaatcgtgtatgttcacaagttcttcatgtccctgttaaattttctcaacaatttccagactgcgaaggaggcactcagcaccgccactgtgcaggccgcagaaagagcagcttcttctatgaaggatctagctcagaagtcgttccggctgctgatggacatcaacctgaaagcacctgtaatcattatcccccagtccagcgtgtcaccaaacgcagtaattgccgatctggggctgatcagggttgagaacaagttcagcctagtgccaatggaacactactcattacctccggtgatcgacaaaatgaacatcgagttgacgcagctaaagctgtcacggactatcctccaggctagcttaccacaaaacgatatcgagatccttaaacctgttaatatgctgttgtctattcagcggaacctcgctgccgcttggtacgtgcaaatcccaggtatggagatcaagggtaagctcaagcccatgcaagtggccctgagcgaggatgacctcaccgtgttaatgaagatactgctggagaacctgggtgaagcgtcttctcagcctagtccaacccagtctgtccaagaaacagtgagagttcgcaaagtggacgtgagtagcgtgcctgaccacttgaaagagcaggaagactggacggatagtaagttgagtatgaatcagattgtctcactgcagttcgatttccacttcgagagcctgtcaattatcttatacaataacgacataaaccaagagtctggagtagcattccacaatgacagcttccagctgggcgagctgcgactgcatcttatggcctctagcggaaagatgtttaaagacgggtccatgaatgtctctgtcaagttgaagacctgtactttggacgacctgcgcgaaggaatcgaacgggcaacctcaaggatgattgatcggaagaacgaccaggacaacaacagctcaatgatagacattagctacaagcaggataagaatgggtcacagatcgatgctgtacttgataaattatacgtctgtgcttctgtcgagttcctgatgactgtggccgatttttttataaaggcagtccctcagtcccccgaaaacgttgctaaagagacccagattctgcccagacagaccgcaacgggcaaagttaagatcgaaaaagatgatagcgtccgtcctaacatgacactaaaagccatgatcaccgatcccgaggtggtctttgtggcatccttaacaaaggccgatgctccagcgttaacagcctccttccagtgtaacctgtctctcagtacttccaaactagagcaaatgatggaggcatccgtcagagatctgaaagtcctcgcgtgtcccttcctgcgcgagaagcgaggcaagaacattacaaccgtcctacaaccttgcagtcttttcatggagaagtgtacctgggccagcggaaaacagaatattaacattatggtgaaggagttcataatcaaaatatcacctatcattctgaatactgtcctgactataatggccgctctgagccctaagacaaaggaggacggcagcaaagacacctccaaagagatggagaacctgtgggggattaagtcaatcaatgactacaacacctggtttttgggggttgatactgccacagaaatcaccgaaagttttaagggaattgagcactccctcattgaagagaactgcggggtggttgtggaatcaattcaggttaccctggaatgcggcctgggccaccgcaccgtgccactgctattggcggagagtaagttttccggaaatatcaagaactggactagcctgatggctgccgtagccgacgttacactccaggttcattactacaacgagatacatgcagtgtgggagcctctgatcgaaagagttgagggcaagcgccagtggaatttgcgcctcgacgttaagaaaaacccagtgcaggataagtcgttactccctggagacgactttatccccgagccacagatggcaatccatatcagcagcggcaacaccatgaatatcacgatcagcaagtcctgcctgaatgtgttcaataatttggcaaagggcttcagcgaaggcacagcttcgaccttcgattacagtcttaaggacagggcaccatttacagtgaaaaacgccgtaggagtgccaatcaaagtgaagccaaattgcaatctaagagttatgggcttccccgagaagtcagacattttcgatgtggacgccggtcagaacttggaactcgagtacgcctctatggtgccatcctcccagggaaatctgtccattctcagccgccaggagagcagctttttcaccctgaccattgtaccacatgggtacaccgaggtggccaacatacctgtggcgcgtcccggaagacggctctacaatgttagaaaccctaacgccagccattcagatagcgtgctggtccagattgatgccacagaagggaacaaggtgattaccttgcgcagcccccttcagatcaagaatcacttctctattgcctttatcatttataagtttgtcaaaaacgtaaagcttctggagaggatcggcattgctcggcctgaggaggagttccatgtgccgctggattcttatcgttgtcagctgtttatccagcctgcaggcatcctggaacaccagtataaagaatcaacaacgtatatcagttggaaggaggaactgcataggagccgtgaagttagatgcatgttgcagtgtccctctgttgaggtctcgtttcttcctctgatcgtgaacaccgtggcactcccagatgaattaagctacatctgcacccacggcgaagactgggacgtggcctatattattcatctgtatccctccttgaccctgagaaaccttttgccatatagtctgcggtacctcctggaagggacggcggagacacatgaattggctgaggggtccacagctgacgtgttacattccagaatctcgggtgaaatcatggaactcgtgctggtgaaataccagggcaagaactggaacggacattttcgcatacgcgacacactgccagagttcttccctgtatgttttagcagcgacagcaccgaggtaaccacagtcgatttgtctgtacatgttaggaggattggctccaggatggtgctgagcgtgttctctccttattggctgatcaacaaaaccactagggtgcttcagtaccggagcgaagatattcatgtgaagcaccccgctgactttagggatatcatcctttttagtttcaagaagaaaaacatctttaccaaaaacaaggttcaactgaagatttcgacctccgcatggagtagttcctttagcttagataccgttggcagttacggctgcgtgaagtgccccgcaaataacatggagtacctggtgggggtctctattaagatgagctcttttaatctgagtcgaatagtgactctcacaccgttttgcactattgcaaacaaaagctcactggaactcgaggtgggagaaattgcgtcagacgggtccatgcccaccaacaagtggaactatatcgctagtagtgagtgtctgcctttttggccagaaagcctgagcggcaaactatgcgtcagggtcgtcggttgtgaagggtctagtaaacctttcttttataaccgtcaagacaatggaactctcttatcactggaagacctcaatggaggcatcctggtggacgtgaacaccgccgagcatagcaccgtgattacgtttagcgactatcatgaaggctccgccccagctcttatcatgaatcataccccctgggacatcctaacatacaagcagtctggttctcccgaggaaatggtgctgctgccacggcaggccaggctgttcgcatgggctgatcctaccggcactcgaaaactgacttggacatacgcggctaacgtgggcgagcacgatctgctaaaagatgggtgtgggcagttcccctacgacgccaatattcagattcattgggtgtcctttctcgacggccgacaaagagtgctgttgtttacagacgatgtggcgctggtgtcaaaagccttgcaggctgaggagatggaacaagctgattatgagatcacactgagcctgcactccctgggcctgagccttgttaacaatgaatccaagcaggaagtgagttatattgggatcacaagtagcggggtcgtatgggaggtgaagcccaaacagaaatggaagccttttagccaaaagcagattattctgctcgagcagtcctaccagaagcatcagatctcccgtgaccacggctggataaagctggataataacttcgaggtaaatttcgataaggatcctatggaaatgaggctccctattaggagtccaatcaaaagggacttcttgtcaggtattcagatcgaattcaaacagtccagccaccagcggagtttgagggccagactgtactggctccaggtggacaaccagttaccaggagctatgtttccagtggtcttccacccagttgcaccccctaagtctatagcattggattcggaacctaaaccatttattgacgtctccgtgatcactcgattcaatgagtactcaaaggttctgcagttcaaatacttcatggtcttaattcaagagatggctctgaagatcgatcaggggtttctgggcgctatcatagctctgttcaccccaaccaccgatccagaggcagaacgcagacgaacaaagctgattcaacaggacatcgatgcgcttaatgctgagctgatggaaacttcaatgaccgacatgtcgatcctttcatttttcgaacactttcacatctctcctgtgaagctccacctttccttgtccctgggcagtggcggagaggaaagtgataaagagaaacaggagatgtttgccgtgcattctgtgaacctgctcttaaagtctatcggagccacactgactgacgtggatgacttaatcttcaagttggcatactatgagattcggtatcagttttacaagcgcgatcagctgatctggtcggttgtccgccactacagtgaacagtttcttaagcagatgtacgttttggtgctcgggttggatgttttaggcaatcccttcggccttatccgcggactgagtgagggtgtcgaggctttattttacgagccttttcaaggggcagtgcaagggccagaggagtttgctgaaggcctcgtgatcggggtcagatctctattcggtcacaccgtcggtggtgccgctggggtcgtgtcacgaattactgggagcgttggtaagggcttagcagcgattacaatggacaaggagtaccaacaaaagaggcgggaggagctctcacgccagccaagagactttggagacagtctcgctcggggtggaaaaggtttcttaaggggcgtagtgggaggcgtgacagggattataacaaaacccgtcgaaggggctaagaaagaaggtgctgctgggttctttaaggggattgggaagggcctcgtgggggcagtcgcacggccaaccgggggaattgtggatatggcctcttcgacctttcaggggattcagcgggcagccgagtccacagaagaagtgtcaagtctacggccaccacgtttgattcacgaagacggtatcatacgaccttacgaccggcaagaaagtgaaggttcagatcttctggagaatcacatcaaaaaacttgagggggaaacttataggtatcactgcgcaattcctgggtctaagaagacaattctcatggtgactaatagacgtgtgctgtgtatcaaggaagtcgagatcctcggcctaatgtgtgttgactggcagtgcccttttgaagatttcgtttttcctcctagcgttagcgagaacgttcttaagatcagtgtaaaagagcaaggcctcttccacaagaaggatagtgcaaaccaaggctgtgttcgaaaggtctacctcaaagacacagccacagccgagcgggcttgcaatgctatcgaggatgctcagagcacccggcagcaacagaaactgatgaagcagtcctccgttaggcttttgaggccccaactcccctcttag

SEQ ID NO: 60988 - DNA, 10887 bp, Artificial Sequence
  Description of Artificial Sequence: Synthetic coding sequence
atggttttggaatctgtggtggctgacctgctcaataggttccttggagactacgttgagaatcttaataagtcccagctgaaactcggaatatgggggggtaatgtagcactggacaacttacaaattaaggaaaacgctctgtccgagctagacgtaccttttaaggtgaaagccggacagatagacaagcttacgttgaagattccctggaaaaatttatatggcgaggccgtggtagcgacattggaaggcctgtaccttctcgtcgtgcctggcgcttccattaagtatgacgcagttaaagaggagaaaagtctgcaagacgttaagcagaaagagctgtccagaatagaagaggcgctgcaaaaagcagccgagaaggggacccactcaggcgaatttatctatggactggaaaattttgtgtataaggatattaagcccggtcggaaacgcaagaaacacaagaaacattttaagaagccctttaaaggcttggacagaagtaaggacaagcctaaggaagctaagaaggacacattcgtggaaaagctagccacacaggtgatcaaaaatgtccaggtgaagatcacagatatacacatcaaatacgaagacgatgtgacagaccctaaacggcctttgagcttcggggtgaccctgggcgagctcagcctcctaaccgccaacgaacattggaccccttgtatcctgaatgaggccgataagattatctacaagctcataagactggatagtttaagcgcatactggaacgtgaattgttccatgtcctatcagcgctctagggagcagatcttggaccaactgaagaacgaaattctcacatccggcaacattcctcctaattaccagtacattttccaaccaatcagcgcgtccgccaaactgtatatgaatccttacgcagaatccgaattaaagacccctaaactggactgcaacatcgagatacagaatatagcaattgagctgactaagcctcaatatttgagcatgatcgatcttctggaatcggtggattatatggttagaaacgctccgtaccggaagtacaagccatacctaccccttcacacgaatggcaggaggtggtggaagtacgctatcgactctgtcctggaagtgcatattcggaggtatacccagatgtggtcttggtcaaacatcaagaagcaccgtcagctgctgaagtcatacaagatcgcatataagaacaagctgacccagagcaaggtgtccgaagagatacagaaagaaattcaggacctggagaagaccctggacgtgttcaacatcattctggcaagacagcaggctcaagttgaggtgatcaggtctggtcaaaaattgaggaagaagtccgcagataccggcgagaagcgagggggatggttctcaggactttggggcaaaaaagaatctaaaaagaaggacgaagaaagtctgatcccagaaactattgatgacttgatgacacccgaagaaaaagacaaactctttaccgcaataggatatagcgagtctactcataacttaaccctcccaaagcagtacgtggctcatattatgactctgaagttggtgtcgacctcagtgaccatcagagaaaataaaaatatacctgaaatcctgaaaattcagattatcgggcttggcacacaggtaagccaacgccctggcgctcaggccctgaaggtcgaagccaaactagagcactggtacatcacgggattgaggcagcaggacattgttcccagtttggtggcctccatcggggacacaacatccagcctcctcaagatcaagttcgaaacaaatcccgaagattctcctgctgaccagacactgatagtgcagtcccagccagtcgaggttatctacgacgcaaaaacggtgaatgcagttgtggagttttttcaatcaaacaaaggactggaccttgagcaaatcacctcagcaactctgatgaaactggaggagatcaaagaacgcacagccaccggccttacacatataatcgagacaagaaaggtcctagacctgcgcatcaacctgaagcctagttacctggtcgttcctcagacagggtttcaccatgagaagtcagacctgctgatactggatttcggaacatttcagctgaatagtaaagatcagggcttacagaaaacaaccaacagtagtctcgaggaaatcatggacaaggcatacgataagttcgacgttgaaataaaaaatgtccagctgttgtttgcccgagccgaggagacgtggaaaaagtgccgctttcaacaccccagcacgatgcatattctccagccaatggacatccatgttgaattagcaaaggcaatggtggagaaagatatacgcatggcgagattcaaggttagtggcggacttccattgatgcatgtgagaatcagcgaccagaagatgaaggacgtgttgtatctaatgaatagtattcctctacctcagaagtcttcagcccaaagcccagagagacaggtttcaagcattccgataatatcaggcggtaccaaagggctgctgggaacatcattgctcctggacacagtggagagtgaatccgatgatgagtattttgacgctgaagacggcgagccccagacgtgtaagtccatgaagggctcggagctaaagaaggccgcagaggtgccaaacgaggaactgattaacttactgttaaagttcgagatcaaggaagttatcttggagttcaccaaacagcagaaagaggaggatactatcctggtgtttaacgtgacgcaactggggacagaggccactatgcggacattcgacctcaccgtcgtgagttacttaaagaaaattagcctggattaccatgagatcgagggcagcaagcgcaagccgctacatttgatcagctcatccgataaaccgggactggacctgctgaaggtggagtacatcaaggcagataagaatgggccttcattccagaccgcgtttggcaaaaccgaacagactgtcaaagtcgcgttttcttccctgaatctgctcctccagacccaggccctggtcgcatctatcaattatctgaccactatcattcccagtgatgaccagagcatatccgtggcgaaggaagtacagatctctaccgagaagcagcagaaaaacagtacgcttcccaaagccatcgtgtctagtagggactccgatatcattgacttcaggttgttcgccaagctaaacgctttctgtgtgattgtgtgcaatgagaagaataatatagctgagatcaaaatccaagggctggatagttccctgtccctgcaaagtcggaaacagtctttgtttgcaaggctagagaatatcatcgtcacagacgtcgatcccaaaacggtgcacaaaaaggctgtttctataatgggtaatgaggtttttagatttaaccttgacctgtaccctgatgccactgagggtgacctttatactgacatgagcaaagtggacggtgtgctgtccttaaacgttggatgcatacagatcgtctatttgcataaatttctgatgagcttgctcaattttctcaataactttcaaacagccaaagagagcctcagtgccgctaccgcccaagcggctgagcgtgctgccacctctgtcaaggacctggcccagagatcttttagggtttctattaatatcgatttaaaggcccctgtgattgtgatcccgcagagtagtatttccacaaatgctgtcgttgtcgatctgggtctcattagagtgcataaccagttttcactggtgtccgatgaggattatttgaaccctccggttattgaccgcatggatgttcaattaactaagttgactctgtacaggactgtgattcagcccggaatctaccaccctgacatacaactcctgcatcccataaacctggaattcctggtgaacaggaacctggctgcctcttggtaccacaaggtaccggtagtggagataaagggccatctggacagcatgaatgtgagcctgaaccaggaagatttaaacctcttgttcaggattctgaccgagaacctgtgcgagggaactgaagatttggacaaagtcaagcccagggttcaagagactggtgaaatcaaagagccacttgaaattagcatttcgcaagatgtacacgattctaaaaatacccttacaaccggagtagaggagatcagaagcgtcgatatcattaacatgctccttaacttcgagatcaaggaagtggttgtgactttgatgaaaaaatctgaaaagaagggcagacccctacacgagctaaacgtcctccaactaggtatggaagcaaaagtgaaaacctatgacatgacagccaaggcgtatttgaagaaaatctctatgcagtgctttgatttcaccgatagtaaaggcgaacccttgcacattatcaactcctctaatgtgactgacgaaccccttttgaaaatgctgctgaccaaggccgacagtgatggtcctgagttcaagacaattcatgatagtaccaaacagcgcctgaaggtgagtttcgccagcctggatttggtgctccacctggaagctctcctgagcttcatggattttttgtccagtgctgctcctttctccgagccttcaagctctgagaaggagagcgagctgaaacctctggtcggggagtcccggtcaattgccgtcaaggctgtgtctagcaacatcagtcagaaggacgtgttcgatctaaaaattacagctgaattaaatgcttttaatgtctttgtgtgcgatcagaagtgtaacattgctgatattaaaatccatggtatggatgcctctatttccgtgaaaccaaagcagactgacgtctttgcacgccttaaggatattattgtaatgaacgtggatctgcaatccattcataagaaggcggtgtccattctgggcgacgaagtgttcaggtttcagttaaccttgtaccccgacgcaactgaaggggaagcttacgcggacatgtctaaagtggacgggaagctgagtttcaaggtgggctgtattcagattgtgtatgttcataaattcttcatgtccctcctcaattttctgaataactttcagacagccaaggaggccctttctactgcgacagtgcaggccgcagaaagggccgcaagctctatgaaggatctggcacagaaaagctttagactgttgatggacatcaaccttaaagctcccgtgatcattatccctcagagctctgtgtctcctaatgccgttatcgcagacttaggactcattcgagtggaaaacaaatttagtctagttccgatggagcattacagcctacctccagtgatcgataaaatgaacatcgaactgacccagttaaaactgtcgcgcaccattctccaagcgagtctcccacagaatgatattgagattctgaagcctgtgaacatgctcctgtccatccagcgaaatctcgcggctgcgtggtacgtgcagatcccaggcatggagattaagggcaagttaaagcctatgcaggtggcgctgagtgaagacgacctaaccgtcttgatgaagatcttactcgaaaatttgggggaggcttcatctcaacctagccccacacaaagcgtccaggagactgtgagagtgcggaaagtggatgtatcttccgtgcctgaccatctaaaggagcaggaagactggactgatagcaaactttctatgaaccagattgtctccctgcagtttgacttccacttcgagtccttgtctataatactctataataacgatattaaccaggaaagcggggttgcattccacaatgatagttttcaattaggtgaactgagactgcacctgatggccagctccggcaagatgttcaaagacgggtccatgaatgtcagcgtcaaactgaaaacttgcaccttggacgacctgcgcgagggcatcgaacgcgctacatctagaatgattgatcggaagaacgaccaggataataacagcagcatgatcgatatcagctacaaacaggacaagaacggcagccagatcgatgcagtgctcgataaactgtatgtgtgcgcttccgtggaattcctcatgactgtggccgatttctttatcaaagctgtaccacagtcccctgagaacgtggccaaggagactcagatccttcccaggcagacagcaacaggtaaagtcaagatcgagaaggatgactctgttcggcctaacatgacattgaaggcaatgatcactgacccagaggtagtgttcgtcgcatctcttacaaaagcagatgcccctgctcttacggcctcctttcagtgtaatctgagcctttctacatcaaaactcgagcaaatgatggaagcaagtgtacgggacctgaaagtgctggcttgcccattccttcgcgaaaaacgaggtaaaaacattacaacggtactgcagccatgcagcctcttcatggagaagtgtacgtgggcaagcggcaagcagaacattaacattatggtaaaagagttcataattaagatctctcccatcattttgaataccgttctaaccattatggctgcgctaagtccgaaaacgaaggaagatggctccaaggatacctcgaaggaaatggagaacctgtgggggatcaagtccattaacgattacaacacatggttcctcggagtagacactgcgacagaaatcactgagtcttttaaggggatcgaacactccctgatcgaggagaattgtggagtagtcgtggaaagcatacaagtgaccctggagtgcggcctgggccatagaactgtgccactgttactggcggagtcaaagttcagcggtaatattaagaattggacatctctcatggccgctgtggcagacgtgactttgcaggtgcattattataacgagattcacgccgtgtgggagccgctgatcgagcgtgttgagggtaagagacagtggaatcttaggctcgacgttaagaagaatcctgtacaagacaagtcactgctccccggagatgactttatccccgagcctcagatggcaattcatatttcatccgggaataccatgaacatcactatctcaaaaagctgcctgaacgttttcaataaccttgccaagggtttctccgaagggactgccagcacctttgattacagccttaaagaccgagcccctttcaccgtgaagaacgcagtgggcgtgccaattaaggttaaacccaattgtaatcttagggtgatggggttccctgagaagagtgacatcttcgacgtggacgccggtcagaacttagaactggagtacgctagcatggttccaagctcccagggcaacttaagtatcctaagtagacaagagagctctttttttacgctgactatcgtcccccacggatacacagaggttgccaacattcccgtggccagaccaggcagacgcctatacaatgtaagaaaccctaacgcctcccatagcgacagtgtactcgtccagatagacgcaacagagggcaataaggtgataaccctgagaagcccattacagataaaaaatcacttcagcatagcatttattatctataaattcgtcaaaaacgtgaaactgctggaacggataggaatcgcccgaccggaagaagagttccacgtccctttagattcttatcgttgtcagcttttcattcaaccagccggtattctcgagcatcagtataaggaatctacaacatatattagctggaaggaagaattgcacaggtcccgtgaggtaagatgcatgcttcaatgtccctctgtcgaggtatcgttcctgcctttgattgtgaacactgtcgccctgccagatgagttgagctatatctgcacacatggcgaggactgggatgtcgcatacatcatacacctgtacccctcccttactctccggaacctcctcccatacagcctccgctacctccttgaagggaccgctgaaacacacgagctggctgagggatcaactgctgatgtccttcacagcaggatttccggagagatcatggagctagttcttgtaaagtaccagggcaagaactggaatggacactttagaattcgcgacaccctgcccgagtttttccctgtgtgtttttcaagtgactccacagaagtgacgaccgtggatttgtccgtgcatgtaagacgtattggaagcaggatggtcctctccgttttctccccttactggctgattaataagactacaagagttctgcagtatcggagcgaggacatccatgtcaagcacccagccgacttccgcgatattatcctctttagctttaagaaaaagaacatcttcacgaagaacaaggtacaactcaaaatcagtactagcgcttggtcctcctccttttctttggatacagtaggttcctacggttgcgtgaagtgccctgctaacaatatggaatatctcgtgggggtcagtataaaaatgagttctttcaatctcagtcgtatcgtaaccctgactcccttttgcaccatcgccaataagtcttctctggaactggaagtgggagagatcgcctccgatgggtccatgcctacaaacaagtggaattatatcgcatctagtgagtgtctgcccttctggccagaaagcctatctggcaagctttgtgtgagagtggtaggatgcgaggggagttccaagccgttcttttataacaggcaagacaacggtacattactctccttggaggatctcaacgggggtattttagtcgacgtcaacacagcagagcactctaccgtcattaccttctcagattaccatgaaggatccgccccagctctcatcatgaatcacacaccatgggacatccttacctataaacagtcgggtagccccgaggaaatggtgctgcttccccgtcaggcaagactgttcgcctgggctgatccaaccgggactcgtaaactgacgtggacatatgcggctaacgtaggggagcacgacctgctgaaggacggctgtgggcaattcccttacgatgctaatatccaaatacattgggtgtctttcctcgacggaagacagagggttctgctattcaccgatgacgtcgccctcgttagcaaagctctacaggcagaagagatggaacaggctgactacgaaatcacactgagcctacattccttgggcttgagtctcgttaacaacgagagtaaacaagaggtatcttacatcggaatcacttccagcggtgtggtgtgggaagttaaacccaagcagaagtggaagccattctcccagaagcagatcatcctcctggaacagtcatatcagaagcatcagatttctcgtgatcatggctggataaaactagacaacaatttcgaggtgaatttcgataaggaccccatggaaatgcgcctgccgatccggtctcctattaaaagagattttctgtctggcatccaaatcgagttcaaacaaagtagccatcagcggtccctgagagcgagactgtattggttacaggttgacaatcagcttccaggagcgatgttcccggtcgtatttcacccagtcgcccctcccaaatccatcgcccttgattctgaacccaagccattcattgacgtcagcgtgataacccggtttaatgagtactccaaagtgctccagtttaagtacttcatggtgttgattcaggaaatggccttaaagattgatcagggcttcctcggcgctatcatagccctgttcacacctaccacagaccctgaagccgagaggcgacgaaccaaattaatccagcaagatatagacgccctgaatgctgagctgatggaaactagcatgactgacatgtccattctgagtttttttgagcactttcatatcagtcctgtcaagctccatctcagcctgagtctggggtcaggtggcgaagaatctgataaagagaaacaggagatgttcgccgttcactcagtgaatctcttgctcaagagcattggtgccacactgaccgacgtagacgatctgattttcaaactagcttactacgaaatacgataccagttctacaaacgggaccagctgatctggtccgtagtccgccactacagcgaacaatttctcaagcagatgtacgtgttagtgctgggactcgacgtgctgggaaatcccttcggcctcatcaggggtctgagtgagggtgtggaagctcttttctatgaaccatttcagggagccgtgcagggtccggaagaattcgcggaaggtttagtgatcggtgttcgctcccttttcgggcatacagtaggtggagccgctggggtggtatctcgcatcactggatcagtggggaagggcctcgccgctattaccatggataaggagtaccagcaaaaacgacgagaagagctgagtcgtcagcccagagactttggggactctttagctcgagggggaaaaggctttctgagaggtgtggtggggggtgtaaccggtataattactaagcccgtcgaaggagcaaagaaagagggagccgctggattttttaaaggcatagggaagggcctcgtgggcgcagtagcccgaccaactggtggcattgtggacatggctagtagcacgtttcagggcatccagagagctgcagaatcaaccgaagaggtgtcaagcctgcggcctcctcggctgatccacgaggatgggatcattcgaccttacgatcggcaagagtcagagggctccgatttattggagcaggagttggaaatccaggagtaa

SEQ ID NO: 60989 - DNA, 10758 bp, Artificial Sequence
  Description of Artificial Sequence: Synthetic coding sequence
atggtgcttgaatctgtagtggccgacttgctgaataggtttctgggtgattatgtcgagaacctgaataagtcccaactgaagctgggtatctggggcggaaatgtggcactggataacctgcagatcaaagagaacgccctgtcagagttagacgtcccattcaaagtgaaagctgggcagatcgacaagttgaccctcaagattccatggaagaatctttacggcgaagctgtcgtcgcgaccttggagggcctttacttgctcgtggtccctggagcctcaattaaatacgatgctgtcaaagaagagaagagcttgcaggacgtcaagcagaaggaactttcccgtatcgaggaggctcttcaaaaagccgctgagaaagataagccaaaagaggctaagaaggacactttcgtggagaagctggccacccaggttatcaagaatgtgcaggtcaaaatcaccgatattcacatcaaatatgaggacgacgttactgatcctaaacgcccactgagctttggagtgacgctgggagaactgagcctgctgactgccaatgagcattggacaccctgcattctgaacgaggccgataagatcatatacaagctgatcagattagacagcctttctgcatattggaacgtgaactgctcaatgtcctatcagagaagccgcgagcaaattctggaccagctgaagaacgaaatactaacatccggcaacataccgcctaattaccagtacatttttcagccgatttcagcgagtgctaaactgtacatgaatccttacgccgagtctgaattgaagacccccaaactggattgtaacattgagatacaaaatattgcaatcgagctgaccaagcctcagtatctatccatgattgatctgcttgaaagcgtggattacatggtccgcaacgcgccttataggaaatacaaaccctatctgccattgcacactaacgggagacgctggtggaagtatgctattgattcagtgcttgaggtgcacatacgaagatacacccagatgtggtcctggtcaaacattaaaaagcaccgccaattactcaaatcatataaaatcgcctacaagaataagctgactcagtccaaggtttcagaagagatccagaaggagatccaggacttggagaaaactttggatgtttttaacataatcctagcccgtcagcaagcccaggtggaggttattagatccgggcagaagctcagaaagaaatctgcggacactggagaaaagcgcggagggtggtttagcgggctgtggggaaagaaggaatctaagaagaaggacgaagagagcctgattccagaaactattgacgacctcatgactcctgaggagaaagacaagctgttcacagccatagggtactccgaaagtactcataacctgactctcccaaaacaatatgtagcacacattatgactctcaaactggtcagtacctcagtgactatccgggagaacaagaacatccctgaaatactgaaaattcagatcatagggctgggtacccaggtttcccagagacctggagcccaggccctgaaggtggaagcaaagctggagcactggtacatcaccggacttcgacagcaagacatcgtgccttccctggtcgcttccatcggggacactacatcatccttgctgaagatcaagttcgaaacaaatcccgaggactctccagctgatcagacgctgatagtgcagtctcagccagtggaagtcatctatgacgcgaagacggtaaacgccgttgtggagtttttccagtccaataaaggcctcgatctggagcagatcacgtccgctacactgatgaaattggaggagatcaaagagcgaactgcgacggggttaacccacattatagaaacgaggaaagtcctcgacctcagaataaatctgaagcccagctacctcgtagtgccccagacaggcttccatcacgaaaaaagtgacctattgatccttgactttgggacatttcagctgaatagcaaggaccagggattacagaagacaaccaactcttcactggaggaaatcatggacaaagcctacgacaagttcgatgtggagatcaagaatgtgcagctgctgttcgctcgagctgaggagacttggaagaaatgtcggtttcagcatcccagcacaatgcacattctgcagcctatggacatccacgttgagctcgccaaggccatggtggagaaagatatcaggatggcgagattcaaggtctccggcggtcttccgctaatgcatgttaggattagcgatcagaaaatgaaggatgtgctgtatctgatgaacagtattccactgccccagaagagctccgctcagagccccgagcgccaggtaagctccatccctattatcagcggcggaaccaaaggcctcttggggacaagcttgttgctggataccgtggaaagcgagtccgacgatgagtacttcgatgcagaagatggcgaaccccagacatgtaagtctatgaagggctcagaactcaagaaggcagctgaggtgcctaacgaagagttgatcaaccttcttctcaaattcgaaatcaaggaggttatcctagaattcacaaaacaacagaaagaagaagatactattctggtgtttaatgtgactcaactgggcacagaggctactatgagaacttttgacctcaccgtggtgtcctacctaaaaaaaatctccttggattaccacgagattgaaggaagtaagcggaagcccctccatctgatatcatcaagtgataagccaggccttgacttattgaaagtggagtacattaaggccgataagaatgggccttccttccagactgcatttggtaagaccgagcagaccgtgaaagttgccttctcttcgctgaacctactactgcagactcaagcacttgtggcctccataaactaccttacaacgattattcccagcgatgaccaatcaattagtgtcgccaaggaagtccagatctctaccgaaaaacaacagaagaattccacactgcctaaggctatcgtgtcttcaagagatagcgatataatcgacttccggctatttgctaaactcaacgccttctgcgtaattgtgtgtaacgagaagaataacatcgcagaaatcaaaatccaaggtttggactcatctctgtcgctgcagagtagaaaacaatctctatttgcgaggttagagaacattattgtgaccgatgtagaccccaagaccgtgcataaaaaggcggtcagtatcatgggaaatgaagtctttcgcttcaacttggacctttaccccgatgctacagagggcgatctctataccgatatgtccaaagtggatggagtgctgtcactgaacgtcggctgtatacagattgtttacttacacaagtttctcatgagtctgttgaacttcctgaacaactttcagaccgccaaggagagcctgtcagcagccaccgctcaggctgccgagcgggcagctacatctgttaaagaccttgcacagcgcagctttagggtgtctatcaacattgacctcaaggctcccgtgatcgtcatccctcagtctagcattagcactaacgccgttgtggtggacctaggcttaatccgggtgcacaaccagttttcactggtgtccgacgaggactacctgaacccgcctgtgattgatcggatggacgttcaactgactaagctgaccctttacagaacggtcatccagccagggatttatcacccagacatccagctcttacatcccattaacctcgagttcctcgtcaataggaacttggccgcttcttggtatcacaaggtacctgtcgtagagatcaaagggcatctggactctatgaatgtctctttaaatcaggaggaccttaacctactgtttagaatccttacagagaacttatgcgaaggtaccgaagatctggacaaggtgaagcccagagtgcaagagactggcgaaatcaaggagccactcgagatctcaatctcccaagacgtccatgatagcaagaacaccctgactaccggggtagaggagatccgtagtgtggatattatcaacatgctcttgaactttgaaattaaggaagtagtcgttacacttatgaaaaagtccgaaaaaaaaggaagacccctccacgagctgaatgtactccaactgggcatggaggccaaagtgaagacatatgatatgaccgctaaggcttatttaaaaaaaatatccatgcaatgctttgattttacagattccaagggtgagcccctgcacatcattaattcatctaatgtgaccgacgaaccattgctgaaaatgcttttgaccaaagctgactcagacggcccagagttcaagacaatccacgatagcactaaacagagactcaaggtctcatttgcctccctggacttggttctgcatctcgaggccctgttatcgtttatggatttccttagctccgccgctcctttcagtgagccatctagttcagagaaggaaagtgaacttaaacctctggtcggagaatcccggtccatagcagtcaaggcagtatcttcaaacattagccagaaagatgtctttgacttaaaaattacagctgagctcaatgccttcaacgtgttcgtatgcgatcagaaatgtaacattgcagacatcaaaatccatggaatggatgcctcaataagcgtgaagccgaagcagaccgatgtcttcgccaggcttaaagacatcatcgtcatgaatgtggacttgcagagcatccacaagaaagctgtctcaatcctgggagacgaagtgttcagatttcagctcactctctacccggatgccaccgaaggcgaggcatatgcggatatgtctaaggtggacggtaagctttccttcaaggttggctgcatccaaatcgtctatgttcacaaattcttcatgtcccttctgaacttcctcaacaattttcagaccgctaaggaagcactgtctacggcgaccgtgcaggctgcggagagggctgccagcagtatgaaggacctggctcagaagtccttcaggctgctgatggacataaacctgaaggccccagtgatcatcattccccagagctccgtttctccgaacgccgttatagcagatctgggcctgattcgtgtggagaacaagttcagccttgtgccaatggagcattattcgctgccgccagtcattgacaaaatgaacatagagcttacacagttaaagcttagcagaactattttacaggcctctcttcctcaaaatgacatagaaatcctgaagccagtgaacatgctgctgagcattcagagaaacctggctgctgcctggtacgtacagatccctggcatggagatcaaaggcaagctgaaacccatgcaagttgctctctctgaggacgacttgaccgtgctgatgaagattctgttagagaacctaggggaggctagtagccagccctcaccaacccaatctgtccaagaaacagtgagggtgcggaaggtcgatgtttcatcggttccggatcatttgaaagagcaagaggactggacagattcaaagctctctatgaatcagatcgtgtcacttcaatttgacttccacttcgaaagcctgtcaattatactgtataacaatgatatcaatcaggaatccggagtggccttccacaacgatagtttccagctcggtgagcttcggctgcatctcatggcaagtagcgggaaaatgtttaaggacggaagtatgaacgtgtccgtaaagctgaagacctgtacgctcgatgatttgagggagggaatcgaacgcgcaacaagtcgcatgattgacagaaagaacgaccaggacaataattcatccatgatcgatattagctacaaacaggacaagaatgggagccagatcgacgctgtgctcgataagctctatgtgtgcgccagtgtggagtttctgatgaccgtggcagacttcttcataaaagctgttccgcagtccccagagaacgtggccaaggagacccaaatcctacccagacagacggccacaggaaaagtgaaaattgaaaaggacgacagcgtgcgacccaacatgaccctgaaggcaatgattaccgacccagaggtcgtattcgtggcctctctgacaaaagcagatgccccagccctcacagctagtttccagtgtaacctgtctcttagtaccagtaagctagagcagatgatggaggcctccgtccgggatctgaaggtcctggcctgcccattcttacgagagaaaagaggaaagaatatcacaaccgtgctccaaccatgttctctattcatggagaagtgcacttgggctagtgggaaacagaacattaacatcatggtgaaggaatttatcatcaaaatttcacccatcatcttgaatactgtgctgacgatcatggcggctttgtctccaaagacaaaggaagatggctccaaggataccagcaaggagatggaaaacctgtgggggatcaagtccataaacgactacaacacatggtttctgggagtggatacagccacagaaattaccgagtcctttaaaggcatcgaacactcactgatcgaggaaaattgcggggtcgtcgttgagagcatccaggtgaccctcgagtgtggactggggcacagaaccgtgcccctgttactggcggaaagcaaattttctggtaatatcaagaactggacatctctgatggctgcagttgcggatgttacccttcaggtacactactataacgagatacacgccgtctgggaacccctgatcgagagagtagagggcaagaggcagtggaatttgaggttggacgttaagaagaatcccgtccaggataagagtttgctgcccggagatgactttattcccgaaccacagatggccatccatatctcaagcggaaacactatgaacatcactatcagcaaatcatgtttgaatgtgtttaacaatctggccaaaggatttagtgagggtaccgcaagcactttcgattattccttaaaagaccgagcgcctttcacggtcaagaatgcagtcggggtgccaatcaaggtgaagcctaattgcaacctgagagtcatgggctttcctgaaaagagtgacatctttgatgtggatgccggacaaaatcttgagttagagtacgctagcatggtgccttccagccaaggaaatcttagcatcctcagcagacaggaatcctctttctttacccttactattgtcccacatggctacaccgaggtagctaacattcccgttgcgagacctggtcgcagattgtacaatgtgcgcaatccgaacgcaagccacagcgactctgtgctcgtgcagattgacgccacagagggtaataaagtcatcactctacggtccccgttacaaatcaagaatcacttcagtatcgcctttattatctataaattcgtgaagaacgtgaaattactagagcgcattggcattgctcgaccagaggaagaatttcatgtgccgctggactcttatcgttgtcagctgtttattcagcccgcaggcattcttgagcatcagtataaggaatctactacttatatctcgtggaaagaggaactccatcgttcaagagaagtgagatgcatgctgcagtgtccctccgtcgaggtctcatttttacccctaatcgtgaacaccgtggccctgcctgatgagctgagctatatctgcacgcacggggaggactgggatgtggcctatatcattcatctgtaccccagcttgaccctgagaaatctactaccctattcgctgaggtaccttctcgagggaaccgcagaaactcatgaactggcagaagggtccacagctgacgtgcttcacagcagaattagcggggaaatcatggagctggtcctggtgaaatatcagggaaagaattggaacggccactttaggatacgcgatacactccccgagttcttccctgtctgcttcagttctgatagcaccgaagtgactactgtagatctcagcgtccacgtgcgaaggataggaagccggatggtgctgtccgtgttctcgccttattggttgatcaataagacgaccagagttttgcaatacaggagcgaggatatccacgtgaaacacccagctgactttagagacatcatcctgttctcattcaagaaaaagaatatcttcacaaaaaataaagtccagttgaaaattagtacaagtgcttggtctagcagtttttcacttgataccgtggggagctacggctgcgtgaaatgcccggcaaataatatggaatatctggtcggtgtatccattaagatgtctagctttaatctctcccggattgtgacgctgacaccattctgtaccatagcgaacaagtctagtttagagttggaggttggtgagatagcttctgacggcagtatgcccaccaacaagtggaattatatcgcgagtagcgagtgcctccccttctggcccgaaagcttgagcgggaagctgtgcgttcgagtggttgggtgtgaaggtagctccaagcccttcttctacaaccgccaagataatgggaccctcctgtcattggaggacctgaacggcggaatcttagtagacgtcaacaccgccgaacacagtaccgtcatcacattcagcgactatcatgagggttccgcgccagccttgataatgaatcacacgccctgggacatactgacttataagcagtccgggtctcccgaagaaatggttctgctgccccgtcaggccagactgtttgcctgggccgatcctaccggcacccgaaagctgacatggacgtacgcagctaacgttggagagcacgatctgcttaaggacggttgtgggcagttcccatacgatgccaatattcagattcattgggtgtcattccttgatggaaggcagcgcgtcctcctatttactgatgacgtggcgctcgttagcaaggcgttgcaggctgaggagatggagcaggccgactacgaaattacgctgagcctccattccttgggcctgtcacttgtgaacaatgagagtaagcaggaggtatcttacatcggaatcacaagctcgggcgtggtctgggaagtgaaaccaaagcaaaagtggaaaccgtttagccagaagcagattatccttctcgagcaatcctaccagaaacaccagatttcaagggaccatggttggattaaactggacaataatttcgaagtgaattttgataaagacccaatggagatgagactcccaattcggagccccatcaaacgcgacttcctgtctgggatacagatcgagttcaaacagtcatcccaccagcgtagcctgcgagcgaggctgtactggctgcaggtagacaatcagttgcctggagcgatgtttccagtcgtatttcatccagtcgcaccacctaaaagcatcgccctggactcagaacctaagccgtttattgatgtctctgttataacacggtttaatgagtactcgaaagtcttacagtttaagtacttcatggtcctcatccaggagatggccctgaaaatcgatcaggggtttctcggcgctataatagccttattcacccctaccaccgaccccgaagctgagcgaagaaggacaaaactgatccagcaggatatcgatgcactgaacgccgagcttatggagacctcgatgacggacatgagtattttgtcatttttcgagcatttccacattagtcccgtgaaactccacctgtctctgtccctcggcagtggaggcgaagagagcgacaaggaaaagcaggaaatgttcgctgtccacagtgtgaacctgctgctgaagtcgatcggcgcaactctgactgacgtggacgacctgatttttaagctggcctactatgagatacgctaccagttttacaaaagggaccaattgatctggtcagtggttagacattactcggagcagttcctgaaacaaatgtacgtcctggtattgggactcgatgtgctggggaatccttttggtcttatcaggggcctgtcagagggtgtggaggcactgttctatgaaccattccaaggggcagtgcaggggcctgaagaattcgccgagggccttgtgattggtgtcaggagcctatttggccataccgtggggggagcagcgggagtggtgagcaggatcacgggcagcgtcggcaagggactggccgcaatcaccatggataaagagtatcagcaaaagcgcagagaagagctgtctcggcaacctcgagacttcggggacagccttgccagaggaggcaagggatttctgcggggagtcgtgggtggggtaaccgggattatcaccaagcctgtggaaggggcaaaaaaggaaggggctgctggcttctttaagggcatcggcaaagggttggtaggcgctgtggccaggcccaccggcggtattgttgatatggcctcaagcacattccagggcatacagcgcgcagccgaatccacggaggaggttagcagcctgagaccccctaggctgatccatgaggacgggattatacgcccttacgaccgtcaagaaagtgaggggagcgatttgctcgagcaggaacttgaaatacaggaatag

SEQ ID NO: 60990 - DNA, 13092 bp, Artificial Sequence
  Description of Artificial Sequence: Synthetic coding sequence
atgctcgaaggactggtggcatgggtcctgaacacttatcttggcaagtatgtcaacaacctaaataccgatcaattatccgtggcgctactcaagggggctgttgaacttgagaacctaccactgaagaaggacgctcttaaggaactggagttaccattcgaggtgaaggccggattcatcggcaaagtgacactgcagatccccttctacagaccgcatgtggacccatgggtgatctcaatcagcagcctgcatctcatcggagccccagagaagattcaggatttcaatgatgagaaagaaaagttactcgagagggaaaggaagaaggccctcctccaggcactcgaagagaagtggaaaaatgataggcagcaaaagggggaatcatattggtacagcgtgaccgcatccgtcgtcacaaggattgtcgagaatattgagctcaaaatacaggatgtgcacttaaggttcgaagatggtgttaccaacccatcccacccttttgcttttggaatctgcattaagaacgtgagcatgcagaatgccgtgaatgagcctgtgcagaagctgatgagaaagaagcagcttgacgtcgccgagtttagcatctactgggatgtcgattgcacactgctaggggatctgccgcagatggagctccaggaagctatggctcgaagcatggagtcaagaagccaccactacgtgctggaacctgtgttcgccagtgcgctgttgaagcggaactgttccaagaagcctctgcggtcccggcatagcccaagaatcgattgcgatatccaactcgagacaatccccctcaagttatcccaactgcaatatcgtcagattatggaattcctcaaagagctcgaacggaaagaacggcaggttaaattcaggcgatggaaacctaaagtagctatatcgaagaactgcagggagtggtggtattttgccctgaacgctaacctgtacgaaattagggagcagagaaagcgctgcacctgggacttcatgctgcaccgggctcgagatgccgtgtcgtataccgacaaatattttaataagctcaaaggaggactgctgtctactgacgacaaggaagagatgtgcaggatagaggaggaacagagcttcgaagaactcaaaatactccgtgagctggtgcacgacagattccacaagcaggaggagttagccgagagcctgcgcgagccccagttcgactcccccggtgcctgccccggagcccctgagccagggggaggatctgggatgctgcagtatttacagagttggttccccggatgggggggttggtacgggcaacagacgcccgaagggaacgttgtcgagggcctgtctgctgaacagcaagagcagtggatccctgaggaaatcctgggaactgaggagttttttgatcctaccgccgacgcctcctgcatgaatacctacaccaaaagagaccacgtctttgcaaagctgaaccttcagctgcagcggggtactgtgaccttgcttcataaggagcaaggtacacctcaaatgaacgagagcgcttttatgcagctcgagttctctgacgtcaagctcctcgcggaatcacttccgagacgaaacagttctctgcttagcgtccggctcggtggcttgttcctgcgggatttggctaccgagggaacaatgttcccattgctggtgtttccgaatccgcagaaggaggtggggagagtgagccagtcatttggccttcaaacaacttctgccgatcggtccgaccactatcccgctgccgacccagatggccctgtgtttgaaatgctctacgagagaaaccctgcccacagccactttgaaagacgcctgaatgtatccacgcggccactgaatattatttacaatccgcaggccataaagaaagtggcagacttcttctataaaggaaaagtgcatacgagtggtttcgggtaccagtctgaactggagctgcgcgtcgctgaagctgccaggagacagtataacaagctaaagatgcagacaaaagccgaaatcaggcagacattggaccgtctgcttgtgggcgactttatagaggagagcaagaggtggactgtgaggctggacatttcggccccacaggtcatttttccagatgactttaagtttaaaaatcccgtattggttgtcgtggacctaggcaggatgctactcactaacacacaggataatagcaggcggaagtccagagacggctcagcatctgaagaaacccaattttcggatgacgagtataagacaccactggctacaccaccgaacaccccgcctccggagtcatcctcaagtaacggagagaaaacaccacctttcagcggcgttgagttttccgaggaacaacttcaagcccacctgatgagcacaaagatgtatgaacgttactctttaagcttcatggatctccagataatggtgggaagggtaaaggacaattggaagcatgttcaggatatagacgtgggcccaacccatgtggtggagaagttcaatgttcacctccagctggaacgaaggcttatatacacctctgacccaaaatatccaggagcagtcctgagtggcaacttgcccgatctgaagatccacatcaatgaggataagatcagtgcgctgaagaactgtttcgccctactgacgacaccagagatgaagacctctgacacgcagataaaagaaaagatttttccacaagaggagcagaggggctccctgcaagactctgtgatgaacctcacacagtcaattgtgctccttgaacagcacacacgagaggtcttagtagagtcccagctgttgctcgctgagtttaaggtgaactgtatgcagctgggcgtggaatcaaacggacgctacatctccgtactcaaggtcttcggaaccaatgcccatttcgtaaagcgtccttacgacgccgaggtttccttaacggtacatgggctgttgctggtggatacaatgcagacctacggagccgattttgacctgttaatggccagtcacaagaatcttagcttcgacatacctaccggctccctcagggatagccgggcacagagccccgtgagtgggcctaacgtggcgcatcttacggacggtgccactcttaacgaccgctctgcaacatcggtgtccctagataagatcctcactaaggagcaagagtccctaattaagctggaatatcagttcgtcagttctgaatgcccctctatgaacctggattctacattgcaggtaattagcctgcaggtgaacaatctggacatcattcttaaccctgagacgatcgtcgaactgatcggctttctccagaagagctttccgaaggaaaaggacgatctctctccccaacccctgatgacggacttcgagcgatcttttcgggagcagggaacttatcaaagcacctatgaacagaataccgaggtcgctgtggaaattcacagactgaatttgctcctgctgcggacagtgggaatggccaacagagagaagtatggccgaaaaattgctacagcaagtatcggcggtacaaaagtcaatgtgagtatggggagcacattcgatatgaacgggagtctcggctgtcttcagctgatggatctgacccaagataacgttaagaaccagtatgtcgtatcaatcggcaactcagtgggctatgagaacattattagcgacatcggctactttgaatcagtgttcgtcagaatggaggatgcagctctgacagaggctctgtcctttactttcgtcgaaagatccaaacaggagtgtttcctgaatttaaagatggccagcctccattataaccattctgccaagttcctgaaggagttgacactgagcatggacgaactggaggagaacttccgtggcatgctaaagtccgccgctaccaaggtgacaacagttctggccacgaaaaccgccgaatactctgagatggtatctctcttcgaaacccctaggaaaaccagagagccctttatactggaggaaaatgaaatttacggctttgatctcgcctctagccatctggacactgttaaactgatcctgaacataaacatcgagtcaccagtggtgagtatccccagaaaaccaggcagtcctgagctcctagtgggacatctgggccagatatttattcagaacttcgtggcgggtgacgacgaatcccggagcgaccggctgcaggtggagataaaagatatcaagctgtatagtctcaactgcacccagcttgctgggagagaagcggtgggctcagagggatcaaggatgttctgtcccccttctggcagtggatctgctaactctcaagaagaggcacactttactcgtcacgacttctttgagtctctgcatcgcggacaggcttttcatattttaaacaacaccacaattcagttcaagctggaaaagattcctattgagagagagtctgaattgaccttctccctttcgcctgatgacctgggcacatcctctatcatgaagatcgagggaaagtttgtgaaccccgtgcaggtagtcttggcgaagcacgtgtacgagcaagtactgcaaactctggacaacctcgtgtactccgaggatctgaataaataccctgcttcggccactagttcaccatgtccggatagtcctctcccaccactgtctacctgcggtgaaagctccgtggaacgaaaagaaaacgggctctttagtcattccagcctctccaatacatcgcagaaatcgctgtcggtgaaggaagttaagtcatttactcagattcaggccaccttttgcatttccgaactgcaggttcagctttcaggcgacttgaccctcggggctcagggtctcgtgtctctgaagtttcaggatttcgaggtagagttctcgaaggaccatccccaaaccctgagcattcaaattgccctccattccctcctcatggaagatcttctggaaaaaaacccagacagtaagtacaaaaacctgatggtgtcccgtggcgcaccaaagccttcctccctggctcagaaggagtatctcagccagtcatgcccgagtgtgtctaacgtggagtatccagatatgccaagatcacttccctcccatatggaggaagcacccaatgtcttccagctttaccagcggcctacatctgcctcccgtaagaaacagaaggaggtccaggataaagattatccccttacccctcccccatcacctacggtggacgagccaaaaatactcgtcggaaagtctaagtttgacgattcgctggttcatataaatatcttcctcgtggataagaaacaccccgaattttcttccagctacaatagggtgaaccgaagcatcgacgtcgattttaactgcttggacgtcctgattactttacaaacatgggtggtgattttggactttttcggaattgggtccacagccgataaccacgcaatgagactgcccccagagggtatcctccataacgtcaaactggagccccatgcaagcatggagagcggccttcaagaccctgtgaatacaaagctcgacctgaaggtacactcactcagcttagttcttaacaagacgacctcggaactggccaaggcgaacgtgagcaagctggtggcccacctggagatgatcgagggcgacctggccctccaaggcagtattgggagtctttccctttccgacctaacatgccatggagaattctatagggagcggtttaccacatcgggcgaagaggcccttattttccagacgttcaaatacgggcgtccagatcccctgctccggagagagcatgatattcgcgtctcactgagaatggccagcgtgcagtacgttcacacgcagcgattccaagctgaggtcgttgcatttatacagcattttacccagctgcaggatgtgctcggcagacagcgtgcagctattgagggtcagacagtgcgggaccaggcccagaggtgttcaagagtgttactggacatcgaagcaggagccccagtgctgcttattcctgagagttccagatccaataacttgatcgtcgccaatctgggcaagctgaaagtcaagaacaagtttctgtttgccggttttcccggtacgttcagcctacaggacaaagagagtgtgcccagcgcttcccccaccgggattcccaaacattcactacggaagaccacctcgacagaagagcctcggggaactcatagtcaagggcagttcactatgcccttggccggtatgtctcttgggtcccttaagagcgagtttgtcccttcgacctctaccaagcagcaaggtccccaaccaacgctgtccgtcgggcaggaatcatctagccccgaggaccatgtctgcctgctggactgcgttgtcgttgatctccaggacatggacatatttgctgcggaacggcatcctagagagtactccaaggccccagaggacagctctggcgatttgattttcccgtcgtactttgtaaggcagacgggcggaagcttactgactgagccgtgtaggttaaagcttcaagtggaaagaaacctggacaaagaaatcagccacaccgtgcccgacatttccatccatgggaatctatcctcagttcactgttcccttgacctctataaatataaattgattcgcggtctccttgaaaataacctgggggaaccgatcgaagaatttatgagaccatacgatctgcaagaccccaggatacacactgtactttctggggaagtatacacctgcatgtgtttcctgattgacatggtgaacgtcagcttggagctgaaggatccaaaacggaaggagggggcaggctcactcgcacgctttgactttaagaagtgtaagctgctgtatgaaagtttcagcaaccagacaaagtcaatcaacttggtctcccacagtatgatggcgttcgacacccgatacgcagggcagaagacatcacccggaatgactaacgtatttagctgcatattccagcctgctaagaatagctcaactacccagggatcaattcagatagaactacacttcagatctacgaaggatagctcttgctttaccgtggtactcaacaaccttagagtctttcttatcttcgactggctccttctggtacacgactttctgcatactccctcagacatcaagaagcagaaccacgtgactccgtctagacacagaaatagctcatctgagtccgccattgtgcccaaaaccgtgaagagtggcgtggtaaccaagcgcagtagtttaccagtttccaatgaaagacatctggaggttaaagttaacgtaacaggtactgagtttgtcgtcatagaagacgtgagttgcttcgatacgaatgccattatcttgaaggggacgacagtgctgacatataagcctaggtttgtcgaccggcctttcagtggcagtttatttgggattgaagtcttctcctgtagactcggaaacgaacacgatactgctttgagcatagtcgatcccgtccaaatccaaatggagcttgtgggtaactcatcataccagaactccagtgggcttatggatgcctttaactcagaggatttcccgcctgttttagagatccaactccaggctctggatatacgtcttagctataacgatgtccagctctttctggcaatcgccaagtcaataccagaacaggcaaatgctgcagtgcccgacagtgttgccctggagtcagatagcgtgggcacttacctgccaggcgctagcagagtgggggaggagatcagagaaggcacacgccacacattggaccctgtccttgaactgcagcttgcccgattgcaagaactgggcttttcaatggatgactgcagaaaggcacttctggcgtgccaaggccagctgaaaaaggccgcatcctggcttttcaaaaacgcagaaccgctgaaatccttatcactcgccagtaccagccgcgattccccgggagcggtcgctgccccattgatttcgggggtcgaaatcaaagcagaaagtgtgtgcatttgcttcattgatgattgcatggactgtgacgtgcctctagccgagttaactttttccagactaaactttcttcagcgcgtcagaacttcaccagaaggctacgcccacttcacattgtccggcgattactataatcgtgctctatcaggctgggaaccatttattgagccgtggccctgtagtgtcagctggcagcagcaggccgcttcacgtttacaccccccaagattgaagctggaagctaaggcgaagccccgtctagatatcaatatcacgtctgtacttatcgaccagtatgtcagcaccaaagagtcctggatggccgactactgcaaggatgacaaagatattgagtccgccaaatcagaagattggatggggtcctctgtggatccaccgtgcttcggccaaaccgaggttaagacccctaagaggaggcagccatttgtaccctttgccctccgcaatcataccggctgcaccctgtggtttgcaacactgacaaccacaccaactcgggctgccctgagccactccgggtcaccgggagtcgtgcctgaagggaatgggacattcttggatgatacacataatgtgagcgaatggagggaagtgctgactggcgaggagataccattcgaatttgaggctagggggaagttaaggcaccgccacacccacgatctacgaatacatcagctccaggttcgggttaacggttgggagcaggtgtccccagtgagtgtcgacaaagttgggaccttttttcgctatgctgcgccagataagaactccagttccagcaccattggtagccccagtagtcggaccaacattattcacccacaggtttacttttcttctctcccacccgtgcgcgtggtgttcgcagtcaccatggagggtagcgcaagaaaggtgattacagtgcggtcagccctaattgttcggaacagactagagacccctatggaactgagactggattctccttccgcacccgataaaccagtagtgcttcctgcaattatgcctggcgattccttcgctgtgccactacacttgactagctggcgcctgcaggcccgtccaaaaggccttggcgtgttcttttgtaaggccccaatccattggacaaatgtggttaagaccgctgagatcagctcttccaaacgcgagtgtcattctatggatactgagaaaagcaggttctttcgattctgcgtcgcaatcaagaaagaaaactatcccgactacatgccatctaatatattttccgactcagccaaacagatcttccgacagccaggccatacgatctatctcctccccaccgtagtcatatgcaatctactcccgtgcgagctggatttttatgtcaagggaatgcccattaacggcactctgaaaccaggcaaagaagctgctctccataccgcagatactagtcagaacattgaactcggagtttcactggaaaacttcccactttgtaaggagctactgattccaccaggcacacagaactacatggtcagaatgcggctgtacgatgtgaatagacggcagctgaacctgacaatacggattgtctgtagagccgaagggtcactgaaaatcttcatttctgccccttactggttaatcaacaaaaccggcctgcctcttattttccggcaggataacgcaaaaacagatgctgctgggcaatttgaagagcatgagctggctaggagcttatctccattgcttttttgttatgcagacaaggagcaaccaaatctatgtacaatgcggataggaagaggcattcaccctgagggcatgcctggttggtgccagggtttctccctagatggagggagtggagttcgcgcacttaaagtgattcaacaggggaatagacctggcctcatctataacattggaatagacgtcaaaaaaggcagaggtcggtatatagatacttgcatggtgatttttgcacccagatatctccttgataataagtcctcccacaaactggctttcgcccagcgtgaattcgctcggggtcagggaaccgctaatcccgagggctatatctccactctgcctggatcctcagttgttttccattggcccagaaacgactacgatcagttactctgtgtcagactgatggacgtgcccaattgcatttggagcggagggttcgaggttaacaaaaacaatagtttccatattaacatgcgggataccctgggtaaatgtttttttctgcgagtcgaaatcactcttcgcggagcaacttacaggatctctttctctgacaccgatcagctgccaccacctttccgcatcgataatttctccaaggttcccgtagtcttcacccaacatggagtagcagagcctagactgcgcaccgaagtgaaaccaatgacctccctggattacgcgtgggatgaacccaccctgcccccattcatcactctgacagtgaaaggagctgggagttccgagatcaattgcaacatgaatgactttcaggacaaccgacagttatactacgaaaactttatctatatcgccgctacttataccttttcaggcctccaggaaggaacaggacgtccagtggcctccaacaaagccattacctgtgcagagcttgttctcgacgtgtccccaaaaactcagcgcgtcatcttgaagaagaaggaacccggtaagagaagccagctgtggagaatgactggcaccggcatgctcgcccatgagggttcttccgttccacataaccccaataaaccgtcagcggctcgcagcacagaaggctcagctatactagacatcgcaggcctcgcagcagtgacagacaataggtacgaaccacttatgttacgaaagcccgataggagacgatccactacccaaacatggtcctttcgagagggtaaactaacatgtgggctccatggcctcgttgtgcaagccaaaggcggactgtctggcctctttgacggggcagaagtggtgcttggcccagacactagcatggaactcctgggtcctgtgccaccagagcaacagtttatcaaccagaagatgagacctggtagcggaatgctcagcatcagagtgatacccgacggccctacccgagctcttcagatcaccgacttctgtcatagaaaatcttccagaagttatgaagtggacgagctgccagtcactgagcaggaactccagaaactgaagaatcccgacaccgagcaggaactggaagtcctcgtaaggctggaggggggtatcggactttccctgattaataaggtgcccgaggaacttgtcttcgccagcttgacgggcataaacgttcactacacccaacttgcgacgtcacacatgcttgagctgtcgattcaagatgtccaggtggacaaccagctgatcggcaccactcagcccttcatgctgtacgttacaccattgagcaatgaaaatgaagttatcgaaaccggccctgccgttcaagtcaacgcggtaaagttcccatccaagagcgcgctgaccaatatttacaaacacctgatgatcaccgcccaaaggtttaccgtgcagatcgaggagaagttgctgctgaagctgctttcatttttcgggtacgaccaggctgagagcgaggtggagaaatatgacgagaacctccacgagaaaacagccgagcaagggggtacccccatacggtactatttcgagaacctgaagatcagcattccgcagattaagctgagtgtcttcacatcaaataagctgcccttggacttgaaagcccttaaatccactctagggtttcctctgatccggtttgaggatgcagtgattaatctggacccctttacccgggtccacccgtatgaaaccaaagagttcataatcaacgatatactgaagcacttccaggaagagctgctgagccaggccgcacgcattctgggttccgttgattttctggggaatccaatgggtctgcttaacgacgtctccgagggtgtaaccggactaattaagtatggaaatgtaggtggccttatccggaatgtcacccatggagtctctaatagcgccgctaagtttgccggtacccttagcgatggcttgggaaagacaatggacaatcgccaccagagcgaacgtgaatatatccggtaccacgccgctaccagcggtgagcatctggttgcgggaattcacggcctggcccatggtatcataggaggactgacctccgtcattacgtcaacagttgagggggttaaaacagaaggaggagtctcagggtttatttcaggactgggaaaaggcctagtggggacggtcactaaaccagttgcaggcgctttggattttgcctccgagactgcccaagctgttcgtgataccgccaccttgtctgggcctcggacccaagcacagcgagttcggaagccacgctgctgcactggccctcaaggcttgctccccagatacagtgaaagtcaagccgaaggccaggagcagctgttcaagcttactgataatattcaggatgaatttttcatcgcagtagagaacatcgacagctactgcgtgctgatctccagtaaagccgtctacttcctgaaaagtggagactacgtggacagagaggctatctttcttgaggtgaaatacgatgacctgtaccactgtctggtgtccaaagaccatggcaaggtctacgtgcaggttactaaaaaggcagtcagcactagctcgggtgtcagcataccagggcctagccaccaaaagccgatggtccacgttaagtctgaagtcctggcggtgaaattgagccaggaaattaattacgccaagagcttatactatgaacagcagctaatgctgcgtctgagtgaaaaccgcgaacagcttgaactagactcataa

SEQ ID NO: 60991 - DNA, 13167 bp, Artificial Sequence
  Description of Artificial Sequence: Synthetic coding sequence
atgctggaaggccttgtggcctgggtgctaaacacatacctagggaagtatgtcaacaatttaaataccgatcagttatctgttgccctgctgaaaggagcagtcgaattggagaacctgcctttaaaaaaggacgctctgaaggagcttgaattgccctttgaggttaaggctggattcatcgggaaggtcacacttcagattcctttttatagaccccacgtggatccttgggtgatcagtatcagtagcttgcacttgatcggagccccagagaaaattcaagatttcaacgatgagaaagaaaaacttctggagcgagaaaggaaaaaggctcttctgcaggctctggaggagaagtggaagaatgatcggcaacagaaaggcgaaagctattggtactctgtgaccgcctctgttgtcacaaggatcgtggagaacatcgaactgaaaatccaggatgtgcacctacgctttgaggacggcgtgacaaacccgagccatccctttgcttttggtatttgtattaagaatgtctcaatgcagaatgccgtgaacgaacccgttcagaaactcatgaggaagaagcagctagacgtggccgagttctccatttactgggatgtggattgcacccttctgggcgatctgccacagatggagctccaggaggcaatggcacgcagcatggagtcgcggagccatcactacgtgctcgagccagtcttcgcatcagcattgctgaagaggaattgcagcaaaaaacccttacgcagccgacacagccccagaattgattgtgatatccagctggagacgatccccctgaaattaagtcagcttcaatataggcaaatcatggaattcttgaaggagctggaaagaaaagaacgacaagtcaaattccgtcgatggaaacccaaggttgctatctccaaaaactgtcgagagtggtggtacttcgcattgaatgctaacctctatgagattcgagagcaaagaaagaggtgtacatgggattttatgctccacagagcgagagacgccgtgagctacaccgacaaatattttaacaagctaaagggaggactactgagtaccgatgataaagaagagatgtgtaggatcgaggaagaacagtctttcgaggagctgaaaattcttagggagctggtccatgataggttccacaaacaagaagagctggccgagtcgctgcgcgaaccccaatttgattctccgggagcgtgccctggagcacccgagcccggaggcggttccggaatgctccagtatttacagagttggttccccggttggggaggctggtatggccaacagactccggaaggaaacgtggtggaaggcttgtcagccgagcaacaggagcagtggattcccgaggagatactcggaaccgaggaattctttgatccaactgctgacgcctcctgtatgaatacctatacaaaaagggaccatgttttcgccaagcttaacctccagctgcaaagaggaaccgtcacgttgctccataaagagcaaggaactcctcagatgaatgagtctgccttcatgcagcttgaattctccgacgtgaagttgctggctgagtcattaccacgtcgaaactcctcactgctcagcgtaagactcggaggcctgtttctacgcgacctggccacagagggaacaatgtttccactgctcgttttccccaacccccagaaggaggtgggcagggtcagccagagcttcggtttgcagaccacttctgctgatcggtcagatcattacccagctgccgatccagatggtcccgtgttcgagatgctgtacgagcgaaaccccgcacattcacactttgagcggaggctgaatgtgtccaccaggccactgaacataatctacaatcctcaggcaatcaaaaaggtggccgatttcttttataaaggaaaagtgcatacttctggatttgggtaccaatccgagttagagctacgcgtggccgaagctgccaggcggcagtataataagctaaagatgcagacaaaagcagaaatccgacagacgttggatcggctgttggttggagacttcatcgaagaatcgaaacggtggaccgtccgcctggacatctccgccccacaggtcatatttcccgacgattttaagttcaagaaccctgttttggtggtcgtggacctgggccgtatgctactgaccaatactcaggacaacagccggcgtaaatcaagggacggaagcgcttccgaggagactcagtttagcgatgatgaatacaaaaccccattggcgacacccccaaacactccaccaccggagagcagttcaagcaatggcgagaaaaccccccctttttctggcgtcgagttcagcgaagagcagcttcaggctcatttgatgtcaactaagatgtacgagcgctacagcctgtcatttatggatcttcaaatcatggtgggccgtgtgaaagataattggaagcatgtccaggacatcgatgtcggtccgacccatgtggtggagaagttcaatgtacacttgcaactggaacgcagattgatctacacaagcgacccaaagtatccaggcgctgtgctttcagggaatctgccagatctcaaaatccacatcaatgaagacaagatttctgccctcaagaactgcttcgccctgttgacaacgcctgaaatgaaaacgtcagacacacaaataaaagagaagatctttccacaggaagaacaaaggggttcattgcaggacagtgtgatgaatctgacgcagagtatcgtgctgttagaacagcacaccagggaagttctggttgaaagtcagctgctgttggctgagtttaaggtgaattgtatgcagctgggggtggagtccaatggaaggtacatttccgtgctgaaagtgtttgggactaacgcccactttgtgaagaggccctacgacgcggaggtttccctgaccgtacacggattgctcttggtagatacaatgcaaacttatggggcagacttcgatctgttgatggcaagccacaagaacctgtcctttgacatccctaccggatccctgcgagatagccgcgctcagagcccagtgagtggacctaatgtggcccatcttaccgatggggctacactgaatgataggtctgccactagcgtgagcctcgataagatcctgaccaaagaacaggagtccttgatcaaactggaatatcagtttgtctcatccgagtgtccgtctatgaacctcgacagtacactccaggtgatttccttacaggtgaataatctggatattatcctgaaccccgaaaccatcgtggagttgataggttttctccagaagtcatttccaaaggagaaggatgatctcagcccacaaccattgatgaccgactttgaacgttcctttagagagcagggcacttaccaaagcacctatgaacagaataccgaggttgctgtagaaatccatcgcctaaacttgctcctactgcgcactgttggcatggccaaccgggagaagtacgggagaaaaatagccaccgcgtctattggcggaaccaaagtgaatgtgtctatggggtcaactttcgatatgaatggcagcctcggctgcctgcagctgatggatctgacgcaggacaacgtgaagaatcaatacgtggtctctataggtaactccgtcggctatgagaacataatctcagacatcggctattttgaaagcgtgtttgtgagaatggaggacgccgctctgaccgaagctctgtccttcactttcgttgagaggtccaaacaggagtgtttcctgaacttgaagatggcatccctgcattacaaccatagcgctaaatttctgaaggagttgactttgagtatggacgaacttgaggaaaactttagaggcatgctgaagagtgcagcgacaaaggtgactacggttttggctacaaagaccgcggagtattctgagatggtcagtctgttcgaaacccctagaaaaacgcgcgagccatttatactggaggaaaacgaaatttacggctttgatctcgcctcttcccatctcgacaccgtgaaactaattttaaacattaatatcgaatctccagtcgttagtatccctaggaagcctggaagccctgaactcctggtcggtcacctgggccaaatcttcatccaaaactttgtcgctggagacgatgagtctaggagtgatagacttcaagtggaaatcaaagacattaagctgtactcccttaattgtactcaactggctggccgagaagccgttggctctgaaggctccagaatgttttgcccccctagtggttcagggagtgcaaacagccaggaagaggctcatttcacaaggcacgacttctttgaatcactgcaccggggacaggcttttcatatcctgaacaacaccaccatacagttcaaactcgagaagataccaatagagcgggagtccgaactgactttcagcctgtcccccgatgacttaggaactagctccataatgaagattgaaggaaaatttgttaacccagtgcaggtggtgcttgcaaagcacgtatacgagcaggtgctgcagacgcttgataatctggtatattctgaagatctaaataagtatcctgcctccgcaacttccagtccttgccctgattctcctctacctccactatccacttgcggggaatcttctgtcgagcggaaggaaaacggactgttcagtcactctagccttagcaacactagtcagaaaagcctgagcgttaaggaagtaaagagctttacccagatccaggccactttttgcatcagtgaattgcaggtgcaactgagcggggaccttacactgggagcgcagggtcttgtgtctctgaagttccaggatttcgaagtggaatttagcaaggatcatcctcagaccctgagtatccagatcgcactgcactctcttctcatggaggacctactggaaaaaaaccctgattccaagtacaagaatctgatggtgtcgcggggagcacctaagccttcatccctggcccaaaaggagtacctatctcagtcatgcccttcagtatccaatgtggagtatccagatatgcctcgctcactgccctcgcacatggaggaagctcctaacgtgttccaactctaccaacggccaacatcagcaagccgtaaaaaacaaaaggaagtccaggataaggactaccctctcacaccgcctccatcacctacagttgatgagcccaaaatccttgtgggaaaaagcaaatttgatgactctctggtgcacataaacatcttcctggttgacaaaaagcaccctgagttcagcagctcctataatagggtgaatcggtcgattgatgtggattttaattgtctcgatgttcttattacgttgcagacatgggtggtaatcctggatttcttcgggatcgggagcaccgctgacaaccacgcaatgcgtttgccccctgaggggattctgcacaatgtgaagcttgaaccacacgcgtctatggaatcgggactgcaagaccccgttaataccaagctcgacctgaaagtgcacagcctgtcactagttttaaacaaaaccacatcagaactggctaaggctaacgtaagcaagttggttgctcaccttgagatgatagaaggcgatctggcgctgcagggaagcatagggtccctgtcgctgagcgatctgacttgccacggcgaattttatagagagcgcttcactacctccggcgaagaggctctgatttttcaaaccttcaaatatggacgcccagatcccttgctgagacgcgaacatgacattcgggtgtcattgcgaatggcttctgtgcaatacgtgcacacacaacgctttcaggctgaggtcgtcgcatttatccaacatttcacgcagctgcaagatgtgctaggcaggcaacgagcggcaatagagggacaaaccgtgcgggaccaggctcaacggtgctctagagtcctgctcgacatagaggctggggcacctgttttattgatccccgagagctctcgctcaaacaacctgatcgtggccaatctggggaagcttaaggtcaagaacaaatttcttttcgcgggatttcccggtaccttctctctgcaagacaaggagagcgtgccctctgcgtcacctacaggcatcccaaagcattccctgaggaagacgacttccaccgaagaacctaggggaacccactcccagggccaattcacgatgccgcttgccggaatgagcctggggagcctgaagagcgaattcgtcccttccactagcactaagcagcaaggcccacagccaactctttcggtaggccaggagtccagtagcccggaggaccacgtctgtcttttggattgcgtcgtggttgacctgcaagacatggatatcttcgccgcagagagacaccctagggaatatagcaaggccccagaagactccagcggcgacctaatctttccctcttactttgtcagacaaacaggtggttccttgctcacggagccctgtcgcctcaaactacaagtggaacgcaacctggacaaagagatttcccacactgtgcccgacatctccattcatggaaatttgtctagcgtccactgttcactggatctgtacaagtacaagctgatcagggggctgctggaaaacaacctcggggaacccatcgaagagttcatgaggccttacgatctccaggatccacgaattcacacagtgcttagcggtgaagtgtatacctgcatgtgctttctgattgatatggtcaacgtgagcctggaactgaaggatcctaagagaaaagaaggggcaggctctctagccaggtttgatttcaagaagtgtaagctgttatacgagagctttagcaatcagactaagtctatcaatctggtaagtcacagtatgatggcgttcgacaccaggtatgccggacaaaaaacgagcccaggtatgacaaacgttttttcatgtattttccagccagcaaagaactcatctacaacacaaggttctatccagatagaactccattttaggagcacaaaggattcgagttgttttactgtagtgctgaacaacctgagagtatttctgatcttcgactggctcctactcgttcacgactttcttcacacgcctagtgacataaagaaacaaaatcacgtcactccctcccgacaccgtaatagctctagtgaatccgcaatcgttcccaaaacagtgaagtcgggcgtggtcaccaaacgttcttccctgcctgtctcaaacgaacggcaccttgaagtcaaggtgaatgtcacaggtactgaattcgtggttattgaagatgtttcatgctttgataccaacgctataattctgaaaggcactaccgtcttgacttacaaaccaaggttcgtggataggccgtttagtggcagcctgtttggaatagaagtcttctcatgtcgcctcggaaacgagcacgataccgctctctccattgtggatcccgtccagatacagatggaactggtcgggaattcctcttatcaaaactctagcggtctgatggatgccttcaacagcgaagacttccctccagtcctggagatccaactgcaggcgttagacataaggctttcttacaacgatgtgcagctgtttctggccatagccaagagtatcccagaacaggctaacgccgctgtcccagactcagtagccctagagagtgattcggtgggcacttacctgcctggcgctagtcgtgtcggtgaagaaattcgagaaggtacacgacacaccttagacccagtgttggagctccaactggccaggctccaagagctgggcttctcaatggacgattgccgtaaggcgcttctggcttgtcagggtcagctgaagaaggccgcttcctggcttttcaaaaatgctgagccgctgaagtccctttcactcgcaagcacaagccgcgattctccaggggctgttgctgcaccactgatttcaggagtggagatcaaggcagagtccgtctgcatttgttttattgacgattgtatggactgcgacgtaccactggctgaactgacattcagcagactgaacttcctccagagggtgcgcacctcaccagagggatatgctcactttactctgtccggcgactattataatagagctctctcgggttgggaaccctttatcgaaccctggccatgtagcgtgtcgtggcagcaacaagctgcctcaagactacatccccctcgcctgaaactggaagccaaggctaagccacggctcgacatcaatataacctccgttttaatcgaccagtatgtgtccactaaggagtcctggatggccgactactgtaaagacgacaaagatatcgagtctgcaaagtccgaggactggatgggtagttccgtggatcccccttgcttcggtcagtctctgcctctggtctatctgagaaccagatcaacagcatccttaacaaatctagaacatcagatctatgcacgagcagaagttaagactcctaaacgacggcagcccttcgtacccttcgcgctgcgtaatcacacaggctgcaccctttggttcgcaactctcacgacaactcctacccgagcagccctctcacactcaggctcaccgggagtggtcccggaaggaaacggaacatttttagatgacacccacaacgtaagcgagtggcgtgaggtgcttaccggtgaggaaataccttttgagttcgaggcgagggggaaactcagacatagacacacacatgacctgaggatccaccaactgcaagttcgcgtgaatggttgggagcaggtctccccagttagtgtcgataaggtgggcaccttttttagatacgcagctcccgataaaaattcttcaagctctaccataggatccccttccagccgcaccaacatcattcatccacaggtctacttcagcagtctacctccagtgagagtggtgttcgctgtgacaatggagggctcagccagaaaagtgattaccgtgcgctctgcactaatagttcgcaaccggttggagacacctatggagttgagacttgattccccgagtgcccctgacaagcctgttgtgctgcctgctattatgcccggtgacagctttgctgttcccctgcacctgaccagctggcggctccaggcaaggcccaagggactgggagtatttttttgtaaggctcccatccactggactaatgttgtgaagaccgctgagatttccagcagcaaacgcgagtgtcactcgatggacacagagaagagtcgcttttttcggttctgcgtggctatcaaaaaggagaattatcccgattacatgccgtcaaatattttcagtgatagtgccaaacaaatattccgccagcccggtcatacgatctatctgctcccaacagtggtgatttgcaacctgctgccttgtgagctcgatttttatgttaagggcatgcccattaacggaaccctaaagccaggcaaggaagcagccctgcatactgcagatacaagtcagaacatcgagttgggggtgtctctcgaaaattttcctttgtgcaaagagctgcttataccacccggtactcaaaactacatggtgagaatgagactgtacgacgtgaatcgcaggcagctcaacctgacaattcgcattgtttgcagagctgaaggatccctgaaaattttcattagcgctccctattggttaattaataagaccgggttgccactcatttttaggcaggacaacgccaaaaccgatgccgctggccaatttgaagagcacgagctggccaggtcactttcacctctcctcttttgttacgccgataaggaacagcccaatttgtgcaccatgagaattggtagaggcattcacccagagggaatgccaggatggtgccaggggttttcgttggatgggggatcaggagtgagggccctcaaagtcatccagcagggaaaccggcctggtttgatttataacattggaatcgacgtgaagaagggtcggggtcgatacatcgatacatgcatggtaatctttgcacccagatatctattggacaataaatcgagtcataaactcgcttttgctcagagagagtttgcgagaggacaaggtaccgccaaccccgagggctatatatctacattacccggttcctccgtcgtgttccactggccaaggaacgactatgaccaactgctctgcgttagactcatggacgtgccaaactgtatttggtcaggaggatttgaagtgaacaagaataactcttttcacattaatatgcgggacacactaggaaagtgctttttcctgcgtgtagagatcactttaaggggggctacatacagaatctctttctcggatacggatcaactccctcctcctttcaggatagacaacttttctaaggttcccgttgtgttcacccagcacggggtggctgagccaaggctccgcaccgaagtgaagcctatgacatcactcgactatgcctgggatgaaccgaccctccccccatttatcacacttacagtgaaaggcgctggatcttctgaaattaactgcaacatgaacgattttcaggataacaggcaactctactatgagaattttatttatatcgccgctacttatactttcagcggactacaggaaggaaccggacggccagtagcgtctaacaaagcgatcacttgtgctgagttggtgcttgatgtaagcccgaagacccagcgtgttatccttaagaaaaaggagcctggaaagcggtcccagttgtggcggatgactggtacagggatgctggcacacgaaggttcgagcgttccacacaacccgaacaagccctctgctgctcgcagcacggaaggcagcgctatcctggacatcgccggactggccgctgttactgacaacagatacgaaccactaatgctgagaaagccagaccgccgaagaagcaccacccagacttggtcatttagggaaggaaagctaacgtgtggcctgcatggccttgtggtgcaggcaaagggaggcctcagtgggctgtttgacggcgctgaggtggtacttggacctgacacctctatggagctgttggggcctgttccaccggagcaacaatttataaaccagaaaatgagaccaggtagcggtatgctgtccattcgagtaatcccagacggccctacacgcgctctgcagataactgatttttgtcacagaaagtcctcccgtagttacgaggtcgacgagctcccagtgaccgagcaggaattgcagaaactgaagaacccagataccgagcaggagctggaagtcttggtgcgactggaagggggtattgggctgagtctgatcaacaaagtgcctgaagagctcgtgttcgctagtctcactggaataaacgtgcactacacccagctagctacttctcacatgctcgagctctccatacaggacgttcaagtggataatcagcttataggaacaacacagccattcatgctatatgttactccactgtccaacgagaatgaggtaattgaaacaggaccggcagtccaggtcaatgcggtgaagttcccttccaagtctgctctgactaatatatacaaacacctgatgatcacagctcagcgcttcactgtgcaaatagaggagaaactgctgctcaaactgctgtcatttttcggatatgaccaagctgagtccgaagtggaaaagtacgatgagaatctacatgagaaaacagccgaacagggaggcacaccgattaggtactattttgagaacctgaagattagtattccacagataaagctatccgtgtttacatccaataagctccctctggaccttaaggccctcaaatccacgcttggcttccccctcataaggttcgaggacgcagtgataaacttagacccttttactagagttcacccgtacgaaaccaaggagttcatcattaatgacattctgaaacactttcaggaagagctgctgagtcaagccgctaggatcctagggtcggtggactttctcgggaacccaatgggcttattaaatgatgtgtccgaaggtgtgaccggcctcattaagtatggcaacgttgggggactgatccgcaacgttacacacggcgtgtcaaactccgctgccaagttcgccggaacactaagcgacggccttgggaagaccatggacaatcgccaccagtcagagcgggagtacataagatatcatgccgctacttctggcgagcacttggtcgctgggattcatgggctcgcacacggtattattggtggcttaacgagtgtcatcacatcgaccgtggaaggagttaagacagagggcggtgtgtcaggctttatttccggcctgggcaaaggcctggttgggacagtgacaaagcccgtggcaggggcactcgacttcgccagtgagacagcgcaagccgtccgggacaccgctaccctcagcggcccacgtactcaagcccaacgtgttaggaaaccaaggtgctgtaccgggcctcaggggctcctccccaggtattccgaatcacaagctgagggacaggagcagctctttaagctgacagataacatccaagatgagttttttatcgcagtggaaaatatcgactcctactgtgtcctgatctcttctaaggccgtgtacttcctaaagtctggggactatgtagatcgcgaggcaattttcctcgaagtaaagtatgatgacctataccattgtttagttagcaaggatcatggcaaggtgtatgtccaggtgacaaagaaagccgtctctacctcttctggggtctccattcctggcccttcacaccagaagccaatggtacatgtgaaatccgaggttctggcggtgaaactgtcacaggagatcaactatgccaagagtttgtattacgaacagcagctgatgctgaggctaagtgaaaatcgggagcagctggagctcgacagctac

SEQ ID NO: 60992 - DNA, 579 bp, Artificial Sequence
  Description of Artificial Sequence: Synthetic coding sequence
atgctgcttgaggaaaccgggctgacaccacaggagacctgtttaagccctcggaggcctcatcgttggcaaagaacccaagcacagagggtgagaaagcccagatgctgtacgggtccgcaggggctcctcccacgctacagcgaaagccaagccgagggccaggaacaattgttcaaactgaccgacaatatacaggacgagttctttattgctgtcgaaaatatcgattcctactgtgtgttaatctcgtccaaggccgtctacttcctgaaatcgggagactacgtggaccgggaagcaatctttctggaggtcaagtatgacgatctctaccattgtctggtaagcaaagaccacggaaaagtttacgttcaagtgactaaaaaggccgtgtctaccagctctggcgtatctattccaggaccttcccatcagaagcctatggtccacgtaaaaagcgaagtactggcagtcaagctgtcccaggagattaattacgctaagtctctgtactatgagcagcagcttatgcttcgactgtcggagaaccgagagcagctggaattagactcatag

SEQ ID NO: 60993 - DNA, 1161 bp, Artificial Sequence
  Description of Artificial Sequence: Synthetic coding sequence
atgcgcggagagaagctgtctaaggcacttaagtccacactgggctttcctctcattcgatttgaagatgctgtgattaatcttgatccattcacccgtgtgcacccatatgaaactaaagaatttataataaatgacattctgaagcactttcaggaagaactgctttcacaggctgcacggatcctaggatccgtagatttcctgggaaatcctatgggcctgttgaatgacgtgagcgaaggggtgacaggactgattaagtacggaaacgttggcggactgattaggaatgttacacatggagtgagcaactccgccgctaaattcgccggaaccctctccgacgggctcggtaagactatggacaatcgacaccagtctgagagagaatatatccgttaccatgccgctaccagcggcgagcatcttgtcgccggaattcacggcctcgcacacggaatcatcggcggacttacctcggtgataacttctactgttgagggggttaagaccgaaggaggggtcagtggctttatctctgggctaggcaagggccttgtgggtacagtgaccaaaccagtggccggtgccctggactttgcttccgagaccgcccaggctgtaagagacactgcgaccttatctggtccaagaacgcaggctcagcgtgttaggaagcccaggtgctgcaccggaccccaggggctgcttccccgatactcagaatctcaagctgaaggacaggagcaactttttaaactaaccgataatatacaggacgagttctttattgccgtcgagaacattgatagctactgcgtgctgatcagctcaaaagctgtgtactttctcaagtccggggactacgtggacagagaagccatctttctggaggtcaaatacgatgatctgtatcactgcctggttagcaaagaccacgggaaagtgtatgtgcaggtcaccaagaaagcagttagcacgtcttccggggttagcatccctggacctagccatcagaaaccaatggtgcatgtcaaatcagaggtgctggcagtgaaactaagtcaagagataaactatgctaaaagcctttactatgagcagcaactaatgctcaggttgtctgagaaccgtgagcagcttgagctggactcatag

SEQ ID NO: 60994 - DNA, 378 bp, Artificial Sequence
  Description of Artificial Sequence: Synthetic coding sequence
gagttcattgaagagcttttgagccctcccttcgggggattagtagccttcgtaaaagaagccgaggcgctgatcgagcgcggtcaggcagagcgcttgaggggggaggaggccagggttacccagctcattcgtggattcgggtctagttggaaatcatcggttgaatctctctcgcaggacgtcatgcgatcttttaccaacttccgcaacggcacgtctatcatccagggtgccctaacacaactgatacagttgtatcacaggtttcatcgagttctttcgcagcctcagctccgagccctgccggctcgagctgagctgataaatatccatcacctcatggtcgaactgaagaaacataaaccaaatttctag

SEQ ID NO: 60995 - DNA, 378 bp, Artificial Sequence
  Description of Artificial Sequence: Synthetic coding sequence
gaattcatcgaggagctgttatcacccccttttggcggtctagtggccttcgtcaaggaggctgaagccctgattgaacgagggcaagcggagcggttacggggtgaggaagcgcgagtaacacaactgatcagaggtttcggcagttcctggaagtcttccgtggagtctctgagccaggatgtcatgagaagctttacaaattttagaaacggcacctccatcatacaaggagcccttacacagctgatccagctgtaccataggttccaccgggtcctttcccaaccgcagctacgtgcactgccagcccgagcagagctgatcaacatccatcacctgatggtcgaacttaaaaaacacaagccaaatttctag

SEQ ID NO: 60996 - DNA, 1797 bp, Artificial Sequence
  Description of Artificial Sequence: Synthetic coding sequence
atggagcaaatgctgggagccttccaatccgatctgagttccatttctagtgagattcggaccttgcaagagcagtcaggcgcaatgaatatccgtctgagaaaccgacaggcggtcaggggcaagctgggagagctcgtcgacggtctagttgtgcctagcgcactggtgactgctatcctggaggctcctgtgaccgagccgagattcttggagcaattgcaggagctggatgcaaaagctgccgcagtgagggagcaggaggcacgcggtactgccgcatgtgctgatgtccgaggagttctcgacaggctcagagtgaaagccgtgaccaaaatcagagagttcattctgcagaaaatctactcttttcgaaagcctatgactaactatcagattcctcaaaccgcactcctgaaataccggttcttttaccagttcctgctgggaaacgagagagcgactgccaaggagatccgggatgagtacgtggagaccctatcaaagatctatctgtcctattaccgctcatatctaggacggctcatgaaagtgcagtacgaggaagtggctgagaaggatgacctgatgggggtggaggatactgcgaagaaggggtttttttctaaaccaagtctgcgtagccggaacacgatctttaccctgggaactaggggtagcgtgattagtcctactgagctagaggcccctatcttagtgccccataccgcccaacgaggagagcagcggtatccatttgaggctctgttccgatctcagcactatgccctgctcgataatagttgcagagagtacttgttcatctgcgaattctttgtggtctctggaccggctgcacatgacttgttccacgccgttatgggtcggactctatccatgaccttgaagcacctggattcctacttggcagactgttacgacgctatcgcagtcttcttgtgtatccacatcgtcttaaggttccggaacatagcagccaaacgagatgtgccggctctggacaggtactgggagcaggtgctcgctctcctgtggcctaggtttgagctgatcctggagatgaatgtgcagtcagtgaggtccacggacccccagcgcctgggcggacttgacacacggccacattacatcaccagaagatacgccgaattctcttccgccctggtgagcatcaatcaaaccattccgaatgaaaggaccatgcagttgcttggtcagttacaggtggaagtagagaactttgtactgagggttgccgctgagttcagttcgagaaaggaacagctggtgttcttgattaacaactacgatatgatgctcggcgtgctgatggagagagccgctgacgacagtaaagaggtggaatcttttcagcagctgctgaatgctagaacgcaggagtttattgaagaacttctgtcccctccgttcggtggactggtcgcattcgtcaaggaggctgaagctctcatcgagagaggtcaagctgagcgcctgagaggcgaggaagccagagtgacacagctaatcaggggattcggatcatcatggaaaagctcggtggaaagcctgtctcaagacgtgatgagaagtttcactaactttcgcaatgggacctccatcattcagggagccttaacacaactcatacaattgtaccaccggttccatagggtcctgtcccaaccacagctccgtgccctacctgcccgagcggagctgatcaatattcatcacctcatggtcgaactgaaaaaacataaaccaaacttttag

SEQ ID NO: 60997 - DNA, 1797 bp, Artificial Sequence
  Description of Artificial Sequence: Synthetic coding sequence
atggaacagatgctgggggctttccagtccgatttgagttctatcagcagcgaaatccgaaccttacaggagcaatccggtgccatgaacatcaggcttcggaatcggcaggctgtgcgcggaaagctgggtgagctcgtggatgggttggtcgtgcctagcgcactcgtcaccgcaatactcgaggcccctgtcactgagcctagatttctcgagcagcttcaggagttggatgctaaagccgctgccgtgagagaacaagaggcccgaggcactgctgcttgcgctgacgtgagaggggtgttggataggctccgagtcaaagccgttaccaaaatccgggagtttattctgcagaagatatacagctttcgaaagcccatgaccaactatcagattccccaaacagcactgctgaaatacaggttcttctatcagtttctactcggcaacgagcgagctaccgcaaaagaaatccgtgacgaatatgtagaaaccctgtcaaagatttacctctcttactacagaagctatctcggcagactcatgaaggtacagtacgaagaggtggctgagaaagatgatttgatgggcgtcgaagacacagccaagaaaggtttcttctctaaaccctctctgcggtctagaaacaccattttcaccctgggaaccagaggatccgtgattagtcctacagagctggaggcaccaattctggtgcctcacaccgcgcagcggggtgaacaacggtacccgttcgaagccctcttccgttctcaacactacgccctattggacaatagctgcagagaatacctgtttatctgcgaattttttgtggtgagcgggccagctgcccatgatctctttcacgccgttatggggcgaacactttcaatgacactcaaacatcttgattcctacctcgctgattgttatgacgctatcgcagtcttcctttgcatccacattgttttgcggttccggaatatagcagcaaaaagggatgttccagccctcgaccgatattgggagcaggtgctagccttgctatggcccaggtttgagttgatactggagatgaacgtccagtcggtgaggtctaccgacccccagaggctcggaggactggatacaagaccacattatatcacccgcagatacgcagagttctcgagtgctctggtgtccatcaatcagactatccccaatgagagaacaatgcaattactcggccagcttcaggtcgaagttgagaacttcgttttacgagttgccgctgagttttcaagtcgaaaggagcagttggtgtttctgatcaataactacgatatgatgctcggagtgctcatggagagggccgcagatgatagcaaggaggtagaatcttttcagcagttattgaatgctcgaactcaggaatttattgaggagctcctttctcccccttttggaggcttggtcgcgttcgtgaaggaagctgaggccttgattgagagaggccaggcagaaagattaaggggtgaagaggccagagtgactcagcttataaggggcttcgggtcaagttggaagagctctgtggagtccctttcacaggatgtgatgcgatcatttactaacttccgaaatggtacatctattatccagggcgctctgactcagctcattcagttgtaccatcgttttcacagagtactgagccagccccagctgcgagctcttcctgccagagccgaactgatcaacattcatcacctgatggtggagttaaagaaacataaacctaacttttag

SEQ ID NO: 60998 - DNA, 2106 bp, Artificial Sequence
  Description of Artificial Sequence: Synthetic coding sequence
atggaagaagaggaaggaccactggctggagggcctggtctgcaggaacctctccagctcggggaactagatatcacatctgacgagtttatcttggacgaggtagatgtgcatatacaggcaaatctggaagatgaactcgtgaaagaagcactcaagacgggggtggacctgcgacattactccaaacaggtggaattggaactgcagcagatagagcagaaatcgattagagactatatccaggagagcgagaacatcgcttccttgcataaccagatcacggcctgcgacgccgtcctggaacgaatggaacagatgctgggcgctttccaaagtgacctgtctagcatttcttcagagatacggacacttcaggaacagtctggcgcaatgaacatccggttgcgaaatcggcaggcagtgcgcggtaaactcggtgagctcgtcgacggcctggtcgtgccatctgcgcttgtgaccgctattttagaggccccagtgacggagcctcgcttcctggagcagctgcaggagctcgacgccaaagccgcagctgttagggaacaggaggccaggggcacggcagcatgtgccgacgtccggggtgtgttggatagactgcgcgtaaaggccgtgacaaagattcgcgagttcatcttgcagaaaatatactcattccgcaaacctatgaccaattaccagatcccccagaccgctcttctaaaatacaggttcttttaccagtttttgttgggcaacgaacgcgctacagccaaggaaattagagatgagtatgtggaaaccctctctaaaatctatttgtcctactacagaagttacctggggaggctgatgaaggtacagtacgaggaagttgccgaaaaagatgacctgatgggagtcgaagacaccgccaagaagggatttttcagcaagccatctctgcgtagccggaatacaatttttacactgggcactcgcggtagtgttatctctcccacagagttagaggcccctatccttgtccctcacactgcacagcgcggagagcagagatacccctttgaggcactattcaggtcacaacattacgctctgctggataattcatgccgagaatacctcttcatttgtgagttttttgtagtttctggacctgcagctcacgacctgtttcatgccgtgatggggcgtaccctgtccatgactttaaagcacctggactcatacctggctgactgttatgacgccatcgctgtcttcctgtgcatccatattgtattgcggtttagaaacattgcagctaagagagatgtccctgcactcgataggtattgggaacaagtcttggctctgctgtggccaagattcgagctgatcttagagatgaacgtgcagagcgtccggtcaaccgatccgcaacggctgggcggactcgacacacgtccacattatatcacaaggcgttacgctgagttttcaagcgcccttgtatcgattaaccagaccatacccaatgagcggacaatgcaacttctgggacaactccaagtggaagtggagaatttcgtgctccgggtggcggctgaattttcgtctcgtaaggaacaacttgtatttcttatcaacaactatgacatgatgcttggagtgctaatggaaagagcagctgacgatagtaaagaagtcgagagctttcaacagctcctgaatgcgagaacccaggagttcattgaggagttgttgagcccacctttcggtggcctggtggcattcgttaaagaggccgaggctttaattgagagggggcaggccgaacgccttagaggagaagaggctcgcgtcactcagctgattaggggttttgggagtagctggaaatcgtctgtggaatccctgtctcaggacgtgatgagatctttcacaaacttcagaaatggcacctctatcattcagggggctctgacccaactaattcaactgtaccaccgcttccaccgggtcctgtcacagccgcagctcagagctctcccggcacgagcggagttgatcaatattcaccatttgatggtggaactgaagaaacataagcccaacttctag

SEQ ID NO: 60999 - DNA, 2106 bp, Artificial Sequence
  Description of Artificial Sequence: Synthetic coding sequence
atggaggaagaagaaggacctttagcgggaggacctggtctacaggagccgttacaattaggagagctggatattacctcagacgaattcattctcgacgaggttgacgttcacattcaagccaacttggaagatgagctcgtgaaggaggccctgaaaaccggggtcgatctgcgtcactattcaaaacaagtggagttagaattacagcagatcgagcagaagtctattcgcgattacatccaggagtccgaaaatatcgcctccctgcataatcagataacagcatgcgatgccgtgcttgaacgcatggaacaaatgttgggggcatttcagtctgacctgtcctccattagctcagaaattagaactctgcaggaacagtccggcgctatgaacattaggttacggaacaggcaggctgtgcggggtaaacttggcgagttagtcgatgggcttgtggtgccttctgcactcgtgaccgccatcttagaggccccagttactgagcccaggttcctggagcagctgcaggagttagacgccaaagctgccgctgtgcgggaacaggaggccaggggcaccgctgcctgcgctgatgtgaggggtgtcctcgaccggctcagggtgaaggctgtcaccaagatcagggaatttatcctgcagaaaatctacagcttcagaaaacctatgaccaactatcaaatcccccaaactgccctgcttaagtatcgctttttctaccaatttttattgggcaacgagcgcgctaccgcgaaagagatccgcgacgaatatgtcgagaccctgtcaaagatttatctaagctactatcgcagctaccttgggcgtctcatgaaagttcagtacgaagaagtcgcagaaaaagacgacctgatgggggtggaagatacagctaaaaagggcttttttagcaaaccaagtctgcgctctaggaacactatcttcacattgggtacgcgcggatcggtcattagccctactgaattggaagccccaattctggtgcctcacaccgctcagagaggggaacagagatacccatttgaggcgttgtttcgttcacagcattacgctttgcttgataactcatgccgcgagtatctgttcatctgcgaattttttgtggtttcaggtcctgccgcacatgatctgtttcacgccgtcatgggcagaactctgagcatgaccctgaagcacctcgattcctatctggctgactgctacgacgctattgcagttttcctttgcatccacattgtgcttagattcaggaacatcgcagccaagagggatgttcccgcactggacaggtactgggagcaagtcctggccttgctctggccacgcttcgagctgatactggagatgaatgtccaaagtgtccgcagtaccgacccacagcgactcgggggtctggacacacggcctcactatatcactagaagatacgccgagttcagctccgctcttgtctctataaatcagaccatccctaatgagcgaactatgcaacttcttggccaattgcaggttgaagtggagaattttgtcctgcgggtagctgccgagttttctagccgtaaagagcagcttgtgtttctgatcaataattacgatatgatgttaggcgtcctgatggaacgggcagccgatgactctaaagaagttgaaagcttccagcaactcctgaatgccaggacccaggagttcatcgaagagctgctctctcctcctttcggaggccttgtcgccttcgtgaaggaggccgaagccttgatagagagaggacaggcagaaaggctccggggtgaggaagcccgagttacacagttaatccgtggttttgggagcagctggaaatcctctgtggagagcctgagccaggacgtcatgagatccttcacgaactttcgcaacgggaccagtattatacagggggcactcactcagctcatccagctttatcacagatttcaccgtgtgctctcgcaaccacaactcagggccctgcctgcgagggcagaactcattaacatacaccaccttatggtggaactgaagaagcataagcccaacttctag

SEQ ID NO: 61000 - DNA, 1797 bp, Artificial Sequence
  Description of Artificial Sequence: Synthetic coding sequence
atggaacagatgctgggagcctttcagtcagacctgagcagcataagcagcgaaatccgtacactccaggagcagtcaggtgccatgaatattagactccggaacagacaagccgttagaggaaaactgggagaacttgtcgacggactcgtggtgcccagcgccctggtaacagctattctggaagcgccagtgactgagccgcgttttctggagcagctgcaggagctcgatgcgaaggcagccgcagtgcgtgagcaagaggccagggggaccgccgcatgcgcagacgtgagaggcgttcttgaccgtctccgagtgaaggccgtgactaagattagagaatttatattacagaagatctactccttccggaaacccatgactaactaccagatcccacaaacagcattgttgaaatacagattcttctaccagtttcttttggggaatgaacgggcaacagccaaggagatccgagacgagtacgtggagacactgtctaaaatctacctatcatattaccgctcctatctggggcgactgatgaaagtccagtacgaggaggtggctgagaaggatgacctcatgggggtcgaagacacggccaagaaaggcttctttagcaagccttcactaagatccaggaataccatttttaccctcgggacgcgaggatcagttattagccccaccgagctggaggccccaattctcgtgcctcacacagcccagcgcggagagcagagatacccgttcgaggcccttttcagaagtcagcattatgccctgctggacaattcttgtagagagtatctcttcatttgtgaattctttgtggtgagtggccctgctgcccacgatctcttccacgcagttatgggccgaactttatcaatgactctcaagcatctggattcatatttagctgattgttatgacgccattgctgtatttctgtgtattcatatcgtccttcgctttagaaatatcgccgcaaagagagatgtgcctgctcttgataggtattgggagcaggttctggccttgctgtggcctcggttcgagttaatcttggaaatgaatgtgcaaagcgtgcgcagcaccgatccacagaggctagggggactagacacaaggccccactacattacccggaggtatgcagaattctcctccgctttggtgtctattaaccaaactatcccaaacgagaggaccatgcaacttttaggacagcttcaggtggaagtcgagaatttcgtgctcagagtcgcagccgagttttctagccggaaagagcagcttgtgtttttaatcaataactacgacatgatgctcggggtgctgatggaaagggctgctgacgattctaaggaggtggagtctttccagcagcttcttaatgccaggacccaggaattcatagaggagctcctctccccaccattcggcggactcgtcgcattcgtaaaagaggccgaggccctcatagagcgcggtcaggcagaaaggctcaggggggaagaagcacgggttacacagctgatacgaggttttgggagcagctggaagtcctcggtggaatctctcagccaggatgtgatgagaagctttaccaacttcaggaatgggacaagcattatccagggcgctctcacccaactcatccagttatatcacagattccatcgagttttgtctcagcctcagctccgggcacttcccgcacgggcagaactgataaatatccatcatctgatggtggaactcaagaaacataagccaaacttctag

SEQ ID NO: 61001 - DNA, 2106 bp, Artificial Sequence
  Description of Artificial Sequence: Synthetic coding sequence
atggaagaagaggagggtcccctggcgggaggacctggtctccaggaacccttgcagctcggtgaactggacatcacttcagacgaattcatcctcgatgaggtggatgttcatatccaggctaatctcgaggacgagctggtcaaggaagccctcaagaccggagtggatctgagacactattccaagcaggttgaattggagcttcagcaaatagaacagaaatcaatccgagattacatacaagagtccgagaacatcgcgagcctgcataaccagattaccgcttgcgacgctgtgctcgagagaatggaacagatgcttggcgcatttcaatccgatctgagttcaatctcatccgaaatcagaacactgcaggaacagtcaggggcaatgaatatccgcttgaggaaccggcaggcggtgagaggaaagctgggcgagctggttgatggattagtcgtgccatctgccctcgtgacagccatcttggaggcccctgtcaccgaacccagattcctggagcagctgcaagagctggatgctaaagctgccgcagtgagggaacaagaggccagaggaactgctgcctgcgcggacgtacgaggagtcctcgacagactcagagtgaaagccgtgacgaaaattcgcgaattcattctgcagaagatatatagcttccggaaacccatgaccaattaccagatcccacagacggcactgctgaagtacagatttttttaccagttcctcctcgggaatgaacgggctacagccaaggaaatccgagatgaatacgtcgaaactctcagcaaaatttatctgagttattacagaagctatctgggcaggctgatgaaggtccaatacgaggaagtagctgaaaaagacgacctgatgggggttgaagatactgcaaaaaagggctttttttcgaagccaagtctgagatcacgcaataccatctttacgttgggtacgcgcggatcggtcatcagccctaccgagctggaggctcctatactagtcccgcacactgcccagcgaggagaacagagatatccgttcgaggcactgttcaggagccagcactatgccttgctagataactcttgcagagaataccttttcatctgtgaatttttcgtcgtctcaggcccagcagcacacgatctgttccatgcagtcatgggcaggacgctctccatgacgctgaaacacctggatagctatctggctgactgctacgacgcgatcgccgtctttctgtgcatccatatagtccttaggttcagaaatattgctgctaagcgggacgtgccagcgttagaccgatactgggagcaggtgttggccctgctgtggcccagattcgagctgatcctcgaaatgaatgtgcaatcagtccgttcaactgatccgcagagacttgggggtctggatacacgtccacattatattacacgacggtatgctgagttcagctccgccttggtttcaattaaccagacaatcccaaatgagaggaccatgcagctgcttggccagctgcaggttgaggttgagaatttcgtcctgagggtcgccgcagaattctcatcacggaaggagcagctggtgtttctaatcaacaattatgacatgatgctgggcgtgctcatggagagagctgccgacgacagtaaagaagtcgaatcttttcaacagctgctgaacgctcgcacgcaggaatttattgaggagctgctctctcccccttttggcggattggtagccttcgtcaaagaggccgaagccctgatcgaacggggacaggcggagcgcttaaggggggaggaggctagagtcactcagcttattcggggatttggatctagttggaaatcctctgtggaaagtctctctcaggatgtaatgcgcagctttacaaacttcagaaacggaacgagcataatccagggagcactgacccaattaatacagttataccaccgtttccaccgcgtgttatcacagcctcagctgcgcgcactgcctgccagggccgagctcataaatatccatcatctcatggtcgagttgaagaaacacaaaccaaatttctag

SEQ ID NO: 61002 - DNA, 2013 bp, Artificial Sequence
  Description of Artificial Sequence: Synthetic coding sequence
atgatggaggaggaagaactcgaattcgtagaagagttagaggcagtcctgcagctgaccccagaggtacagctggcgattgagcaggtctttccttcccaagatcccctggatcgcgctgactttaatgcggtggagtacatcaacactctgtttccaacagagcagtcgctggcgaatattgatgaagtcgttaacaagatcagactgaagatacgaaggctggatgataatatacgaacagtcgtacggggtcagacgaatgtgggacaagatgggagacaggtgaaagagattacgcgagacataaagcagttggatcacgccaagcgccatctcaccacctctatcactaccctgaaccatctgcatatgctcgcgggtggcgtcgattcgctcgaggccatgacccgcaggcgtcagtatggcgaggtggctaaccttcttcaaggggtaatgaatgtgctggaacatttccataaatacatggggattcctcagatcaggcagctgtccgagcgggtgaaggctgcccaaactgagttgggacagcagatattggcagattttgaagaggcgtttccctcccagggaacaaaaagaccaggagggccttccaacgtcctccgggacgcctgcctcgtcgctaacatcctggacccgagaattaaacaagaaatcatcaaaaaatttatcaagcagcatcttagcgaatatctggtgcttttccaggaaaaccaggatgttgcttggctggacaagatagaccgaaggtatgcctggatcaagcgccagttagtggactacgaggagaagtacggtaggatgttccctagagagtggtgcatggccgaacgcatcgccgtggagttttgtcacgtcacccgcgctgaactggcaaagatcatgaggacacgtgcaaaggagatcgaagtcaagctcctgctgtttgccatccagcgcaccacaaacttcgagggctttttagctaaaaggtttagcggctgtacacttaccgacggaactctgaagaaacttgagtcccccccaccatctactaaccccttccttgaagacgagccaacccccgagatggaagagttggccaccgagaaaggagatctggatcagcctaagaagcccaaggctccagacaacccgttccatggaattgtcagtaaatgcttcgagccacacctgtatgtgtacatcgaatcccaggacaagaatcttggagagctgatcgaccgctttgtggccgactttaaggcccaagggcctccgaagccaaacaccgatgaaggcggtgccgtcctgccgtcctgcgcagatctattcgtttattacaaaaagtgcatggtccagtgcagtcagctgtccaccggggagccaatgatcgccctgactactatattccagaagtatctgagggaatacgcatggaaaatcctaagtggtaacctccccaaaacaaccactagcagcggaggtctgacgatctccagcctgttgaaggaaaaagaggggtcagaggtggcgaaattcacgttagaggagctctgcctcatctgcaacatcctttcaacagccgagtactgtctcgctacgacacagcagctcgaggagaagctcaaggagaaagtcgatgtttcattgatagaacggattaacctaaccggcgagatggacacattttccacagttatttcttcctcaatacaactgctggttcaggacttggacgcagcatgtgatcccgctcttactgccatgtccaagatgcaatggcaaaatgtggagcacgtgggcgaccaatccccctacgtaacaagcgtaatccttcatatcaagcaaaatgtacccataatcagggataatttggcttccactcgcaagtattttacccagttctgcgtgaaattcgctaacagttttatacctaagtttatcacacacctgttcaagtgcaagccaatatctatggttggtgccgaacaggtgcgctggacttag

SEQ ID NO: 61003 - DNA, 1644 bp, Artificial Sequence
  Description of Artificial Sequence: Synthetic coding sequence
atgatggaggaggaggaactagaatttgtagaagagctagaagcggtactgcaattgacacccgaggtgcagttagccatagagcaagtttttccctctcaggaccccctggaccgggctgacttcaacgcagtcgaatacatcaacacactgtttcctaccgaacagtctctcgctaatatcgacgaggtcgtcaacaaaattcgcttaaaaatccgacggctggatgacaatatcagaaccgtggtccggggacagaccaatgttggacaggatggtcggcaagctctcgaggaagcgcaaaaagctatccagcagctttttggcaagataaaggatatcaaggataaggcagagaaaagcgagcagatggttaaggagattacacgcgacatcaaacagctggatcacgccaaaagacatttgacgacctctattacaacgctgaatcatcttcacatgttggccggtggagtggacagtttggaagccatgactcgcaggcgacaatacggtgaagttgccaatttgttacagggcgtgatgaatgtgctggaacacttccacaagtacatggggatcccccaaatcaggcagctgagtgaacgggttaaagccgctcaaacagaattaggccagcagatcctcgcagatttcgaagaagcttttccgagccaaggtacaaaagtggcctggctggacaaaatcgaccgccgttacgcttggatcaaaaggcaactcgtggactatgaagaaaagtatggccgtatgttccctcgtgaatggtgcatggcagaaagaatcgcagtggaattctgccacgtaacccgggcagagcttgcaaagataatgaggacccgtgccaaagaaatcgaagtgaaattgctgctcttcgccatccaaagaactacaaacttcgaaggctttctcgcaaagaggtttagcggatgcaccctgaccgacgggacattgaagaagctggagagcccgcctcctagtaccaatccttttttagaggatgagccaactcctgagatggaggaacttgctactgagaaaggagacctggaccagcctaagaagccgaaggcgcctgacaacccatttcacggaatcgtgagtaagtgcttcgaaccacatctttatgtgtatatcgagagtcaggacaagaatttgggtgaacttatcgaccggttcgtggccgacttcaaagctcagggaccgcctaaacctaataccgatgagggaggcgcagtcttaccatcatgcgcggacttgttcgtctattacaagaaatgtatggtccagtgcagccaactgtccaccggggagccaatgattgcgttaactacgatattccagaagtacctccgggagtacgcttggaagatattgagtggcaatttgccaaagacaactacatctagcggtggcctgaccatctccagcctactgaaggagaaggagggctccgaggtagctaaatttaccttggaggagctgtgtctgatttgtaacatattatcgaccgccgaatactgtttggcgactactcagcaacttgaagagaagttaaaggaaaaggtggataggcacttacagcagtactcagccgcaggaagcgggagtggttgctgcctctag

SEQ ID NO: 61004 - DNA, 1269 bp, Artificial Sequence
  Description of Artificial Sequence: Synthetic coding sequence
atgatggaagaagaagaactagaattcgtggaagagctggaagcagtgctgcagctcacgccagaagtgcagctggccatcgagcaggtgttcccttcacaggaccctctggatagagctgatttcaacgccgtcgagtatattaatacgcttttccctacagagcagtccctcgccaacattgatgaagtggtcaacaagatcagattaaaaatccggagacttgacgataatattagaaccgtggtcaggggacaaactaatgtggggcaggatggcagacagaaaaagttggagagcccgcctccgagtacaaaccccttcctggaagacgagccaacccccgagatggaagaactggcgacagaaaagggtgacctggatcagccaaagaaacctaaggcacccgataacccattccatgggatcgtgagcaagtgcttcgaaccacacctgtacgtttacattgagagtcaggacaaaaacctaggtgaattgatcgatagatttgtcgctgatttcaaggcccagggacccccaaagccaaacacagatgagggaggagccgtgctccccagctgtgctgacctgttcgtgtattataagaaatgcatggtccagtgctcacagctgtcgacaggagaaccgatgatcgccttaaccacgatctttcagaaatacctgcgggaatatgcttggaagattttaagcgggaacctcccgaagaccaccacgtccagcgggggactgaccataagctcattgctgaaggagaaggagggttcagaggtggccaagtttacgcttgaggagctctgtttaatttgtaacattctcagcaccgctgaatactgtctggctactacacaacaactggaggaaaaactcaaagagaaagtggatgtttcactgattgaacgaatcaatctaacaggggagatggatactttcagcacagtgatttcttctagtattcagttgcttgtgcaggacttagatgcggcttgtgatccggcactcacagccatgagtaaaatgcagtggcagaatgtggaacatgttggcgaccagtctccatatgtgaccagtgtcatcctccacatcaagcagaacgtgccaatcatcagagacaatctagcaagcacgagaaaatacttcactcaattctgtgttaagtttgctaacagctttattcctaagtttatcactcacttatttaagtgcaaaccaattagtatggtaggagcagagcaggtgagatggacgtag

SEQ ID NO: 61005 - DNA, 2499 bp, Artificial Sequence
  Description of Artificial Sequence: Synthetic coding sequence
atgatggaggaggaggaactggaattcgtggaggagcttgaggccgtccttcaactgactcccgaagtccaattggccattgagcaagtatttccatcccaagaccctttggacagggccgacttcaacgcagtggagtatatcaacaccttgtttccgacggagcagtcgttggccaacatagacgaggtcgtcaacaaaatcagactgaagatcagacgactggacgataacataaggaccgtcgttagggggcagacgaacgtgggacaggatgggcgacaggccctcgaggaagcacaaaaggccattcagcagctgttcggaaaaatcaaagacataaaggataaggccgaaaaatccgaacagatggttaaggaaattacccgggacatcaaacaactggatcatgccaagagacacctcaccaccagtataaccaccctcaaccatctacatatgttagcgggaggcgtggactcactcgaagctatgacccgccgtaggcaatatggtgaggtggctaatctattacagggcgtgatgaatgtcctggagcacttccataaatatatgggcatccctcagattagacagctgagcgagagggtgaaagccgctcagactgaactcggtcagcagatcttggccgattttgaagaggcattcccctcccaggggactaagcggccagggggtccatctaatgttctgagggatgcctgcctcgtcgcgaatatactggacccaaggatcaagcaggagattataaagaagtttatcaagcaacacttaagtgagtatctcgtgttgtttcaggaaaatcaagacgtggcctggcttgacaagattgaccgtcgttacgcctggatcaagagacagttagttgattacgaagagaagtacggtagaatgttccctcgggaatggtgtatggcggagagaatagcagtggaattttgccacgtgacgagagcagaattagccaaaatcatgcggacccgggctaaggagatcgaggtgaaactcctgctctttgctattcagaggactacaaattttgagggtttcctagccaagagattctcaggttgtactttaaccgatggcaccttgaagaaactagaaagccccccaccctctacaaacccatttctggaggatgaacctacccctgagatggaggagctggccacagagaagggagacctggaccaacccaaaaagccaaaagccccagacaatcccttccacggcatcgtgtccaagtgcttcgagccacacctatacgtgtacatagagtcccaggacaagaatttgggtgaactcattgatcgcttcgtggcggatttcaaggcccagggcccaccaaagccaaatacagatgaaggaggagcggtgctcccatcatgcgcggacttgttcgtgtactataagaagtgtatggtccagtgcagtcagctgtctacgggtgagccaatgattgcgttaacaaccattttccagaaatatctgagagagtacgcctggaaaatcctgtctggtaatctgcctaagaccaccacaagcagcgggggacttactatcagttctctgctgaaagagaaggagggctctgaagtcgccaagtttactttagaggagctttgtctcatctgtaatattttgtctacggcagagtattgtctagctaccacgcagcagttggaggagaagctgaaggagaaggtggacgtgtcactgattgaaagaatcaacctgaccggggagatggatactttttcaaccgttatcagctcatctatccaactgctcgttcaggacttggatgccgcatgtgatccagccctgaccgctatgtccaaaatgcagtggcagaacgtcgagcacgttggagatcagtctccctatgttacatctgtaattctgcacataaaacaaaacgttcccattatccgggacaatctagccagcaccaggaaatatttcacccaattctgtgtaaaatttgccaactcttttatccctaaatttattacgcatctattcaagtgtaagcctatcagcatggtgggcgctgaacagctgcttctcgatacccattcgttaaaaatggtcctgctggacctccctagcattagctcccaagtggtgcggaaagctcccgcttcctataccaaaatagtggtcaagggtatgactcgggcagaaatgattctcaaggtcgtgatggcccctcacgaacctctggtggtgtttgtggataactatatcaagttgctcacagattgcaatactgaaactttccaaaagatcttagatatgaaaggtctaaagcggagtgagcagtcatctatgctggaacttctacggcaacgacttcccgcaccccctagcggggctgaaagcagcgggtctctgtcattgacagcacctacacctgagcaggaaagcagtcgaatcaggaagttggagaaactgattaagaaacggctctag

SEQ ID NO: 61006 - DNA, 1506 bp, Artificial Sequence
  Description of Artificial Sequence: Synthetic coding sequence
atgttctctctgatcgtgaaggccgcacaaactgagttaggacagcagattctcgcggacttcgaagaggcatttccatcgcaaggcactaaacggccagggggaccaagcaacgtcttgcgggacgcttgcttagtggccaacattctggatcctcgcattaaacaggagatcattaaaaaatttattaagcaacaccttagcgagtatctggtcctgttccaggaaaatcaggatgtagcatggctcgacaaaattgacaggcgatacgcttggataaagcgacaattagtcgattatgaagagaagtacggcagaatgttcccacgggaatggtgtatggccgaacgaatcgcagtggaattttgtcatgtaactagagccgaattggcgaagatcatgcgaaccagagcaaaggagattgaagtgaagctcctgctattcgcaattcagcgcaccactaactttgaaggcttccttgcaaagcggttttcgggttgcactctgacagacggcaccttgaagaaattggagtctccaccccctagcacaaaccccttcctcgaggatgagccaactcccgagatggaagagctggccacagaaaagggagaccttgaccagcctaaaaagcccaaagcccctgacaacccattccatggaatcgtgagcaaatgttttgaaccacacttgtatgtctatatcgagagtcaggataaaaatttgggtgagctgattgaccgcttcgtagctgacttcaaggcccaaggacctcccaaacccaatacagacgagggaggggctgtgcttccaagctgtgccgacctgttcgtgtattataagaaatgtatggtgcagtgctctcagttgagtacgggcgagcctatgattgccctgactactatctttcagaagtacctgagggagtatgcttggaagattctgagcggaaacctccctaaaaccaccacttcttccggcggactgacaatatcttccctgctgaaagagaaagaggggtccgaggtggctaaatttaccctggaggaactgtgcctgatctgtaacatcctttcaacggcagagtactgtttagccacgacacagcagctggaggaaaaattgaaggagaaagttgatgtcagccttatagaacgcattaatctgacaggagaaatggataccttttcgacagtcattagcagctccattcagctacttgtgcaggatctggatgccgcatgcgatcccgcactgacagccatgtccaaaatgcaatggcagaacgtggaacatgttggcgaccagagcccatacgtgacgagtgtaatcctgcatatcaagcagaatgtgcctataatccgagataatctcgcctcgacacgcaaatactttacacagttttgcgttaagtttgcgaattcatttattcctaaatttatcacacacctcttcaagtgcaaaccgatcagtatggttggcgcagagcaagtgaggtggacctag

SEQ ID NO: 61007 - DNA, 387 bp, Artificial Sequence
  Description of Artificial Sequence: Synthetic coding sequence
atggtcctcctcgacttaccgagcatatcttcgcaggtcgttcggaaggccccagcaagctataccaaaattgtcgtgaagggcatgacaagggccgagatgatcctgaaggtcgtgatggctccacacgaacccttggtcgtgtttgtcgataactacataaagctcttgacagactgcaatactgagacatttcaaaagatcctggacatgaaagggctgaagagatcagagcagtcttcgatgctggaactgttacgccagcggttgccagcacctccgtctggcgctgagtcttccggatctttgtccctcaccgcgcctacaccagagcaagaaagctccagaatcagaaagctcgagaagctgatcaaaaaacggctctag

SEQ ID NO: 61008 - DNA, 2934 bp, Artificial Sequence
  Description of Artificial Sequence: Synthetic coding sequence
atggcaagctcacattcatccagccctgtcccccaaggcagttctagcgacgtgttctttaagatcgaggtagatccgagtaagcatatccgcccagtcccctctctgcctgacgtgtgtcctaaggagcctaccggtgattcccactcactgtatgttgccccaagtcttgtcaccgaccagcacaggtggacagtgtatcactctaaagtgaatctgcctgccgcactcaacgaccccaggctcgccaagcgagaatcggacttttttactaagacatggggcttggatttcgttgacaccgaagttattcccagtttttacctgccgcagatttcaaaagagcacttcaccgtctatcaacaagagatttcccaaagagagaaaatacatgagagatgcaagaatatatgccctcctaaggacaccttcgagagaacactgcttcatacgcacgacaagtccaggacagacctagaacaggtacctaagatcttcatgaaacccgatttcgcacttgatgactctctaacctttaactctgtgctcccctggtcccatttcaacacagctgggggtaaggggaaccgggatgcggcatcgtcaaaactattgcaggaaaagctttcacactacctggatattgtggaggtgaatatcgcacaccaaatctctctcaggtctgaagcgtttttccatgcaatgacgtctcagcacgagttgcaggattacctgcggaagacgtctcaggctgtaaagatgttgcgcgacaagatagcccagatcgacaaggtcatgtgtgaaggaagcctccacattcttcgtctcgcactcacacgtaacaactgcgtcaaggtatataacaagctgaaactgatggctacagttcaccagacccagccgacggtgcaagttcttctctccacatccgaatttgtgggtgccctcgacctgatcgccactacccaggaggtcctgcagcaagagctacaggggattcactcctttcgacaccttgggtctcagctatgtgagctagaaaagctgatagacaaaatgatgatcgctgaatttagcacatattcccacagtgacttgaaccggccactggaggatgactgccaggtcttggaggaagagcgcctgatctctcttgtgttcggtttgctcaagcagcgaaagctcaatttcctcgaaatctacggtgagaaaatggtaattaccgcgaagaacattataaaacagtgcgttataaataaggtaagtcaaactgaggagattgatacagatgtcgtggtcaagctggctgaccagatgaggatgctgaactttcctcagtggtttgacttactgaaggatatatttagcaaattcacaatattcctacaacgggttaaggccaccctcaatattatccacagcgtagtgctttccgtcctggataaaaaccagcgcacaagagaattggaggaaatcagtcaacagaaaaacgcagccaaagataatagtttggatacggaagtggcctatctgattcacgagggcatgtttatctcagacgcatttggcgagggtgagctgaccccaattgccgtagacactacttcacagagaaacgcatcgcccaactccgaaccctgctcctctgacagtgtgagtgagccggagtgcactactgattcttcctcaagcaaagaacacacctccagttccgccataccgggtggggtagatattatggtgtccgaggacatgaaactgacagacagcgagctgggcaagctggccaacaacattcaggagttgctgtatagcgctagtgacatctgtcacgatagagcggtcaaattcctgatgagccgggctaaggacggattccttgagaaacttaatagcatggaattcataacattatccaggttgatggagaccttcatcctggacacagaacagatctgtgggagaaagtcaacatcgcttctcggagcactgcagagccaagccatcaagttcgtgaacaggttccacgaggaacgaaagaccaagctatcactgttgctggataacgagcgttggaagcaggcagacgtcccagccgaattccaggacctagtcgatagcctgtctgacggtaaaatagctcttcctgagaaaaaatccggggcaacagaggagaggaagcccgcagaggtgctgatcgtcgaggggcagcagtatgctgtcgttgggaccgtgttactccttatccggattattttggagtattgtcagtgcgttgataacattccaagcgtcactaccgatatgctgactcgcctctccgatctgctcaagtacttcaatagccgcagctgtcagctggtactgggcgctggcgctcttcaagttgtcggcctcaagaccataaccaccaaaaacctagctttgtcttccaggtgtctccagctgatagtccactatattccggtaatacgggcacatttcgaggcaagactcccccctaagcagtactcaatgctgcggcacttcgatcacattaccaaagattatcacgatcatatcgccgaaatttcagcaaaacttgtggctattatggacagcttattcgataaactcttgagcaagtatgaagtgaaggcccctgtcccctcagcatgcttccggaacatttgtaagcagatgaccaagatgcatgaggcaattttcgatttgctgcccgaggagcagacccagatgctgtttctccgtattaatgcatcctacaaactccacttgaagaaacagttgtctcatttaaacgtcatcaacgatggtggcccacagaacggtctagtcactgccgacgtggcattctacaccggcaaccttcaggcactaaaaggactcaaagatcttgatcttaacatggcagagatttgggaacagaagcgttag

SEQ ID NO: 61009 - DNA, 2901 bp, Artificial Sequence
  Description of Artificial Sequence: Synthetic coding sequence
atggccagctctcatagttcctcacctgttccccagggttcatcgagtgacgtgtttttcaaaattgaggtggaccccagtaaacatatccgacccgtcccttccctgccagacgtttgccccaaagaaccaaccggcgactcacattccctgtatgtcgcacctagccttgtcaccgatcagcatcggtggaccgtgtatcattctaaagtgaacctccccgctgccctgaacgatcccagattggcaaaacgggagagtgatttctttacaaagacctggggcctggacttcgtcgatacagaagtgatcccctccttctacttaccccaaatctcaaaagaacacttcacagtataccaacaagagatcagccagcgagagaagatccatgaacgatgtaaaaatatctgcccccctaaggatacctttgagcggaccctcctgcatacacatgataaatctcggacagacttggaacaggttcctaagattttcatgaagccagattttgccctggacgattctctcacatttaattcagtactgccatggtcccactttaacacggccggtggcaagggaaatcgagatgcggcttcctccaaactgcttcaggaaaagctgtctcattacctggatatcgtggaagtcaatatagcccaccagatatcattgcggtctgaggccttctttcatgccatgaccagccagcatgaattgcaggactaccttagaaagacctcacaggctgtaaagatgctgcgtgataaaattgcccagattgacaaggtcatgtgcgagggaagtctgcacatcttacggttggcacttactcgtaacaactgtgttaaggtgtataataaactgaagttaatggcgacagtgcaccagacacagccgaccgtccaggtgctgctttcaacgtctgaatttgtgggggcactggatctgattgccactacccaagaggtgctccagcaggaactgcagggcatccattcctttcggcatctcggatcacagttatgcgagcttgagaagctgatcgacaagatgatgattgcagagttttctacatactcccacagcgatctgaacagacccctggaggatgactgtcaggttctagaggaggagagactgattagtctggtgttcggactgctaaagcagaggaagctgaacttcctggagatctatggggagaaaatggtgattacagctaaaaatataattaagcagtgtgttataaacaaggtttcacagactgaggaaatcgatacggacgtcgttgtcaaactggctgaccagatgaggatgttgaatttcccccagtggttcgacctcttgaaggacatcttctcaaaattcacgatttttcttcagcgagttaaggccaccctgaatatcatccactctgtggtgctgtctgtcctcgacaagaatcagcggacccgcgagctggaggaaatctcacagcagaaaaatgcggcaaaagataatagtctggacactgaggtggcctacttgatccacgagggcatgtttatttcggatgccttcggcgaaggagagctcacgccaatcgccgtggacactacgtcccagcgaaacgctagccccaattccgaaccttgtagcagtgattcagtttctgagccagagtgtacaaccgattcttcctccagcaaggaacataccagcagtagcgccattccaggcggagtcgatatcatggtttctgaagatatgaagctgaccgacagcgagctgggaaagttggctaacaacatccaagagttgctctacagcgctagcgacatctgccacgaccgcgctgtcaaatttctcatgtctagggcaaaggatgggtttctggagaagctaaatagtatggaatttattacgctgtcacggctcatggaaacctttatcctggacacagagcaaatttgcggcaggaagtccactagcctcttgggggctctgcagtcacaggctatcaaattcgtgaaccggtttcacgaggagcgcaagacaaagttatctctactgctggataacgagcgctggaagcaagccgacgtaccagctgagtttcaggatcttgtggacagcctctctgatggaaaaatagctcttccagagaaaaagagtggcgcaaccgaagagcgaaagccggctgaggtgttgatcgtggaaggccagcagtacgctgtcgttggcacagtccttcttcttatccgtatcattctcgagtattgtcagtgcgtggacaacattccatccgtgaccactgacatgctcacacggttgtccgacttactgaaatacttcaacagccgaagctgtcaactcgttcttggtgccggtgcattgcaggtggtgggcctgaaaacgatcactaccaagaatctggcgctatcttcacggtgtttgcagctcatagtgcattatatccctgtgatccgggctcattttgaagctcgattaccacccaagcagtattcaatgctgagacatttcgaccacattacaaaggattatcacgatcacatcgccgagatcagcgcaaagctggtcgccattatggactcgctgttcgacaagttgctatccaaatatgaggtaaaggccccagtgccatcggcatgttttcgaaatatatgcaaacagatgaccaagatgcatgaggctatttttgacctcttgcctgaggagcagactcaaatgctgttcctgagaattaatgccagctacaaactccatttgaaaaagcaattatcccacctgaacgttatcaacgatggtgggcctcaaaacggcctggttaccgctgatgtagccttctataccggaaatctgcaggcactgaaagggcttaaaatttggatgtag

SEQ ID NO: 61010 - DNA, 2898 bp, Artificial Sequence
  Description of Artificial Sequence: Synthetic coding sequence
atggccagcagccactcctcaagcccggtgccacagggcagcagctccgacgtgttctttaaaatcgaggtcgatccgtcgaagcatatccggcctgtaccatccctcccagacgtctgccctaaagagcccacagtgaccgaccagcatcgctggactgtctatcattctaaagtgaatctcccagctgctctcaatgacccccgtttggcaaaaagagaaagcgatttttttacaaagacatggggccttgactttgtcgacaccgaggtaatcccctccttctacctgccccagatctccaaggaacactttactgtgtatcagcaggagatctcccagcgtgagaaaatccacgagcgctgcaaaaacatttgtcccccaaaggatacgttcgaaagaaccctgcttcacacccacgataagagcaggactgatttggagcaagtacctaagatctttatgaaacccgattttgcgctggatgatagtctgaccttcaatagcgtgctaccatggagtcattttaacactgcaggcggaaaggggaaccgagatgcagctagcagtaagctcctccaggaaaagctctcacactatctggacattgtcgaggtgaatattgcgcaccagatttcgctgagaagcgaagcctttttccacgccatgacttcacagcacgagctccaggattacttaaggaagactagtcaggctgtgaaaatgctgcgggataaaattgctcaaattgacaaagtaatgtgtgaagggtccttacatattctgcggctggccctcactcgtaacaactgtgttaaagtgtacaacaagctgaagttgatggccaccgtgcaccagacacaacctaccgtgcaagtccttttgtcaacctctgaatttgtaggcgctttggacttaatcgctaccactcaggaggtactgcagcaggaactgcagggcattcattccttcagacacctgggttcacaactttgcgagcttgagaagctgattgacaagatgatgatagcagaattcagtacgtattctcacagcgacctgaaccggcctttagaagacgactgtcaggttctggaggaggaacgactgattagcctggtgtttggactactaaaacagagaaaactgaactttttggaaatctatggcgagaagatggtgataaccgccaagaacatcatcaagcaatgcgtgataaacaaggtcagccagacagaagagatcgacacggatgtggtggtgaaattggccgaccagatgagaatgttaaacttccctcagtggtttgatctgctgaaggatattttctcaaaatttacaatctttctgcagcgggtgaaggcgaccctgaacatcatccactctgtcgtgctctcagtgctcgataaaaaccaacgcaccagagaactagaggagatctcccagcagaagaacgctgcaaaagataattccctcgatacggaggttgcctacctgattcatgaggggatgtttataagtgacgctttcggagagggggaattaactcctatcgccgtcgacacgacttcccagagaaatgcctcccctaatagcgagccctgttcatcggactctgtcagcgagcccgagtgcactaccgacagcagctcttcaaaggagcatacgagctcctcagccatccccggtggtgtggacataatggtgagtgaggacatgaagctcacagactcagaactgggaaaacttgccaacaacattcaggagctcttatattccgctagcgacatctgtcacgaccgtgctgtcaaattcctgatgagtagagccaaggacggtttcttggaaaagcttaactccatggagttcatcactctttcacgacttatggaaaccttcatcttggatactgaacagatatgcggcagaaagagtacttctttgctgggcgcactccagtcccaagccattaagtttgttaaccgcttccatgaggaaaggaagacaaaactgtcgctccttctggacaacgagaggtggaagcaggcggacgtccctgccgagttccaggacctggtcgactccctgtccgacggcaaaattgccctgcccgaaaagaagagtggggcaactgaggaaagaaaacctgcagaggtgttgatcgtcgaaggccaacagtacgctgtggtgggcaccgtgttgttactcattcgcatcatcctcgaatattgtcaatgtgttgacaatattccctctgtcactactgatatgctgactcgcctgtcagatctgctaaagtactttaattcaaggtcttgccaactcgtgctgggcgcaggcgctctgcaggttgttggcctgaagactatcaccacaaagaacctagctctctcatcccgttgcctccagctaatcgtgcactacatacctgttatccgcgcacattttgaagcacggcttcctcctaagcaatatagcatgttgcggcattttgatcacatcactaaggactatcacgatcacatcgccgaaatttctgctaagctagtggcaataatggattcactatttgacaagctattgtctaaatacgaagttaaggccccagtcccgtctgcatgcttccgaaacatttgtaagcagatgactaaaatgcacgaagccattttcgacctgttacctgaagagcagactcagatgctgttcctcaggatcaatgccagctacaaactccatctgaagaagcagctgagccacctgaacgtgattaacgatggcggtccacagaacggcctcgttacagccgatgttgcgttctacaccgggaatcttcaggcccttaagggactaaaagacctggatctgaacatggccgaaatctgggagcaaaaaagatag

SEQ ID NO: 61011 - DNA, 2898 bp, Artificial Sequence
  Description of Artificial Sequence: Synthetic coding sequence
atggccagtagtcacagctcttcacccgtcccccagggcagttcatccgacgtctttttcaagatcgaggtggacccttccaagcacatacgcccagtacctagcttgccggatgtgtgccctaaggagcctactgtgaccgaccagcaccgctggactgtctatcactcaaaagtcaacctgcctgccgctttgaatgacccacgccttgccaagagggagagtgacttcttcactaagacctggggcttagacttcgtggacaccgaggtgattccatccttttatctgccccaaatcagcaaggaacacttcacagtgtatcaacaagaaatttcgcagagggaaaaaattcatgaacgctgtaaaaacatatgcccaccgaaggatacgttcgagaggactctccttcatacacacgataagtcccgcacagacctggaacaagtccccaaaatctttatgaaaccagatttcgcactggacgattcgttgaccttcaacagtgtactcccttggtctcacttcaatacagctggcggtaagggtaacagggatgccgcaagtagcaaactcttacaggagaagctttctcattatctagacattgtggaggtgaatatcgcccatcagatttctttgcgaagcgaggcattctttcacgcaatgacgtcccaacatgaactgcaggactatctaaggaaaactagtcaggccgttaagatgttaagggataagatcgctcagatcgacaaagtgatgtgtgagggcagcctgcatattctgcggttagctctgacgagaaataactgcgtgaaggtatacaataagctgaagttaatggccaccgttcaccagacacagccgacagtgcaagtcctgttgagcacgtcagaatttgtcggcgcactggacctgatcgctaccacccaggaggtattgcagcaagaactgcagggaattcatagcttccggcacttagggtctcagttgtgtgagctggaaaaattgattgataaaatgatgattgcagagttctccacgtactctcactccgatctgaaccggcctttggaggatgattgccaggtgttagaagaggaaagattgatatcactggtgttcggtttgctcaagcaaaggaaactcaacttcctcgaaatatatggagagaagatggtcataaccgcgaagaacatcattaaacaatgcgtgattaataaggtcagccagaccgaggagatcgacacagatgtggtggtgaaactcgccgatcagatgcgcatgctgaattttccgcagtggtttgacctgcttaaagatattttttcaaagtttacaattttcctccaaagagtaaaggctacccttaatatcatccattccgtcgtgttatctgtgttagacaagaaccagagaactagagagttggaagaaatcagtcaacagaagaacgccgctaaggataattcactggataccgaggtagcctacctaatacacgaagggatgtttatcagcgatgctttcggagagggggagctcactcccatcgcagtcgataccacaagccagcgcaatgctagtcccaactcagaaccctgcagctctgacagcgtgtcagaacctgagtgcacaactgattcatcttcttctaaggagcacactagcagctccgccatacctgggggagtcgacatcatggtcagcgaggacatgaaactcacagattcggagctgggaaaactggctaacaacatccaggagcttctctattccgcatccgatatatgtcacgatcgggctgtgaagtttttaatgagtagagccaaagatgggttcctggagaagctgaactctatggagtttatcacactgagtcgccttatggagacttttattttagacactgagcaaatctgcggacggaagtccacctctttgttgggcgcacttcagtcccaggccatcaagtttgttaaccgttttcacgaagagcggaaaactaaactatctcttctgctggacaacgagaggtggaagcaggccgacgtgccggcagagttccaggacctggtcgatagcctgagcgacgggaagatagccctgcctgaaaaaaagtctggagcgacagaggagcgaaagccagccgaggtgctgatagtggagggccagcagtacgccgtggtggggacagtgttgcttttaatccggattatactggagtattgtcagtgtgtcgataacattccctccgttactaccgatatgctgacaagacttagtgacctgctaaagtactttaatagtagatcctgtcagttggtacttggtgctggtgcactacaggttgttgggctgaaaaccatcaccaccaaaaatttggcactctctagtcggtgccttcagcttatcgtccactacattcccgtgatccgggcacatttcgaagccaggctgccaccaaagcagtattctatgctccgccactttgaccatatcacaaaggactaccacgatcatattgccgagatttcagcaaaactggtggcaatcatggattcactgtttgacaaactgctcagtaaatatgaggtaaaagcaccagtccccagcgcttgcttccggaatatttgtaagcagatgaccaagatgcacgaggctatatttgacttactgcccgaggagcagacacagatgctgttcttaaggattaatgcctcttataagttacacctgaagaaacagctgtctcacttaaatgttattaatgatggcggtcctcagaatggattggtgacggccgatgtggccttttataccggaaatctgcaagctctaaagggcttaaaagaccttgacttgaatatggccgaaatctgggaacagaagcgctag

SEQ ID NO: 61012 - DNA, 4287 bp, Artificial Sequence
  Description of Artificial Sequence: Synthetic coding sequence
atggaaaatgaacctgaccatgaaaatgtggagcagtcactgtgcgccaaaaccagcgaagaagagctgaacaagtcatttaacttggaggccagcttgagcaagttcagctatattgacatggacaaagaactcgaatttaagaacgatctcatcgacgataaagaattcgacatcccgcaggtggacacgccccctaccctggagagtatattgaatgagactgacgatgaggatgagtccttcattctcgaggatccaaccctgttgaacattgacacaatcgattcccactcgtacgacaccagctccgtggccagttctgactcaggagatcgcacaaatctgaagagaaaaaagaagctcccagacagcttttccttgcacggctctgtgatgaggcactccctgctgaaagggatatcggcacaaattgtttcagcagcggacaaggtagacgcaggattgccaacagccatcgccgtaagctccttgattgcagtcggaacctcccacggactggccctgatatttggaaagtatcagaaccaggcgctccgactgtgtctaggatctacctccgtgggcggacagtatggagcaatcagtgctttgagtatcaacaacgactgctcccgcctgctatgtgggtttgcaaaaggccagatcaccatgtgggacctggcttctggcaagctgctgcgatctattaccgacgctcacccacctgggaccgccatcctccacatcaagttcaccgatgacccgacccttgccatttgtaatgattctggaggatccgtgtttgagctcacctttaagcgggtgatgggtgtgcggacgtgcgagagtaggtgtctcttcagcggatccaagggggaagtgtgttgtattgagcctctgcacagcaagcccgaactgaaagaccaccccattacccagttcagtctcctggccatggcctctctgaccaagatactggtgatagggctcaaaccgtcgcttaaggtctggatgacgtttccctacggacgcatggacccgagctctgtgcctctcttagcctggcacttcgtggctgtccagaactacgtcaatccaatgctcgctttttgccgcggagacgttgtgcactttcttctggtaaagcgggatgagtccggcgctatccacgtgaccaagcagaagcacctccatctgtactatgacttgataaattttacctggatcaattcacgcacagtcgtgctactcgattcagtggaaaagctccacgtcatagatcggcagacccaggaagaactggaaaccgtggagatttctgaggttcaactggtttacaactcctctcattttaagtccctcgcaaccggtgggaacgtgtctcaggcactcgctcttgtcggcgaaaaggcttgttaccagtccatctcttcctatggtgggcaaatcttttacctgggcactaagtccgtgtatgtcatgatgctgaggtcctggcgcgaacgggttgaccatctactaaagcaggattgcctgacagaggctctcgcattagcctggagcttccatgaagggaaggcgaaagcagtagtgggcctctccggagatgccagcaagcgcaaggcaatcgtggctgataggatggtggaaatcttgttccattatgctgatcgcgcactgaagaaatgcccagatcagggcaaaattcaagttatggaacaacacttccaggatatggtgccagtaatagtggattactgtttgctcttacagcgcaaagatctgctttttagtcagatgtacgataagctgtccgagaactcggtagcgaagggggtatttctggaatgtttggagccttatatcctctcggataagctggtgggcatcacaccacaggtgatgaaggacttgatcgtccactttcaggacaaaaagcttatggagaatgtggaagctctgatcgtgcacatggatataacatcactcgacattcagcaggtcgtgcttatgtgctgggagaatcgtctgtacgatgccatgatctacgtgtataaccggggaatgaacgaatttatatccccaatggaaaagctcttccgggtgattgctcctccgctaaatgccggaaagaccctgactgacgaacaggtggtgatgggaaataaacttctcgtatacattagttgctgccttgccggacgggcttacccactcggtgatatccctgaagacctggttccacttgtgaaaaatcaggtttttgaattcctgatccgcctgcattctgcggaggcatccccagaagaggaaatttacccttacatccggacgcttctgcatttcgataccagggagtttctcaacgtcctggccctgactttcgaggattttaaaaacgataaacaggctgtggaataccagcaacgtatcgtcgatattttgctgaaggttatggtagaaaacagcgacttcaccccctcccaggtggggtgcctgttcaccttccttgcccgtcagctcgcaaaaccagacaatactctttttgtcaaccgaaccctcttcgatcaagtactcgagttcttatgtagccccgatgatgacagtcggcattccgaaaggcagcaggttctgttggagttgctgcaggctgggggaatcgttcagttcgaagagtcacgcctgattcgtatggctgagaaagccgagttctatcagatttgcgagtttatgtatgagcgggagcaccaatacgacaagatcatagattgctacctgcgagatccgctgcgagaggaggaagtattcaactacatacacaatattctgtctattcctggacactcagctgaagagaagcaatcagtgtggcagaaggctatggatcacatcgaggagttggtcagcctgaagccttgtaaggcagccgagttggtggcaacccactttagtggtcacatcgagacagtgatcaaaaaattgcaaaatcaggtcctgcttttcaaatttcttagaagccttctggaccccagagagggaattcacgtgaatcaggaactgctgcaaatcagcccctgtataaccgagcagttcatcgaactcctatgtcagtttaacccaacacaagtcatcgagacattacaggtcttagaatgctacagactagaggagacaatacagatcactcagaaataccagctgcatgaggtcacggcctatctcctggaaaaaaaaggtgacattcatggcgctttcctgataatgctggaaaggctacagagtaagctgcaagaggtgacacaccagggtgagaacactaaagaagacccaagccttaaagacgtagaggatacaatggtggaaaccatagctttgtgtcagaggaatagccataacctcaaccagcagcagagagaagcactctggtttcctctgctggaggccatgatggcccctcaaaaactctcttcgagtgctattcctcatctccattccgaggccctcaaaagcctaactatgcaggtcctaaattctatggccgcttttatagccttacctagtatactccaacgaatccttcaggatccagtctatgggaagggtaaactgggcgaaatccagggacttatcctggggatgcttgacacatttaattacgagcaaaccctgttggagacaactacctccctcctgaaccaggacttgcactggtcactttgtaatctgcgggcatcagttacccggggactgaaccccaagcaagactattgctccatctgtctgcaacagtataagagacgacaagaaatggctgatgaaatcattgtgttctcctgtgggcacctttatcactcgttttgtctccagaacaaagaatgtaccgtcgaatttgaaggccagacacggtggacatgttacaagtgttctagcagcaacaaagtcggcaagctaagcgaaaattcatcagagattaaaaaggggaggattactccatctcaggtgaaaatgtcccccagctatcatcagtccaaaggagatccaaccgccaagaaggggaccagcgagcctgtcttggatccgcaacaaatccaggcatttgatcaactctgccgcctgtacaggggaagtagccgactggcccttctcaccgagttgtcgcagaatcggagctcagaatcctatagacctttttctgggtctcagtccgctcccgctttcaactctattttccagaatgaaaatttccagttacagcttatccctcctcctgtaactgaggattag

SEQ ID NO: 61013 - DNA, 609 bp, Artificial Sequence
  Description of Artificial Sequence: Synthetic coding sequence
atggaaaatgagccggatcatgaaaatgttgaacagtctttatgcgccaagacgtccgaggaagagctgaataagtcttttaaccttgaagctagcctgagcaaattctcctatattgatatggataaggagctcgaatttaagaacgacctgatcgacgataaggaatttgacatccctcaggtggatacccccccaaccttggagagcatcctgaatgaaactgacgacgaggacgagagcttcatcctcgaggaccctacgctgttgaatatcgatactatcgactctcactcctatgacactagctctgtggcatccagcgatagcggtgaccgaactaatcttaaacgaaagaaaaagctcccagactcctttagccttcatggtagcgtgatgagacatagtctgctgaaaggcatctctgcacagatcgtgtcagccgctgacaaggtagatgccggtctgcctactgcaatcgccgttagttccctgattgcggtaggtaccagccatggcttggccctcatctttgatcagaaccaagccctgcgattatgcctgggttctacatcagtgggcggtcagtatggagctatatccgcttag

SEQ ID NO: 61014 - DNA, 4281 bp, Artificial Sequence
  Description of Artificial Sequence: Synthetic coding sequence
atggagaacgagcctgatcacgagaacgtggagcagtctctgtgtgcaaaaacgtctgaagaggaactaaataaatctttcaacctggaagcgtcactctcaaagttcagttatattgacatggataaagagttagaatttaagaatgatttaattgatgataaagaattcgacattccgcaggtggatacccccccaacccttgaatcaatccttaacgaaacagatgatgaagacgaatcgtttatcctggaggatcctaccctccttaatatcgacaccattgattctcattcctacgacacttcgtccgtggcgagttcagactctggtgacaggaccaatctcaagcgcaagaaaaaacttcctgactcctttagcctccatggttctgtcatgcgacactccctgctaaagggcatcagtgcccagatcgttagcgccgctgataaagtggatgctggtcttccaacagcaatagccgtgtcgagcctgatagctgtgggcacatcccacggcctggcacttatatttgaccaaaaccaggccctgcgcctgtgcttggggagcacctctgtgggagggcagtacggggcaattagcgctctttccataaacaatgactgctcccggttgctgtgcggatttgctaaggggcagatcacgatgtgggacctggcatccggcaaactgttgagatctattaccgacgcacaccccccaggaactgccattctgcacattaagttcactgatgaccctacacttgccatctgcaacgacagtggtggctcagtgtttgaactcacatttaagcgagtcatgggggtgcggacctgcgaaagtcggtgtctcttcagtgggtcgaaaggagaggtgtgttgtatcgaacctttgcactccaaacccgaacttaaggaccacccgatcacccagtttagcttacttgccatggcctctcttacaaaaattctggtgatcggcctgaagcccagcttgaaagtttggatgacattcccatatggtcggatggatccaagctcagtacccctactcgcgtggcacttcgtggctgtccagaattacgtgaatcctatgttggccttctgccgaggtgatgtggtgcatttcctcttagtaaaaagagacgagtccggagcaattcacgttacaaaacaaaaacatctccacctgtactatgatttgataaactttacctggattaactcacgcactgtcgttttgttagatagtgtggaaaaattgcatgtcattgacagacagacacaagaggaactggaaacggtggaaatttcggaagtgcaactggtgtataactccagtcatttcaagtccctggctacaggaggaaatgtgagtcaagcactggctctcgtgggtgaaaaagcctgctaccagagcatctcctcttacggagggcagatattctatctagggactaaatcagtttatgtgatgatgttgcggtcctggcgcgagcgtgtggaccatctactcaagcaggactgtctgacggaggctttagcactcgcttggagctttcatgaagggaaagccaaagcagtcgtcgggctgtccggggatgcaagcaagcggaaggccatcgtggctgatcggatggtggagatcctcttccattatgccgacagagccctaaagaagtgtccagatcagggcaagatccaggtcatggagcaacacttccaggacatggtgccagtaattgttgattattgtttgttgctccaacgcaaggatctgttgtttagccaaatgtatgataaactgtcagaaaactccgtagctaaaggcgtgtttctagagtgtctggagccatacatcctgagcgacaagctggtaggcattaccccacaggttatgaaggacctaattgtgcacttccaggacaagaaattgatggaaaatgtagaagccctgattgtacacatggacattacttccttagacatccagcaggtcgtgctcatgtgctgggaaaaccgcttatatgatgccatgatctatgtttacaaccgcggaatgaacgaatttatctcacctatggaaaagttattcagagtgatcgcaccgccactaaatgcgggtaaaaccctcaccgacgaacaggtcgtgatggggaataagctgctcgtatatattagctgttgcttagccggaagggcctaccccctgggtgacatccccgaagacctggttcctttagtgaagaatcaggtgttcgaattcctgattcgactgcactctgccgaggcgtcaccagaagaagaaatttacccttatatccgcacactgctgcactttgatactcgtgagtttttgaacgtccttgctttgacttttgaagatttcaagaatgataaacaggccgttgagtaccagcagcgcatcgtggatatccttctgaaggtaatggttgagaactcggactttaccccttcccaggtgggatgcctgttcacattcctggccaggcagttggctaagcctgacaataccctcttcgttaatcgaacactgttcgatcaggtacttgaattcctctgcagcccagacgacgattcaagacactctgaaagacagcaagtcttgctggagctactacaggccggaggcattgttcagttcgaagagagccgcttgataagaatggccgaaaaggctgagttctatcagatctgcgaattcatgtacgagagggagcatcaatatgataaaataatcgactgctacctccgtgaccccctgcgggaggaggaagtattcaactacatccacaacattctctctatcccaggtcattccgctgaggagaagcagtctgtgtggcagaaagcgatggaccatatcgaggagttggtctccctgaaaccttgcaaagcagcagaattggtggctactcattttagcggccacatcgagacagtgattaagaaattacagaatcaggtgctgctgtttaaatttctcagaagcctgctggatcctagggaaggcatccacgtgaatcaagagctcctgcaaatctccccatgcatcacagaacaattcattgaactgctttgccagtttaatccaactcaggtcatcgagacactgcaggtgcttgagtgttacaggctggaagaaactatccagattacccagaaatatcagctgcatgaggtgaccgcatacctgctggagaaaaaaggagatatacatggagctttcctgatcatgctcgaacgtctgcagagcaagttgcaggaggtcacccatcagggggagaacacaaaagaggatccatctcttaaagacgttgaagatacgatggttgagacaatcgccctgtgccagagaaacagccacaatctgaaccagcagcagcgcgaggcattgtggttccccctgcttgaggccatgatggctcctcagaagctatcatctagcgctatcccacacttacactctgaggccttaaagtcattgactatgcaggtcttgaattccatggccgctttcatcgctctgccatccatcctccagcgaatcctccaagacccagtgtatggcaaaggaaagctcggggagatacaggggctcatcttaggaatgctcgacacattcaactacgaacaaacccttttagaaaccacaacctccttacttaaccaagacctgcactggtcattgtgtaatctaagagcctctgtgacgagggggctgaaccccaagcaggattattgttcaatatgtctgcagcagtacaagagacgccaggaaatggctgatgaaataatcgtctttagctgcgggcatctgtaccacagtttctgcctgcaaaacaaagaatgcacagtcgaatttgaagggcagaccaggtggacatgttataagtgcagctcttccaacaaagtgggcaagcttagcgaaaattcatcagaaattaagaaagggagaatcactccttcacaggtgaaaatgtctccatcataccaccagtccaaaggagatccgaccgccaagaaaggcacctccgagccagttctggatccccaacagatacaggcctttgaccagctctgcaggctgtatcgcggaagttcccgattggcactgctgacagaacttagccagaacaggagctcagaaagctacaggccgtttagcgggagccagtccgccccagcttttaatagtatatttcaaaacgaaaattttcagctgcagttaataccgccacccgtgaccgaagattag

SEQ ID NO: 61015 - DNA, 4287 bp, Artificial Sequence
  Description of Artificial Sequence: Synthetic coding sequence
atggagaatgaaccagaccacgagaacgtcgagcaatcactgtgtgcaaagactagcgaggaagagctgaataagagctttaatctggaagctagcctgagcaagttctcatacatcgatatggataaggaactggaatttaagaacgatttgatcgatgataaagagtttgatattccgcaggtcgacactcccccaacattggaaagcatcttgaatgagaccgatgatgaggacgagtctttcatcctagaggatccaacattgctgaacatcgacactatcgacagccattcctatgatacatcaagcgtcgcttcctctgacagcggcgatcggactaatttgaaacggaaaaagaagcttcccgactcctttagcctgcacgggtctgtgatgcgccattccctgctcaagggtatttctgcacagattgtctccgccgctgacaaagtcgatgctggccttccgaccgctatcgctgtaagcagcctgatcgccgtgggtacaagccatggccttgcactcattttcggtaaagaccagaatcaagctttgaggttgtgtttaggttccacatccgttggcggtcagtatggcgcaatcagcgcgctctccataaacaacgactgttcaagactgctatgtggtttcgccaaaggccaaatcaccatgtgggatcttgccagcggtaaactgctgaggagcataactgacgctcacccgccaggaacagccatcctccatattaagtttactgatgaccccaccctggctatctgcaatgattctggtgggtctgtgttcgaactaactttcaaacgagttatgggcgttcgcacgtgcgagtctcgctgtctgttttcagggagtaaaggagaagtgtgctgcattgaacctctacatagtaagcccgaacttaaggaccaccccattactcagttttccctgctagccatggctagtctgacaaaaatacttgtgatcggccttaagccttcactgaaggtgtggatgacattcccatacgggaggatggatccaagctctgtgcccctgctcgcatggcactttgtggcagtgcagaattacgtgaatccaatgctagcattctgcaggggcgatgtagtccactttcttctggtcaaacgggatgaaagcggagccatccacgtgacaaagcagaaacacctgcatctatactacgacctgatcaactttacgtggattaattccagaactgtggttcttttagactccgtcgaaaaactccacgtgattgatcggcaaactcaggaagaactggagaccgttgaaatctccgaagtgcaactcgtatataactcttcccactttaagtccctcgcaacagggggtaatgtgtcccaagccctggctcttgtaggagaaaaggcttgctaccagtctatcagttcttacgggggacagatcttctatttgggtaccaagagcgtgtatgtaatgatgcttaggagttggagagagagggtcgatcacctgctaaagcaggattgtttaacagaggctttagccttagcctggagctttcatgaaggtaaagcaaaagccgttgtgggactaagtggtgacgcttcgaagcggaaggccattgtagcagatcgtatggttgaaatactcttccactacgccgacagggccctgaaaaaatgtcccgatcaaggcaaaattcaggtgatggagcaacactttcaggacatggtccccgttattgtggactactgcctgcttctgcaacgtaaagacttactttttagtcagatgtacgacaaactgtccgagaacagcgtcgcaaaaggcgtgttcctagagtgcctcgaaccctacattctgagtgacaaattggtcgggatcacaccacaggttatgaaagatttaatcgtgcacttccaagataagaaactgatggagaatgtcgaagccttaatcgttcacatggatattacaagcttagatatacaacaggttgtactgatgtgctgggaaaaccgcctgtacgacgccatgatttacgtatataaccggggaatgaacgagtttattagccccatggagaaactatttcgcgtgatagcccctcccctaaatgctggcaagacacttacagacgaacaggtggttatgggaaacaagcttctggtgtatatcagctgctgcctggcgggacgggcatatccgctgggagacatcccagaggacctggtccctttggtcaagaatcaggtgtttgagttcctcatcaggctgcactctgcagaggcgagcccggaggaagagatatatccatacattagaacactgttgcactttgacacccgagagtttctgaacgttctggcactcacctttgaggacttcaaaaacgataaacaagctgtggagtaccaacagaggatcgtggatatcctgctcaaggtgatggtcgaaaattcagattttacaccctcacaggtaggctgcttgtttacttttttggcaagacagctggcaaaaccggacaataccctgttcgttaatcgtacgctgtttgaccaggtgctggagttcctgtgctctcccgatgacgactctcgacacagtgagaggcagcaagtcctcctcgaactgttgcaagctggcggaatcgtgcaatttgaagaatcgagactaattcggatggccgaaaaggcagaattttaccagatttgtgaatttatgtatgagcgcgaacatcagtacgacaaaatcatcgattgctacttacgcgacccactgcgtgaagaagaggtgttcaattatatccacaatatcttgtctatccctggccatagcgccgaagaaaaacaaagcgtatggcaaaaggctatggatcacatcgaagagctggtgtccctgaagccttgcaaagccgctgagctagtcgctactcactttagtggacacatagaaacagtcatcaagaaattgcagaatcaggttctcctgttcaaattcctgcgaagcctcctggatcctagagaagggatccacgtcaaccaggagctgctacaaatcagcccatgtataacagagcagttcatagagctactgtgtcaattcaatccaacccaggtcattgagactctccaagtgctggagtgttatcggctcgaagagacaattcagattacacaaaaataccaactgcacgaggtgactgcctacttgctcgagaagaagggagacatccacggagcctttttgataatgttggagcgattacaaagtaagttgcaggaggttacacatcagggcgaaaacaccaaggaagatccgtctcttaaagatgtagaggatacgatggtggagacgatagccctttgccagagaaactcccacaatctgaatcagcaacaaagagaggccctttggttccctctgctggaagctatgatggctccccagaagctgagtagctccgccattccgcatctgcattctgaggcactcaagagccttacaatgcaggtgcttaattccatggccgctttcatcgctctgccatcaattctgcagcgcatcctgcaagaccctgtatacggcaaggggaaactgggagagattcagggcctcattctgggtatgttggatacttttaattatgagcaaactttgttggaaacgacaaccagcctactcaaccaggacttgcattggtcactatgtaacctgagggcctcagttacgagaggactgaacccaaagcaggactactgtagcatttgtctgcagcagtacaagcgcaggcaggaaatggctgacgagatcatcgttttttcttgtgggcatctgtaccatagtttttgtctgcagaacaaagaatgcacggtagagttcgaggggcagacccggtggacctgttacaaatgctcttcctccaacaaagtgggcaagctttcagagaacagttctgagataaaaaaaggcagaatcactccatcccaggtcaagatgtcacctagttaccaccagtcaaagggcgaccctacagccaagaagggtacctctgagcctgttctggatcctcagcagatccaagcctttgaccagctctgtcgtctctatcggggatcatcccgactcgcgttactgaccgaactttcacagaataggagctcagagtcctatcgcccattctccgggtcccagtccgccccagctttcaacagtatctttcagaatgaaaatttccaacttcagctgatcccaccccctgtgactgaagactag

SEQ ID NO: 61016 - DNA, 423 bp, Artificial Sequence
  Description of Artificial Sequence: Synthetic coding sequence
atggagaacgagcccgaccacgagaacgttgagcaatcgttgtgcgccaaaactagcgaagaagagttgaataagtccttcaacctggaggccagtttatctaaattcagttatatcgatatggacaaagaactggaattcaaaaacgacctgatcgacgacaaagaattcgatatccctcaggtggacacaccgcctaccctcgaaagcatccttaacgagaccgacgacgaggatgagtcctttatactcgaggatccaaccctcctaaacatcgatacaattgactctcacagttacgacacgtcctcagtcgcctcatcggattccggcgacagaacaaacctgaagcgaaagaagaagctccctgactcttttagcctgcatggctccgtgatgagacattcccttttaaagggttag

SEQ ID NO: 61017 - DNA, 366 bp, Artificial Sequence
  Description of Artificial Sequence: Synthetic coding sequence
atggagaacgaacccgatcatgagaatgtagaacagagtctttgtgcgaaaactagcgaagaagaactcaataaatcgtttaacctggaggcaagcctttctaagttcagttatatcgatatggacaaagagctcgagttcaagaatgacctcattgatgacaaagaattcgatatacctcaagtggacacccctcctacattggagtcaattctcaacgagacagatgacgaggatgaatcatttattctcgaggacccgacactgctgaacatcgacaccattgactcacactcctatgatactagttcagtggcatccagtgattctggagatcgaacaaacctgaagagaaaaaagaagtag

SEQ ID NO: 61018 - DNA, 4011 bp, Artificial Sequence
  Description of Artificial Sequence: Synthetic coding sequence
atggagaacgaacccgaccatgaaaatgtggaacagtccctctgcgcaaaaacaagcgaggaggagctcaacaaatccttcaacctcgaggcctccctgtcaaaattcagttatatcgacatggataaagagctagaattcaaaaacgacctgattgatgataaggagttcgacatccctcaagtcgatacacctcccaccctggaatctattctcaatgagacggacgatgaggatgaaagtttcatacttgaggatcctaccctcctgaacatcgacaccattgattcacatagctatgatacatcatcagtggcctcttcagattcaggagaccggacgaacctaaaacgaaagaaaaaattgcctgacagcttttccttacacggcagcgtgatgcgccactcccttctgaagggaatcagcgcccagatcgtttctgctgccgacaaggtggatgctggcctgcctacggccattgccgtaagttcactgattgcagtgggtacgtcccatggactggccctaatttttgatcagaaccaggccctgcgactctgcttgggaagcacaagtgtgggcggtcagtatggtgctattagcgctttatcgatcaataatgactgtagccgtctactttgtgggtttgcgaaagggcagatcactatgtgggatctcgctagcggcaagctcttgcgttccattaccgacgcccatccgcctggaactgccatcctgcacatcaaatttactgatgaccccaccctagctatctgcaacgattctggaggcagcgtttttgagctgactttcaaaagggtaatgggtgttcggacatgcgagtcccgttgcctgttttcggggagtaaaggcgaggtgtgctgtatcgagccactgcactccaaacctgaattaaaggaccatcctatcacacagttcagtctcttagcgatggcctccctgaccaaaatcctagtgattggcctgaaaccatccctcaaagtctggatgacatttccttacggccgaatggatccttcatctgtccccctgctcgcgtggcatttcgtcgctgtgcagaactacgtcaacccaatgttggccttctgccggggtgacgtggttcacttcctgctagtcaaaagagacgagagcggcgctattcacgtgaccaaacagaaacatctgcatctttactacgacctcatcaacttcacatggatcaactcccgcactgtggtccttcttgactccgttgagaaattacacgtcatagacaggcaaactcaggaagaactggagactgtggagatcagcgaggtccagcttgtttacaattcatcccatttcaagagcctcgccaccggtggtaatgttagtcaggccctcgctctggtgggagagaaggcctgttaccagagcatcagctcgtacggcggacaaatcttctacctcgggaccaagtcagtgtatgtgatgatgctgcggtcctggagagagcgcgtggaccacctcttaaagcaggactgtctgacagaggcattggccctagcctggagctttcacgagggtaaggccaaagccgtcgtagggctgtccggggatgcatccaaacgcaaagcgattgtggctgataggatggtcgagatactttttcattacgccgacagggccctgaagaagtgtcctgaccagggaaaaatccaggtaatggaacagcacttccaggtggtgctgatgtgctgggagaatagactctacgatgctatgatctatgtgtacaatagggggatgaatgagtttattagccccatggaaaagttgttccgcgtcattgctccccctcttaacgccggaaaaaccttaaccgacgagcaagtcgtgatgggcaataaactgcttgtgtacatatcctgttgcctcgcaggtagggcctatcccctcggcgacatacctgaggatctggtgcccttggtgaagaatcaagttttcgaatttctgatccggctgcactccgccgaagccagcccggaagaagaaatctacccttacatccgtactttgttgcatttcgatacccgcgagtttttgaatgtgctcgcactcacattcgaagattttaaaaacgataagcaagccgtggagtaccaacagcggattgtggacattctgctgaaagtaatggttgaaaacagcgacttcaccccctcccaggttggctgcttatttacttttctggcccgacagctcgccaaaccagataatactctgtttgtgaaccgcacactctttgatcaggtgctcgagttcctgtgcagccccgatgatgacagtcgccatagcgagaggcaacaggttctgctggagctactgcaagccggaggcatcgtgcagtttgaggagtcacggctaattcgaatggcagaaaaggctgaattttatcagatatgcgagttcatgtacgagcgagaacatcaatatgacaagatcatcgattgttacctgcgggatcccctccgagaggaagaagtgtttaattatatacacaacatcctgtctattcctggccattcagctgaagagaaacagagcgtgtggcagaaagcaatggaccatatcgaggagttggtgtccctgaagccatgtaaagctgcggagttggtggccacgcacttcagcggacacattgaaacagttatcaagaaactccagaatcaggtgctcctattcaaattcttaagaagcctcttggatccaagggagggaattcacgtaaaccaggagctgctgcaaatctccccttgtatcactgagcagttcattgagcttctttgtcagtttaatccaacccaggtcatcgaaactttacaggtactagagtgttatagactcgaagaaaccatccagatcacccaaaagtaccagctgcacgaggtgaccgcataccttctggagaagaagggcgacatccacggggcatttttgatcatgctggaacgcttgcagagcaagctacaggaggtcacacaccagggagaaaataccaaggaagacccctccttgaaagatgttgaagatacaatggtcgaaaccattgcactgtgtcaacgcaactctcacaatttaaatcagcagcagcgagaggcactgtggttcccactgctcgaggccatgatggccccacagaaactatcctcttcagcaatcccgcacctgcacagtgaagctctgaaatcgctcactatgcaggtattgaattccatggcagctttcatcgcattaccatcaatcctccagcgaattctgcaggaccccgtgtatggtaaaggaaaattaggtgagattcagggcttgattttgggcatgctagacacattcaattatgagcaaactctgctggaaacgacgaccagtttgcttaatcaagacctgcactggtcgctgtgcaatctccgagcctccgtcaccaggggcctaaaccccaagcaggactactgttcaatttgcctccagcagtacaagcgtcggcaggagatggctgacgagattatagtttttagttgcggccatttgtaccattctttttgtcttcagaacaaagagtgcactgttgagttcgaaggccagacccgctggacctgttacaagtgttcctcatccaacaaggtgggaaagctgtcagaaaattctagcgagattaaaaagggcagaattacaccatctcaggtgaagatgtcacccagttatcaccagtccaagggtgatccaactgccaaaaagggtacgtccgaaccagtactcgatccccagcagattcaggcgttcgaccagctgtgcaggttgtacagagggtcaagcaggctcgccctgctcaccgaactttcccaaaatcgctcttccgaatcatacaggccctttagtggttctcaaagtgcaccagcattcaactccattttccagaacgagaatttccagctgcagctgatccctcctcccgtcaccgaggattag

SEQ ID NO: 61019 - DNA, 225 bp, Artificial Sequence
  Description of Artificial Sequence: Synthetic coding sequence
atggaaaatgaacccgatcacgaaaacgttgagcagtccctgtgcgccaaaacatctgaggaggagctgaacaagtcatttaatttagaggccagtctgagtaagttctcctatatagatatggacaaagagttagaattcaagaatgaccttattgacgacaaggaattcgacattcctcaggttgataccccgccaacgttggaatccattctgaatgaatag

SEQ ID NO: 61020 - DNA, 741 bp, Artificial Sequence
  Description of Artificial Sequence: Synthetic coding sequence
atgagccccaaaccgagggccagtggccctccagccaaggctaaggaggcaggaaagaggaaatcatcgtcacagcctagcccatctgatcccaagaaaaagactactaaagtggctaagaaaggaaaggctgtacggaggggacgaaggggcaaaaaaggcgctgccacaaagatggctgctgtgactgcaccggaggccgagtccgggcctgctgcccctggcccaagcgatcagcctagtcaggaactgccgcaacatgagcttcctcctgaagaaccagtgtcggaagggacccagcacgaccccttgagccaggagagcgaactggaagagcccctttctcaggagtcagaggtagaggagcccctgtcccaggagtcccaggtagaagagccgctgtcacaggaatcagaggtcgaagaacccctgagccaagagtctcaggtagaggagcctctcagccaagagtccgaggttgaggagcccctgagtcaagagtccgaggtggaggaaccactaagtcaggaaagccaggtagaggaacccctgtcacaagagtctgaggtggaggagcccttgtcacaggagtcacaggtggaggaacctctcagccaggaaagcgagatggaagagcctctatctcaggagagccaggtggaggagcccctgagccaggagtccgaaatggaggagcctttaagtcaggagtccgaaatggaggagcttccttccgtgtag

SEQ ID NO: 61021 - DNA, 378 bp, Artificial Sequence
  Description of Artificial Sequence: Synthetic coding sequence
atgagcccgaaacctcgagccagcggcccacctgccaaagctaaagagactgggaaacggaagtcgagtagccagccctcaccgtccgggcctaaaaagaagacaactaaagtagccgaaaagggggaagcggtccgcggaggtcgacggggtaagaagggagcagcaacaaaaatggccgctgtaacggctcccgaggccgaaagcggtcctgctgctcccggaccaagcgatcagccgagccaggagctccctcagcatgagctcccacctgaagagccagtctctgagggcacgcagcacgaccctctgagccaggaatcagagctggaggagccactttcgaaaggtagaccctcgacacctctatctccttag

SEQ ID NO: 61022 - DNA, 2109 bp, Artificial Sequence
  Description of Artificial Sequence: Synthetic coding sequence
atgacctctcgtaatcagctcgttcaaaaagtcttgcaggaactgcaggaagctgtcgagtgcgaggggctggagggactgattggagctagcctcgaggcaaagcaagtcttatcctccttcactctcccaacatgtcgggagggcggacccggactgcaggtcctcgaagtagatagcgtggccctgtcactgtaccccgaagacgctccgagaaatatgttgccgctagtgtgtaagggggagggcagcctgctttttgaagctgctagtatgctgctgtggggagacgcgggactctccctggaactccgggctcggacagtggttgaaatgctcctccacaggcactactatttgcagggaatgattgatagtaaagtgatgctgcaagcagtgcgttactcactctgcagtgaggaaagtcctgaaatgaccagtttgcccccagcaacactggaggccattttcgatgcagatgtgaaggctagctgttttcctagcagcttctctaacgtgtggcatctctacgccctggcatctgtgctgcagcgaaatatatacagtatctaccccatgcggaacctgaaaatccgtccttactttaatagggtcattcgacctagacgctgcgaccacgtaccaagtactctgcacatcatgtgggcagggcagcctctgaccagtcatttctttcgacatcagtattttgccccagtggtgggactggaagaggtggaagctgaaggggctcccggagtggccccagcccttccggctctggccccactgagcagcccagctaaaactttggagctcctcaatcgcgaacccggtttgtcctactcccacctctgtgagcgctatagcgtgaccaagtcaacattctaccgctggcgcagacaatctcaggagcatcgtcaaaaagttgcagctcgattctctgccaagcacttcctgcaggactcttttcatcgaggcggagtcgttcccctgcagcagttcctacaacggttccccgagatatctagatctacctattacgcctggaagcacgaactattaggcagtggaacatgtcccgcactgccccctcgtgaagtgctcggcatggaggagctggaaaaattgccagaggaacaggtcgcagaagaagaactcgagtgttcggcccttgccgtcagtagtcctgggatggtgctcatgcagcgcgcaaagctttacctggagcactgcataagtctcaacacgttggtgccctaccggtgtttcaaacggaggttcccgggaatttccagatccacatactacaattggcgtaggaaagcccttaggaggaatccaagcttcaagcctgccccagccctgtcagctgccggtactccccagttagcctctgttggagaaggcgcagtcataccctggaaatccgaagcagaagagggtgccggtaacgccaccggtgaggacccaccagctccaggggagctgctaccactgagaatgcccctgtcccgctggcagcgtaggctgaggagggcagcgaggcgccaggtgttgagcgggcatctccccttttgccgtttcaggctgcggtacccctcattgtcgccttccgccttctgggtttggaaatcattggcccgaggttggcccaggggtctttccaaactccaggtgcctgtacccaccctggggaaaggaggccaggaagcagaggagaagcaggagaaggaggccggaagggacgtgacagccgtaatggcacccccagtgggcgcatccagtgaagatgtggaagggggtccttcgagggaaggtgccctccaggagggagcgacggcccagggtcagccgcactcaggaccattactttcacagcctgtcgtcgctgccgcagggggacgggacggacgcatgcttgttatggatatgatagccacaacaaagtttaaggctcaggccaagctgtttctgcagaaaagattccagtccaagagctttcccagctataaggagttctcagcactcttcccactgaccgcaagaagtacctactatatgtggaaaagagccttatacgacgggcttacgctggtagacggatag

SEQ ID NO: 61023 - DNA, 252 bp, Artificial Sequence
  Description of Artificial Sequence: Synthetic coding sequence
atgactagtcgcaaccagctcgtccaaaaggtgctccaggaattgcaggaggccgttgagtgcgaaggtctggaagggctgattggcgcttctctagaggcgaaacaagtgctaagtagctttacgctgcccacctgccgagaaggagggcctggcttgcaggtcctcgaggttgacagcgttgcattgtccctgtaccccgaggacgcgcctcgtaacatgctgccattagtctgtaagggtgagggatag

SEQ ID NO: 61024 - DNA, 1260 bp, Artificial Sequence
  Description of Artificial Sequence: Synthetic coding sequence
atggccaaagagggcgtggaaaaggcggaagaaaccgagcagatgatcgagaaggaggctggaaaggagccagcggagggtggcggaggggatggttcacatcgcctgggcgacgctcaggaaatgcgcgctgtcgttctggcaggatttggtggcctcaataagttgcgactcttccgaaaggcaatgcctgaaccgcaggacggcgagctgaagatccgagttaaagcttgtgggctgaacttcatcgacttgatggtccgtcagggcaatattgacaatccacccaagacaccactggtgcctggttttgagtgctctgggattgtggaagctctcggcgacagcgtgaaaggctacgagataggtgacagggtgatggccttcgtgaactataacgcctgggccgaggtcgtatgtactccagtcgaatttgtatataaaatacccgatgacatgtccttctcagaggctgcagcattccctatgaatttcgtcacagcctacgtgatgctgttcgaagtggccaacctcagggagggaatgagcgtgcttgtgcactcggctggcggaggcgtcggccaagctgtggcccaattgtgtagtaccgtgccaaacgttactgtgttcggcactgcctcaacttttaaacatgaagccattaaggattcagtgacacatctgttcgaccgaaacgccgattatgtccaggaggtgaaacggatctccgcagaaggagtggacattgttctcgactgtctgtgcggcgataacacaggaaaagggttaagcctgctcaagcctctcggaacctacattctctacggaagcagcaatatggtgacaggggaaaccaaatcttttttttcatttgctaaaagctggtggcaggtggagaaagtcaacccaatcaagctatatgaagagaataaagtgattgcaggcttcagtctcctcaatctgctgtttaagcaaggacgtgccggattaatcagaggagtggtcgagaagctgattggcttatataaccaaaagaagatcaaaccagtggtcgacagtctgtgggccctcgaggaagtgaaagaagccatgcaaagaattcacgatcgtgggaatattgggaaattaatcctggacgttgagaagactcctacacctttgatggcgaatgacagcacggaaacctcagaggcaggcgaagaggaggaagatcacgagggcgactccgagaataaggaacgaatgccctttattcaatag

SEQ ID NO: 61025 - DNA, 648 bp, Artificial Sequence
  Description of Artificial Sequence: Synthetic coding sequence
atggtcctcctgaccatgattgctagagtggccgatggactcccactggccgcatccatgcaggaagacgagcagtccgggcgagacctccagcaatatcagtcgcaggccaaacagttgtttagaaagcttaacgagcaaagcccaactaggtgtacgttggaggcaggggctatgacttttcattacatcattgagcaaggcgtttgttacctggttttatgcgaggcagctttcccaaagaagttagcttttgcttatctggaggatctccatagcgagttcgatgaacaacacggtaaaaaagtgcctacagtgtctcgcccttacagtttcatcgaatttgatacctttatacagaagacaaaaaagctatacatcgactcaagagctcgacgcaatctgggctctattaataccgagctgcaggacgtacaaaggatcatggtcgcaaatatcgaggaggtcctccagcggggtgaggcactgtcagcgctggacagtaaagcaaacaacttaagcagtctcagcaaaaaataccggcaagacgctaagtacctgaatatgcgttccacctacgctaagctggcagcggtcgccgtgttcttcataatgttgatcgtttacgtacgattctggtggttgtag

SEQ ID NO: 61026 - DNA, 873 bp, Artificial Sequence
  Description of Artificial Sequence: Synthetic coding sequence
atggagaccccgttggacgtgctttcaagggcagctagcctcgttcatgccgatgatgaaaaacgagaagccgcacttaggggcgagccacgaatccagaccctccctgtggcaagcgcactgtcttcccaccggacaggaccccctcccataagccccagcaaaagaaaattctccatggagcccggagacgaggacctggactgtgataacgatcacgtgagtaagatgtcgcggatttttaatcctcatcttaataaaactgctaacggagattgccgtcgagacccccgagaacgcagtcgatcacctatcgagagggcagtggcgccaaccatgagtttacatggcagtcatttgtacacaagcctcccatcactgggactggagcagcccctggcgctcaccaagaatagtctggatgcctctcgcccagccggattgtcaccaacactgacgccaggcgagaggcagcagaacagacccagcgtcattacatgtgccagcgcaggtgctcgtaactgcaatctgagtcactgtcctattgcccattccggttgcgcagcccctgggccagcgagttatcggcgtcctccttccgcggcaacgacatgcgatccggtggtggaggagcacttcaggaggagcctcggtaaaaactacaaagagcctgagccggctcccaactcagtatctataacaggttcagtggatgatcacttcgcgaaagcgctcggcgacacctggctgcagatcaaagccgctaaggacggagcatctagttccccagagagcgcatcacgtaggggacagcctgcatcaccctctgcccacatggtttcccacagtcatagtccctcagtggtttcttag

SEQ ID NO: 61027 - DNA, 888 bp, Artificial Sequence
  Description of Artificial Sequence: Synthetic coding sequence
atgaccgaaaatacacatttcgataagattccggaaagttgcgcactgaagagctggcgccacccagggctccaccatggggaggccgctctgcggggagagccaagaattcaaactctcccagttgcctcagcattatcaagccacaggaccggtcctccgcctatttccccttcgaagcggaagttctccatggagcctggagatgaggacctcgactgtgataacgaccatgtttcaaaaatgagtcggatcttcaatccgcacttgaataagaccgctaatggagactgtaggagggaccccagagagcggtcaaggagtccaatcgagcgcgcagtagcaccaactatgtccctccatggcagtcatctgtacacatccttgccctcgctgggcctggagcagcccttggcccttacaaaaaactccctggatgcttccaggcccgctggactcagccctaccctaacgccaggcgagcggcaacagaatagaccctccgtaattacctgcgccagtgcaggcgctcgcaattgcaatctgtctcattgtcccatcgcccattctggatgcgcagcccctggccctgcttcatatcgcagaccgccttccgccgcaacaacttgcgatcccgtagtggaagaacatttccgcagaagcttggggaagaactataaggagccggagcccgcaccaaactctgtctccataactggcagcgttgatgatcacttcgccaaagccctcggggatacatggctccagatcaaggcggcaaaggacggggcaagcagtagccctgaaagcgcatccagacgagggcaacccgcaagcccttcggcacacatggtatcacatagccacagtccatctgttgttagctag

SEQ ID NO: 61028 - DNA, 510 bp, Artificial Sequence
  Description of Artificial Sequence: Synthetic coding sequence
atggagactccgctggacgtgctgagtcgggctgcgagcttggtacatgccgacgacgagaagcgggaggctgcgctgaggggggaacccagaattcagactctccccgttgcatctgccctgtcaagtcatcgcacaggccctcccccaatctcccccagcaaacgcaagttctcaatggaaccaggcgacgaggacctggactgtgacaacgatcacgtctccaaaatgagtagaatcttcaaccctcacttgaacaaaacagcaaatggggactgtcggcgagatccgcgagagcggagtaggtcccccattgaaagggccgtcgcccctaccatgagcctacacggtagccacctgtacacttcccttccctccctgggcctagagcagccattggcgctcactaaaaacagtctcgatgcttcaagaccagctgggctgagccccacactcacgccaggcgaaaggcaacaagtgggactttgcctggggggatggagaggttag

SEQ ID NO: 61029 - DNA, 603 bp, Artificial Sequence
  Description of Artificial Sequence: Synthetic coding sequence
atggagacacctttagatgtgctgtcacgtgcggcaagcctggtccatgctgacgatgagaaacgggaagctgctctgcggggtgaaccaagaatccagacactaccagtggcctccgctctaagttcacacaggacaggacccccacctatctcacctagcaagagaaagtttagtatggagccgggtgacgaagacctggactgcgataacgatcacgtgtcaaaaatgagcaggatttttaacccccacttgaataagactgcaaacggggattgtcgcagagatcccagggaaagatcacgatcacccatcgagcgggcagtggctccaaccatgtccctccatggttcccacctctacacatccctgccttcactggggctggagcaacccttggcccttaccaaaaactccctcgatgctagccgcccagcgggactcagccctacattaacaccaggagaaagacagcagaatcgcccttcggttattacctgtgcctctgcgggtgcacgcaactgtaacctctctcattgtcctattgcccattcggggtgtgctgccccaggacccgcttcatacagacgacccccttcctag

SEQ ID NO: 61030 - DNA, 384 bp, Artificial Sequence
  Description of Artificial Sequence: Synthetic coding sequence
atggagacccccctggatgttctctccagagccgcatccctggttcatgctgatgacgagaagcgagaggcagccctcagaggcgagcctaggattcagacactgcctgtcgcttctgccctttctagccacaggacaggacctcccccaattagcccgagcaagaggaagtttagcatggagccaggtgatgaagatttagattgtgataacgatcatgtgtcaaagatgtcccgcatctttaatcctcatctgaacaaaactgctaatggggactgccggcgagaccccagggaacgctcaagatctcctattgagagggccgtggcgcctaccatgagcttacacgggtcccatttatacacatcgttacccagtctctag

SEQ ID NO: 61031 - DNA, 891 bp, Artificial Sequence
  Description of Artificial Sequence: Synthetic coding sequence
atgctattcatgaaaatggatttgctgaactaccagtacctggacaagatgaacaataacatcggcatcttgtgttatgagggggaggccgctctaaggggtgaaccccgtatccagacactccctgtggcatccgctctttcgtcgcaccggaccggtccccctcctatctcacccagcaagagaaagttcagtatggagcccggagacgaagatctagattgtgataatgatcacgtttctaagatgtcacgtatcttcaatcctcatctcaacaaaacagccaacggtgactgccggcgagatcctcgggagcgatccaggtcacctattgagcgagctgtggctcctaccatgtcgctacacggctctcacctgtatacatcacttcctagcctggggctggaacagccccttgctctgaccaaaaacagccttgatgcctctcgacccgcaggtctgtcccccactctgacccccggtgagcgacaacagaaccgcccttccgtgatcacctgcgcctctgccggagccaggaattgcaacctgagccactgccccattgcccacagcggatgtgctgcccctggccctgcatcttaccgccgacctccgagcgctgccactacctgcgatccggtcgtggaggagcacttcaggcggagcctaggaaaaaattataaggagccagagccggcacccaactctgtctcaatcacggggtctgtcgacgaccatttcgctaaggctctaggtgacacgtggcttcagatcaaggccgctaaggacggtgcgtcatcttctccggagagtgctagcaggcgcggacaaccagcctcccctagcgcccatatggtttctcacagtcacagtccgtctgttgtgtcttag

SEQ ID NO: 61032 - DNA, 675 bp, Artificial Sequence
  Description of Artificial Sequence: Synthetic coding sequence
atggaaactccattagatgttctgtcccgagccgctagtctggtgcatgctgatgatgagaaacgcgaggcagcccttcgcggagagcctcggattcagactctaccagttgccagtgctctgagctcacatcgcacaggccctcctcctatcagtcccagcaaacgaaaattctcaatggagccaggagacgaggatctggattgtgacaatgaccacgtctcaaagatgtcaaggatattcaaccctcatctaaacaaaacggcgaatggcgactgccggcgagacccacgtgaaaggagccgctcccccattgagcgggctgtggccccaaccatgtctttgcatggcagtcacttatacacgtccttgcccagcctcgggttagagcagccgctggcgttgacgaagaatagcctcgacgcctctcgacccgcaggcctctctccaactctgacaccaggggagcggcaacagaacagaccatccgttattacttgcgccagcgccggagcaaggaactgcaatctgtcgcattgcccaattgcacactctggatgtgctgcgccaggcccagcaagttataggcggccaccctccgcagctactacatgcgatcctgttgttgaggaacactttcgacgatctctaggcaagaactataaggaaccatag

SEQ ID NO: 61033 - DNA, 621 bp, Artificial Sequence
  Description of Artificial Sequence: Synthetic coding sequence
atgaacaaaacagcaaatggagactgtaggagagatcctagagagaggtctcggagcccaatcgaaagagcagtggcacccactatgagtttgcacggtagtcacctttacacttctctgcctagcctcggcttagaacagccgctggcactcacgaaaaattctcttgacgcctcaaggcctgcaggcctgagtcctaccctgacccctggagaaaggcagcagaatagaccgagtgtcattacatgcgccagtgctggggctcggaactgcaatctgtcacactgtccaatagctcactccggctgcgcagctcctgggccagcctcctacagaaggcccccaagtgccgcaaccacctgtgaccccgtggtagaggaacactttcgacgctcattgggtaagaattacaaagagcctgaacctgccccaaatagcgtgagcattaccggaagtgtagatgaccatttcgccaaggcgctgggggacacgtggctgcaaattaaggctgctaaagatggcgcttcttccagccccgagagcgcgtctaggagaggacagccagcctcccccagcgcacacatggtctctcattcccacagcccctctgtggtttcatag

SEQ ID NO: 61034 - DNA, 633 bp, Artificial Sequence
  Description of Artificial Sequence: Synthetic coding sequence
atgatcaaggtgcggaataagaccgctaacggcgactgccggcgagaccctcgggagcgcagccgctcccccattgagagggcagtggcacctaccatgtctctacacgggtctcacctatacacttccctgccctctttggggctggaacagcctctggctctgacgaagaacagcctggatgcttctaggccggctgggctttcccctactctcacccctggggagaggcagcagaatagacccagtgtgataacttgcgcatctgccggagcgcgaaattgtaacctatcacattgtcctattgcccattctgggtgcgctgctcctgggccagccagctacagaagaccaccgtctgcagccacaacatgcgaccccgtggtagaggagcattttcgacggagccttgggaaaaactacaaagagccggaacctgcgcctaatagtgtctctattacaggatctgtggacgaccatttcgccaaagccttgggtgacacctggctacagatcaaggccgctaaggacggtgcgagttcaagccccgaatctgcttcaagacgcggtcagcctgcctctcctagcgcccatatggtgtcccacagccactctccttcggtcgtttcctag

SEQ ID NO: 61035 - DNA, 906 bp, Artificial Sequence
  Description of Artificial Sequence: Synthetic coding sequence
atggccagtagatacgtagcagttgggatgatcctgagtcagacagtggtaggggtgctaggttctttttccgtcctgcttcactacctttcattctattgtaccggatgtcgactgcggtccaccgatctgattgtcaaacacctgatcgttgccaactttctggcgctgcgctgcaaaggagttccccaaaccatggccgcatttggagtgagatacttcctgaacgcgcttggctgtaaacttgtgttctacctccaccgagtaggcaggggagtctcgattgggaccacctgcctgttgagcgttttccaggtgatcactgtttccagccgtaaatccaggtgggcaaaactaaaagagaaagcgccaaagcacgtcggtttctccgttctcctttgctggatcgtctgcatgctggtcaacatcatcttccctatgtacgtaacaggcaaatggaattatacaaatattacggttaatgaggacttgggatactgcagtggaggcggaaacaataaaattgctcagaccctgcgggctatgctgctgtcttttccagacgtgctctgcctggggcttatgctgtgggttagttcaagtatggtatgtatactccataggcacaaacagagagttcagcacatcgacagaagcaacttgagcccccgagcatcaccagagaacagagcgacccaatcgatcctgattcttgtgagtacctttgtttcatcctacaccttaagctgcctgttccaggtgtgtatggcactgcttgataatcctaattctcttctggttaatacttctgccctgatgagcgtatgttttcccactctgtccccgttcgtgctgatgtcttgtgatccctctgtctatcgcttctgtttcgcctggaagagatag

SEQ ID NO: 61036 - DNA, 2178 bp, Artificial Sequence
  Description of Artificial Sequence: Synthetic coding sequence
atgccgccttttctactgttggaagctgtttgcgtgttcttatttagccgcgtcccacccagcctacccctgcaggaggttcatgttagcaaagaaaccatcggcaagatctccgctgcgagcaagatgatgtggtgtagcgctgctgtggacataatgttcctgctggacggctctaactctgttggtaaaggctccttcgaaaggagtaagcacttcgcgatcacggtgtgcgatggtctggacatttctcccgaaagagtgcgagttggcgcattccagttctcgtctacacctcatctcgaatttccactggattccttcagcacacagcaggaggtgaaggccagaataaagcgcatggtttttaagggcggaagaaccgaaacagagcttgccttaaagtatcttttgcaccgtggcctgccaggcggacgtaacgcaagcgtcccgcaaattttgatcatagtgactgatggaaagagtcaaggagacgtggcgttgccctcgaagcagctgaaggaaaggggcgtgaccgtgttcgctgtcggcgtgagattcccgcgatgggaagaactgcacgccttggcctccgaacccaggggccagcatgtcctgttggcagaacaggtcgaggatgccactaatggactcttcagcacactgtcatcgagtgccatttgcagttctgctacacctgactgtcgagtggaagcgcatccgtgtgaacacagaaccttagaaatggtgcgagagttcgcagggaatgcaccatgttggcgtggatccaggagaacgcttgccgttcttgcagcgcattgtcccttttatagttggaagagagtgtttctgactcaccccgcaacctgctatagaacaacttgtcctggcccttgcgattcacagccgtgccaaaacgggggaacttgtgtgcctgaggggctcgacggctaccagtgtctatgcccgttggcctttggtggcgaagccaactgcgcactgaagttaagcctggagtgtagagtggatctactgtttttactggattcaagcgcaggaactacactggacggtttcctgcgggctaaggtcttcgtgaaacgattcgtgagggctgttctgagcgaagactctcgcgctagggttggcgtagcaacttactcccgagagctcctggtcgcagtccccgtgggtgagtaccaggatgtcccagatctcgtatggagtctggacgggattcccttcagggggggtccgacgctcactggctccgctttgagacaggctgccgagcggggattcgggagcgccactcgcaccggacaggatcgcccacggagggtcgtggttctcctgactgagtcacattcagaggacgaggtggccggacccgctaggcacgccagagcacgcgagctgcttttacttggcgtggggagcgaagccgtgcgcgcagagctggaagaaatcaccggcagcccgaagcacgttatggtgtattccgatccacaagatctttttaatcagatccccgagttgcagggcaaactgtgctcaagacagcggccaggctgtcgcacacaggccctagacctcgtcttcatgctagacactagtgctagtgtgggacccgaaaattttgcccaaatgcaatccttcgtcaggtcttgcgcactgcaatttgaggtgaacccagatgtcacacaggtgggcttggtggtgtacggttcccaggtccaaactgcatttggcctagacacaaagccgacccgggctgcgatgctgagggccatctcgcaagccccatacctggggggagtgggttcggcaggcactgccctgttgcatatctatgataaagtcatgacagttcagcgcggagcgaggcctggtgtgcccaaggccgtagtcgtgctcacgggcggaaggggcgctgaagatgcagctgtcccggcacagaaactgaggaacaatggcattagtgtgctggtggttggcgtaggaccagtgttgagcgaggggctgaggagattggcaggcccacgagacagcctgatacatgtagctgcctacgccgacctccggtaccaccaggacgtactcatcgaatggctgtgtggaggtgagtggggtaatcctcacccacagggatgcccccacggtagaccctctgcctag

SEQ ID NO: 61037 - DNA, 1251 bp, Artificial Sequence
  Description of Artificial Sequence: Synthetic coding sequence
atggccactaagggcatgagactgaaatctaccaaagaagttttcccactggctcacgtctgcaatgataccaataagatgaccctgattaatccgcagggcgcaaaactcaacatctacaagcgtaaagtcgaacaggcgattcagtcatacgaaaagcgtctgaataaaatcgtctggcgcgcactcagtcaagaggaaaaggagaagctcgacgccaataagccaatacagtatctggaaaacaagaccgtgctgaatcaggccctcgaaaggctgaactggccaatcagccttaaagaactatccatgctggaatctgagattctggccggaaagatgtacatccaacaggccatggagttgcaagaggccgctaaaaagaactacgcaaacaaagctccaggagagcagcagaagttgcagggtaatcctacaaaaaagactaaatctaagcgcccagatcctcttaaaggacagaaagtaatcgcccgatgcgacgagaacggcttctattttcctggagtagtaaaaaagtgtgtctcaagaactcaggcactggtgggattcagctatggcgacaccaaagtggtgtccacctcgtttatcacaccagttggcggagctatgccatgccctctgttgcaggtgggtgactatgtgttcgctaaaattgtaatcccgaagggcttcgacttctacgtgcctgcgatagtgatagctctcccaaacaaacatgtggcaactgagaagttctataccgtcctcaagtgcaacaaccggagggagttttgcccccgatccgctttgatcaagattagtcaaaacaaatacgctctgtcatgctctcacattaagagccccccaattcctgaggacccagaggttgaggacgtggaggctcgcaattcagctttcctcttctggcccctgaaagaggccgacacccaggactcaagagaaccgaggcgagagaagccgagacggaagaagcggccagccaagcagccacttcagcaggccgctccttccgactctgatggcagtagccacggcatcagtagccatggatcctgccagggaacacatccagagcccagaacagcgcacctgcactttcccgctgctgggcgtcttggcctgtccagccacgccatcatagctacacccccaccgagggccgctttaccttgcacactccaggcaacccattccagtaaggggctgcgctcagttcccgagaccctgtag

SEQ ID NO: 61038 - DNA, 1875 bp, Artificial Sequence
  Description of Artificial Sequence: Synthetic coding sequence
atggagaagtcaggcccatcttctaccatctcagaacagcaactccagcgccaggagggatggataaacaccaaaacagacctggctgagcagtctctaatctccagcgaaaagtggcttcagctgcacgggctcaaatctaacaagcttactttgaagcagattctatctcagattggattccctcattgcgaagattacgtggcgagccttggcagacctgtcgcctctaggtatgctgacgggctttttccgcaactgtatagggccgaggacgggagggtgtacaacctgactgcgaagtcagagctgatctatcagtttgtggaacacttaacacaagctgtggaaagttataagcagcgaatggattggctcacatcgaagtcaagacaaatctttggcgtgatcctcgagcaatgtgtgaccatcgtgctcgacttcggagggatcttggagggcgaactcgacctgtgtagggaagctctcacaatggttctgcaagagcaagtggcccatattaccgaatttaacattatacgcgtgtcacaagagccagtgaaatggcaggaaaacgccacccccgtcacggaacaaagcatcgccacagcaatcagctgggtggagaagctgaccgtggagctgacagtctctgaagccggacgactggacgcactgctggaggcagggagggacaagacgatcgagtccatctactatttcgtggtaggggatgtcccggaggagagcaaggagttactccttcagagagcccttgaaatcccttgcccggtctacacggtgagctttaacgcgaggggtgaggggactatagcgttcctgaaggatctgagcgctaagacgcactctcggtttcatgcattcgctgagcgcactgagtgtgtagagttccctgcattcagcacaaaagatggcgataatgtgatgacatggaactctagaaaactgaagggcaaactacctcccggtgcgggtgtgcgggaggatgtcttcctcgtctggcaagagatggaagaggcctgctcaactctcgcccaaatccaaaggctcgtggctgagcctccaaaaccagacgtggcaaccgtcgactgtgagtctgagacgacttcagtggagatagcaagcaatcctgaggacacttgggattccaagacatggctgcagaagtatgggctcaaggctcaaaaactgtcgctttacgatgtcctagcagactgctccttcagacatgcagatggtgttgtcgacattaaggctaaacctgaaaatgagtctgtgcagacatccgccgaaacaaataaaaaaaccgtgcatgcaaagtactgttcacgcttcgtgcacgctccttggaaagatggctctttggtccacgtgaatattaccaaggaaaagtgcaaatggtattctgaacgcatacataccgctctagcgaggatccggcgtcggatcaagtggttacaggatggtagccagagtctgtttgggaggttgcacaatgactgtatctacattctcatcgacacatcccactcgatgaagtcgaaactggatttagtgaaggataagatcatccagttcattcaggagcagctcaaatataagtccaaattcaacttcgtgaaatttgacggacaggccgtcgcctggcgcgagcagctagctgaggtgaatgaggacaatctagagcaggcacagagttggattagagatatcaaaattggatcctcgacgaacactcttagtgcactcaaaacggcgtttgctgacaaggagacacaggcaatttacctcctgaccgatggtagacccgaccaaggcacatctagccatctgctgcttacggctgctgtgtag

SEQ ID NO: 61039 - DNA, 1428 bp, Artificial Sequence
  Description of Artificial Sequence: Synthetic coding sequence
atgtggcggctctggggggatttgtggctgttgggcatgctaatggtgtgctttcattcaagcacagagcagaaaatggccgagtacaccatggtaagtcaggaaccggtgaagtggcaggagaatgccacgccagtgactgagcagtcaattgctaccgcgatctcatgggtggagaagctgaccgtcgaactcactgtttcggaggctggcagattggacgctctcctggaagccggtagagataagaccatcgagtctatctactacttcgtagtcggtgacgtgcccgaggaatctaaagagttgcttctgcagcgggcattggaaatcccctgcccagtgtatacagtttcatttaacgccagaggcgagggtactattgcctttcttaaagatctctcagctaagacacattcccgatttcacgcgttcgcagagcggaccgagtgcgttgagtttcccgctttttcaaccaaggacggggataatgtaatgacgtggaacagcagaaagcttaagggtaagttaccacccggagcgggagtccgcgaggatgtgttcctcgtgtggcaagaaatggaggaggcctgctccacactggcacagattcaacgcctcgtcgcagagccgccaaaacccgatgtcgctacagtcgattgtgaatcggagactaccagcgtcgaaatagctagtaatcctgaggacacttgggactccaagacatggctgcagaaatacggtctgaaagcacagaagctgagtctatatgacgtcctagccgactgctcgttccgccacgccgacggcgttgtagacattaaagccaagcccgagaacgaaagcgtgcaaaccagcgccgagacaaacaagaagacagtgcatgccaagtattgttccagattcgtccatgcgccatggaaagatggtagtctggtacacgtaaatatcactaaagaaaagtgcaagtggtactcagaacggatacacaccgcacttgccaggatcaggcgaaggatcaagtggctgcaggacgggtcccagagtctgtttgggagacttcacaacgactgtatctacatcttaatagatacgtcccacagtatgaagagtaaactagacctcgtgaaggataagatcatccagttcatccaggaacaactcaaatacaaaagcaagtttaactttgtgaaatttgatggtcaagccgtggcctggagagagcaattagctgaggtgaatgaggacaatctcgagcaggcccagtcctggatcagagacatcaagatcgggagttcaaccaacacccttagtgccctgaaaaccgcatttgccgataaggagacacaggcaatctatctactcaccgacggcagacccgaccaacaacctttcaaggagggagttagcgtcctgtcgcatagatag

SEQ ID NO: 61040 - DNA, 3885 bp, Artificial Sequence
  Description of Artificial Sequence: Synthetic coding sequence
atggaaaagagtggtcctagttcaaccattagcgagcagcagctgcagcgccaggaaggttggataaatactaaaacagacctggccgagcagagcttaatatcctcagagaaatggctacagctgcacgggttgaaaagcaataagctcacactcaaacagatactctctcagatcgggtttccccattgcgaagactacgtggccagtttgggccgtcccgtggctagccgatacgcagacggtctgtttccccagttgtatagagcagaggacgggcgagtgtataacctcactgctaaaagcgaactcatttatcagtttgtcgaacatctcacccaggccgtggagtcctacaagcagcgcatggactggctcactagcaaaagcagacagattttcggggtgattctggagcagtgtgtcaccattgtattagactttggtggcattcttgagggcgaactggatctgtgccgagaggccctcacgatggtgctgcaagagcaggttgcacatattactgaatttaacatcatacgggtgtcccaggagcccgttaagtggcaagagaatgccacgcccgtgaccgagcaaagcatagcgaccgctatctcatgggttgaaaagctgactgtggagctgacagttagcgaggccggacggttggacgctctgttggaagcaggtagggacaagactatcgaatcgatctattatttcgtggtcggagacgtgcctgaggagagcaaggagctcctgctgcagcgagccctcgaaataccatgccctgtgtatacggtgtcctttaacgccagaggagaagggaccatcgccttcctaaaagacttatctgctaagacccactctaggttccatgctttcgcagaacgaaccgaatgtgtggagtttccagccttctcaaccaaagacggggataatgtcatgacctggaattctcgaaagctcaaagggaagttgccgcctggagccggagttcgagaagacgtctttctcgtgtggcaggaaatggaggaagcttgtagtacactcgctcagattcagcgcctggtggccgagcctcccaagcctgacgtggccaccgtggactgcgagtccgagacaacttctgtagagatcgccagcaatccagaagacacctgggacagtaagacatggttgcagaaatatgggctgaaggcccagaagctctctctgtatgacgtgctggccgactgcagtttccgacacgccgatggcgtagtcgacataaaggccaagcccgagaatgagagtgtacagacgagtgccgaaactaacaagaaaactgtccacgcaaagtactgtagcaggttcgtacacgctccatggaaagacggttcacttgtgcatgtaaacattacaaaggaaaaatgcaagtggtactctgaacgcattcacacagcattagctcgtatcaggagaaggataaagtggctacaagacggttcgcagtccctatttggacgtctccacaatgattgcatctatattttaatcgatacatctcatagcatgaaaagcaaattggatctcgtgaaggataaaatcattcagtttattcaagaacagctgaagtacaaatcaaaattcaacttcgtaaaattcgacggtcaggccgtcgcttggagggaacagctggctgaggtgaatgaagacaacttggagcaggcccagtcctggatccgcgacatcaaaattggcagttccaccaatacactgagtgccttaaaaactgcatttgccgacaaggaaacacaggctatctacttactaactgatggtcggcctgaccagcctcctgagaccgtgattgatcaggtcaaaagatttcaggagatcccaatttacactatcagctttaactacaatgatgaaatcgccaaccgcttcctgaaggaggtggccgcactcactggcggagagttccacttctacaatttcggctgtaaagaccccacaccacctgaggccgtgcaaaatgaagacctgacgctcctggtaaaagagatggagcagggtcactctgatcttgagaaaatgcaggatctctacagcgagtcactcatcatggattggtggtataacgcggaaaaggatggcgacagcaaacatcaaaaagagatttgcagcatgatcagtacccccgaaaagtgcgcaaagccgcagagcgatgtggattcaacccaaacatcgtccctcaatatgcttaaagggccttggggactttctgatcaaaaggtccagaaaaagaaggtcttgcacgcggaatcaaccaaaacatccctgctgcggagtcagatgtccagtctgagaagttctgcttgctccgagcggaaggacgggctcagcaacgcctcttcaaggcggaccgcactgtcggacaaagagatgtccatcctgttagcagaggagtggcttgatgataaatcttcggagaaggtaacccgggaagggagccaggtatatgatcatgacagctcagatgtgtcttcggagaactggctgaagacttacgggctcgttgccaaaaagctgacgcttatggacgctctttctgtggcggcagtgccacacagttcgacatacgtcccagtgctcgataagcacgtggtttcaaaagtattcgatgaagtgttcccattagctcacgtttgcaacgataccaacaagatgacactcataaaccctcagggagccaagttgaacatctacaagcgaaaggtggaacaggcaatccagtcatatgaaaagcgactgaacaagatcgtttggagggcgctgtcacaggaagagaaggagaagctggacgccaacaagccaatacaatatcttgagaacaaaacggtgttgaaccaggccttagaacgtttaaactggccaatctcgctcaaggagctctctatgcttgaaagcgaaattctcgctggaaaaatgtacattcagcaggctatggaattacaagaagccgcaaagaagaactacgcaaacaaggctcctggcgagcagcagaaattgcagggcaatcccactaagaagaccaagagcaagaggccagacccgttaaaagggcagaaggttatcgcacgatgtgatgagaacggcttctacttccccggtgtggtcaagaagtgtgtatctcggacgcaggccctagtgggttttagctatggcgatacaaaggtggtctcaacttcatttataactccagtgggcggagctatgccatgtcctctgctgcaagtgggggattacgttttcgccaagattgttattcccaagggcttcgatttctatgtgcccgcaatcgttattgcgctgccaaataaacatgttgccaccgaaaaattttacacagttctgaagtgtaataatcgtcgagaattttgtccccgttcagccctgattaaaatttcacagaacaagtacgctctgagttgctcacacattaagtccccccctatacctgaagaccccgaggtggaagacgtggaggcgaggaattctgcatttctcttctggcctctaaaagaggctgatactcaggactctagagaaccacgtcgggagaagcccagaagaaagaagcgcccagcgaagcagcctttgcaacaagcagctcccagtgattcggatggcagtagtcacgggataagctcccacggctcatgtcagggaacgcaccctgagccgcgtacggcccacctccatttcccagctgccggaaggctcggactttcttcccatgcaattatcgctacccctccgcctagggcggctctgccctgtaccttgcaggcaacccactccagcaagggcctgcgctcggtgcccgagacgctgtag

SEQ ID NO: 61041 - DNA, 3729 bp, Artificial Sequence
  Description of Artificial Sequence: Synthetic coding sequence
atgcctggcctgtactgcccttcctcttggaccccactgcctcttaccgatagctgggtcagggcgtgcgcgaatggcccatgcctgagcgtccgcgcaagactgacttatcgcaacccgcagcctcagcctgtggacggtgtcttcgtgtaccctctggcagaggctgaagtggttagcgggttcgaggccgaggcggctggtagaagagtgagcttccaactgcagagcagaagaagatcccaggccgcatgctgtagagcgctcgggcctggtttagggaccccaacacccaggcgatgtgcccaaggacatctggttctggacttagcccaggctagaagtacccttgtgttgccaaccggcatcattgccgctgccggtaccatgacagtgacactgcactcaagcagggagctgccaagtcggcctgatggagtgctgcacgtggccttgcctaccgtcttgaccccgctcgctccccctggacccccaggcccacctagacctcccggactgtgtgacgactcacctacctcatgtttcggcgtggggtcgctccaggaggaaggactcgcctgggaggagctggctgcacccagagatgttttttccggccctgccagatgccccgctccctacacttttagcttcgaaatgcttgtgaccggcccttgtctcttagctggtctggaatctccctcccacgccctccgcgcagatgccccacctcacgcctcctcagcggctactatatgcgtcacgctagccgaagggcatcattgcgaccgcgcactcgaaattctgttgcatcctagtgaaccacaccagccgcatctgatgcttgaggggggttcactgagcagcgcagagtacgaggcgagggtcagagctcggagggacttccagcgactccagcgcagggacagcgacggggatcggcaggtatggtttttgcaaagaagattccacaaagacattctgctcaatccggtgctggcattatctttctgtcctgatctcagctccaaacctggccatctgggaacagccacccgtgaactgctgtttctgttggattccagtagcgtggctcacaaggatgccatcgttctcgccgtgaagtcacttcctccacagactctcattaatctggccgtgttcggcacactagtccagccactgttcccggagagcaggccttgttccgatgatgctgttcagctcatatgtgagtcgatcgagacactccaagttccatctggcccacccgatgtccttgcagctctggactgggcggtcggacagccccagcatagagcttaccctcgccaattattcttgctgaccgccgcatcccctatggctgcaaccacccacaggactcttgagctcatgaggtggcatcgagggaccgccaggtgtttctctttcggattgggccctacgtgccaccagctgctccagggtctcagtgctctatcacgaggccaagcctatttcctccggccaggccagagactgcagcctatgcttgtgcaagctcttcggaaggctctggaacccgcactctccgatatctcagttgattggttcgtacctgatacggtcgaagcgttgctgactccgagggaaataccagccctctacccaggggatcaacttttaggctactgttcactgtttagggtggacggattccgatctcgcccaccaggcggtcaggagccaggctggcaaagtagtgggggatctgttttcccttccccagaagaagcacccagtgcagctagtcctggcactgagcccaccgggacgtccgagccactgggcacaggaactgtttcagccgagctgagcagcccttgggctgctcgcgatagcgaacaatcgaccgatgccctaaccgaccccgtaactgatcccggaccaaaccctagtgacactgccatctggagacgaatcttccagtccagctatatacgcgagcaatacgtgcttacacactgtagtgccagtcccgaaccgggacccggatccaccgggagctccgagtcccccggatcacaggggccagggtctccagaaggcagcgccccactagagccaccctcccaacaggggtgtcgcagcttggcctggggagagccggcaggcagccggtcctgtccgcttccagccccaacccctgccccatttaaagtcggtgctctttcaaccgaagtgctgggcaggcaacaccgggcagcccttgctggcagaagcctctcctctccacctggtagagctaatcaggtcccagggaggccaagaaagccgtcgctgggggcaatcctggacggaccgtcaccagaacctggccaacagctcggccaaggcctggacgacagtgggaaccttctgtctcctgcccctatggattgggatatgctgatggagccgccttttctgtttaccgccgtgccaccatccggtgagttggcccctcccgcagtgccgccacaagccccacgctgtcacgttgtaatcaggggcctatgtggagaacagcctatgtgctgggaagtcggagtaggacttgagacactgtggggtcccggagatgggtcgcaaccaccctctccaccggtgcgggaggcagcatgggatcaggcccttcataggctcacggccgctagcgtagttcgtgacaacgaacagctggcattaaggggcggtgcagaaactactgcagatagagggcatgcacggagatgctggctgagggccctgcaaacaagcaaagttagctctgcgccttcctgttttacgtgtcccgtggccgtggacgccacaacacgcgaggtcttgcccggtgcattgcaagtgtgcagttccgagcccgctgagccgccaggcacaccacccgctagccattctcacctggacgccgctccgttaccaacagtagtgtacagcaaaggcctacaacgagggagtcccgcaggagcttgggacagcgatcagaacggcaactctaagcgtgcacttggggatcccgctacccccaccgagggtcctcggaggcctccgccaagacccccttgtaggctgtccatgggtcggagacacaagctatgctcacccgatcccggtcaagcaaataacagtgaaggaagcgaccacgattacctccccctcgtaaggctgcaggaggcaccaggatctttcaggctggacgcacctttttgcgctgctgtcagaatctctcaggagcgactgtgtcgcgcatcgcctttcgccgtccaccgtgccagtcttagccctacctcagccagcttgccctgggctctgctagggcctggcgttggccagggcgactcagcaactgcctcctgtagtccaagtccttccagcggaagcgagggcccagggcaagtcgattctggtcgaggatccgacaccgaggcatccgaaggcgctgaaggtctggggggtacagatctgcggggaagaacctgggccaccgccgtggccctggcttggcttgagcaccgctgcgccgcagcctttgatgagtgggagctgaccgctgccaaagctgattgttggctgcgagcgcaacacttgcccgatgggcttgaccttgccgctctcaaagccgctgctcgaggactgtttctactgcttcggcactgggatcagaatctacaactgcacctactttgttactctcccgctaacgtatag

SEQ ID NO: 61042 - DNA, 2676 bp, Artificial Sequence
  Description of Artificial Sequence: Synthetic coding sequence
atgctcccgacagaggtacctcaatcccatccgggaccatctgcactcttgctcctgcagttgcttctcccccctactagcgcattctttccgaatatctggagcctgctggcggctcccggttctatcacgcaccaggacctcaccgaagaagccgcactcaacgtgacattgcagttattccttgagcagccaccgccaggcagacctccgttacgcctagaggactttctggggcgaaccctgttggccgatgaccttttcgccgcatatttcgggccaggctcttctcgccgatttcgcgcagctttgggggaggtgtctagggctaacgcggctcaagatttcctaccaacctccagaaacgatcccgacttacattttgacgccgaaagactcggccaggggagggcacgtctggtcggagcattaagggagactgtggtggcagccagggctttagatcacacactcgccaggcagcggttgggcgcagcattacatgccctgcaagacttttactcccactctaattgggtggaacttggagaacagcagccccaccctcaccttctttggccgaggcaggaactgcagaatttggcgcaagtagccgatccaacatgtagcgattgcgaagagctgagctgccctaggaattggctcggattcaccctgcttacaagcggttatttcggcactcacccccctaaaccacctgggaagtgttctcacggaggacattttgataggagctcaagtcagcctccacgcggagggatcaacaaagacagcacatccccagggttttccccgcaccatatgcttcatctgcaggccgctaaactggctctgttggcttctatacaggccttttcactcctaagaagcaggctgggggacagggatttcagcaggctgctggacatcacccccgcatcttcactttccttcgtgctggatacgaccggctccatgggcgaggaaatcaatgctgcaaaaattcaagccagacacttggtggagcagcgaagaggtagcccaatggagcctgtacattacgttttagtgccttttcacgatcctggctttggtcccgtgttcaccaccagcgacccggactcgttctggcagcaactgaacgagatacacgccctagggggtggagacgagcccgagatgtgtctgtccgccctacagttagcactcctgcatacccccccattgtctgacatctttgtgttcactgacgcctcacccaaggacgcttttctgacaaaccaggtggaatcccttacccaagagcgacgctgcagagtcacgtttctggtaacggaggatacgagccgggtgcaaggtcgggcacgcagggaaatcctatccccactgcgctttgagccgtacaaagcagtggcacttgcaagcggaggagaggtgatttttaccaaggaccaacacattcgtgatgtagctgccattgtcggcgaatccatggccgcactggtgactttgccactggatccccctgtagtggtacctggtcaaccccttgtgttcagcgtggacggactcttacagaaaattactgttcgcatccacggcgacatcagtagtttctggatcaaaaatccagctggcgtatcccagggacaagaagaaggaggcggtcccctaggccacacgagacgtttcggtcagttctggatggtgacaatggatgacccaccacagacagggacctgggagattcaggtgactgcggaagacacgccaggcgtgagggtccaagctcagacttctctggatttcctgttccacttcggaataccaatggaagacggcccacatcccggactctacccgctgactcagccggttgccggtctgcagacccagttgttggtggaagttaccgggctgggctcacgcgcaaacccaggcgacccccagccccatttctcccacgtgattctgagaggcgtgcccgaaggggctgagctggggcaagtccctttggaacccgtcggacccccagaacgcggtctcctggctgctagcctttcacccaccctcttgagtaccccaaggccattcagcctagagctaatcgggcaggacgccgctggtcggaggttacacagagccgctccacaacccagcactgtagtccccgttctgcttgagctttctggcccttcaggcttcctagctcccggatctaaagtccctcttagtctgagaattgccagtttttcaggcccacaggacctagaccttagaacttttgtgaacccaagtttctcattgacaagtaatttatctcgagctcacctggaactgaatgagtccgcttggggaagattatggctggaggtgcctgatagtgccgctccagattccgtagtgatggtgactgtgaccgccggaggaagggaggctaatcccgtcccacccactcacgcatttctacggcttttagtgagcgcccctgcaccccaggatcgccatactacacccaccggctcctcggaccccatattaaccacagcgaccccggcattctcaccatttactctggtggcccagggccgtgccggtgcaggcttggccgcaggcagcccttggtgggggacagtcggaggagtcctgctcttgctgggcctggcatcctggtag

SEQ ID NO: 61043 - DNA, 2067 bp, Artificial Sequence
  Description of Artificial Sequence: Synthetic coding sequence
atgctacccactgaggttccccagagccaccctggaccaagtgcactcctcctcctgcaactgctgttgcctcccacatccgccttcttcccaaacatttggagcctgttggctgcccctggcagcatcacacatcaggatttgaccgaggaggcagcgctgaatgtgacactgcagctgttcctggagcaaccaccccctgggaggccacccctgcggctggaggacttcctgggacgaaccctgctggcagacgatctgttcgctgcttacttcgggccagggtcctctcggaggtttagggctgctttgggggaagtttcacgggcaaatgcagcccaggattttctgccgactagtaggaatgacccagacctgcattttgacgcagagcggctgggacaggggagagcccgtctcgtgggcgcactgcgggagaccgtggtggccgctcgtgcactagaccacacactggccaggcaaagactgggagccgctctacatgcacttcaagacttctacagccatagcaattgggtagaactgggggagcagcagccccacccgcacctgctctggcctagacaggaattgcaaaatctcgcacaggttgcggatcctacctgtagtgactgtgaagaactttcttgcccacggaattggctgggctttacgctgctgacatcagggtactttggtacccatccccctaagccccctggcaaatgctcccacgggggacacttcgaccgctcctcgagccaaccccctaggggcggaatcaataaggacagtacatcacccggtttctccccccatcacatgctccatcttcaggctgcaaagctggccttgctagcgagcatccaggcctttagccttctgcggtccagactcggcgatcgcgacttttccagactgctggacattacaccggcttcttccctctcctttgtactcgatacaaccggaagcatgggcgaggaaatcaacgccgctaagattcaggcacgccatctagtcgagcagcgcaggggttccccgatggaacccgtccattatgttctggtcccatttcacgatccgggtttcggacctgtgtttactacctcagaccccgactccttttggcagcagctgaatgagattcatgcgctgggcggaggcgatgagcccgaaatgtgcttatccgccctccaactggcacttctgcacacgcctcctctgagtgatatctttgtgtttaccgatgcttcccctaaggacgctttcctgacaaaccaggtggagagcctgacgcaagagagaaggtgccgagtaacattccttgtgactgaggacacatcgcgcgtacaagggcgtgccaggcgggaaattctgtcccctctcagatttgaaccgtataaggctgtggctctggctagcgggggagaagtaatctttacgaaggaccagcacattcgagacgtggccgcaatcgttggtgaaagcatggcagctctcgtgacattgcctttagatccccctgtggtggtgcctggccagccgttggtgttttccgtagacgggttgctgcagaagatcacagttcggatccatggcgacatttcaagcttttggatcaagaaccccgcaggggtgagtcaaggacaggaggaagggggagggccactagggcatacccggagatttggacaattttggatggtgacaatggacgacccccctcaaacaggcacttgggagattcaggtgacggctgaggacacccctggtgtgagagtgcaagcccagacatccctagacttcctgttccactttggtatcccaatggaggatgggccacatcccggtctgtaccccctgacccaacccgtggcaggactgcagacgcagcttctggtcgagtcccagtcatgggggtcctccgccgcttttttgccgagacaccccagccggggtcctagagggtgtagaacacgtccaggagcactgggtgctcgagggacatccggcgcaaggtcgcccagatccctcgcagtagctcatgctgctgttaacccttag

SEQ ID NO: 61044 - DNA, 2559 bp, Artificial Sequence
  Description of Artificial Sequence: Synthetic coding sequence
atgctgcccacagaggtgccgcagtcccacccgggtcccagcgcactgctgctgcttcaactgttgctgccccctacaagcgcctttttccctaatatctggagcctgctggccgctcctggaagcattacacatcaagacctaaccgaggaggccgctcttaatgtgacattgcagctgtttcttgaacagccaccaccaggccgaccacccctccggctcgaggacttcctgggacggacgctccttgccgatgatttgttcgccgcttacttcgggccaggtagcagcaggagattccgcgcagctctaggggaagtctcacgcgcaaacgcagcgcaagacttccttccaacttccagaaacgatcccgatttacattttgacgcagagcggctggggcaaggacgggcaaggctcgtcggtgcccttcgcgagacagtagtggccgcacgagccctggaccacactcttgctaggcagcgtctcggtgcagctcttcacgcgctccaagacttttactcccactccaattgggttgaactaggggaacagcagcctcatccgcatctgttgtggcccagacaagagcttcagaatcttgcacaggtcgctgatcctacatgcagcgactgcgaagagctaagctgcccacggaactggttggggtttacactcctcacgtccggttatttcggaactcacccacccaagcctccagggaagtgcagtcacggcggacacttcgaccggtcatctagtcagccgccaagagggggaattaataaagactccaccagtccagggtttagcccccaccacatgctacacctgcaagccgcaaagcttgccctgcttgcttctatccaggccttctctcttctacggtcacgcctcggtgatagggatttctctagactgctggatataacgccagcctcctccttatcctttgttttggatactaccggttccatgggcgaggaaattaatgcagcgaaaattcaggcgaggcatctggtggaacagcggaggggctcaccgatggaaccagtccactacgtcttagtccccttccacgatcccggatttggcccagtcttcaccactagcgacccagacagcttctggcagcagctcaatgagatccacgctcttggcggaggcgatgagcctgagatgtgtctttccgccctgcagctcgctctgctgcataccccccctctgagtgatattttcgtgtttacagacgcctcacctaaggacgcctttctcacaaatcaagtcgaaagtctgacccaagaaaggcgttgtcgggtcacatttctggtgacagaggatacttctagagtgcagggcagggctcggcgtgagatactgagtcctctgcgctttgaaccttataaagctgtggccctggcttctgggggagaagtcatcttcacaaaagatcaacacattagggatgtggccgctatagtcggcgagagcatggccgcacttgtgaccctgccgttggatcctcctgtagtcgttcccggtcagccattagtgttcagcgtagatggattattgcagaagataacagtgcgcatccatggagatattagttcattttggattaagaatccagcaggagtgtctcaaggccaggaagagggagggggacctctgggccatacaaggcgattcggccaattctggatggtcacaatggatgatcctccacagacaggcacttgggagattcaagtcacagcagaggacactccaggggtgagagtgcaggctcagacctcgttggacttccttttccacttcggcatacctatggaggatggaccacaccctggcctgtatccactgacccaacccgtggcaggcctgcagacccaactgctcgtggaggtcacagggctcgggtctagagctaaccctggagatcctcagccacacttctcccacgtcatcctgaggggcgttccggaaggtgcagaactgggccaagttcctttagagccggtggggccacccgaacgcggactgctagctgcctcactgtcgcctacactgttgtctacccccagaccattttctttggaattaattggccaggatgctgccggaagaagattacacagggcagcaccacagccgtctacggtggtgccagtgctcttggagctgtccggcccttcaggattcttggcccctggcagtaaggtgcccctgagcttgaggattgctagtttttccgggcctcaggatctcgacctccgcacctttgtgaacccctcattctctctcacctctaatctgtcaagagcgcaccttgagctgaatgagtcggcatgggggaggttgtggctggaggtcccggacagcgccgctcccgatagcgtggtgatggtgacagtaacagcgggaggaagagaggccaacccggtccccccaacgcatgcttttctcaggctgctggtttccgccccagcccctcaagttaggaaccactattttccgtctcagggccctgctcatcatccatatcgtctaatatag

SEQ ID NO: 61045 - DNA, 2835 bp, Artificial Sequence
  Description of Artificial Sequence: Synthetic coding sequence
atgtcgctgactataagggctccatctgtggattaccgaaacactctgggcctttgcgggaccttcgacgagaaccctgagaacgatttccatgataagaatggtatgcaaatcgaccagaactttaacaactacgttgctttcataaacgaatggagaatccttcctggaaaaagtatgtccgatacgcttcccgtatctatgacgagcccgggaaagccctcttactgttcatgctccctggacacagctgcttatcccagtagtgaagatttggacagtgtgagtcgttcggagattgccttaggatgtaaggacctcaatcacgtctccctttccagcctgattcccgagctagatgtgaccagtgagtacatcaattctgatacgctggtaagggaaatcaacaagcacacttctcctgaggagtataatctgaacttgttcttacaggagaagaagcatattaacctgacgaagttgggactgaacgttcagaagcaccccggtaacgagaaagaagatagcctccagtacctggcaaacaagaaatacacacagggccgaggttcccatagccaggaaatgaggtataaccgtcagaaccggtggaaacggcaaaacttccatgagttccctcctctgtttgcctttccttccctgagccaaaccgatctggaggaattgacatatttcttccctgaagatcacgccgaggatgtgcaacaagaatttttcccttcctggcccactccgtccggattgaccgaatacagtactctaaccttatgccaagagacgctggctaatagctccataggtcgcctttgtctagcctttctggggaaacgtctcgactccgtgattgaaatgtgtgttaaagatgtgctgctgaaagacgatctatcttgggccgaagctggagtcgcactgctcgagaacgagtgcgaaaagaggatcgttgaggagggcaaatataatactgaggaatacgggacatctattgaggacatcctgagcgtcctaaagtgccccaatctgtgcagcggaaatggccaatgtatggaatggggttgcgcatgtagcccatcattttcttcttacgattgttcggatagctacgataaagcccctgagataacagagctcggaaatgccggattctgtgatgtgcagaaatacaactgcatgatggtaagagtgttcggcaagggctttaaggaactgccctcaatcaaatgcgaggtgactaaacttcaatacaactcctctgagtggatgccaggcgagcccatctacacacagaccgtattccataacagtagagctgtggattgccaacttccaaccgatgtgcaacagtttgacacaatggacctcgtgggcggaaaaccaaccggcaaatggcagctaaaggtctccaatgatggatataagttttcgaatccaaagataacagttatttatgatggcgcatgccaagtctgcgggttgtacaaaaatgacagctgcacaattaaggagaatgtgtgcattatagacggactttgttatgtcgagggcgataagaatccgacctcaccctgcctgatttgtcgcccaaagatatctaggtttacttggtcctttctcgagaacaaccagcccccagtgatccaggcgctccaggacaagctgcagacattctacggcgagaacttcgagtaccagtttgtggctttcgatcctgaaggttctgacatccactttacgcttgatagtggccctgagggtgccagcgtctcctccgcaggcttatttatgtggaaaactgacctcctgaccacgcagcagattactgtgaggctgaacgatgattgcgatgctgaaactagagtgacaatagaggtaactgtgaagtcctgcgactgcttgaacggtggttcatgtgtgagcgaccggaacttttcccccggatccggcgtgtacttgtgcgtgtgcttacctggcttccatgggtccctgtgcgaggttgacatatccggatgccagagcaacccatgtggccttggttcctacattagtggcttccactcctattcttgcgattgtcccccagaactgaaggtggagacacagtttgttaaccagttcactacacaaaccgtcgttctgacacggtccgataagagcgtgaacaaagaggaggatgacaagaatgcccagggccgaaaaaggcacgtaaagcctacatccggtaacgcgtttaccatttgcaaatatccctgtggtaagtcgcgtgagtgtgtggctcccaacatctgcaagtgtaagcctggatacatcggctctaattgtcagaccgctttgtgcgacccagattgcaaaaatcacgggaaatgtataaaacctaacatctgtcaatgcttaccaggacatggaggagcgacatgcgatgaggagcactgtaaccctccctgccagcacggtggtacgtgcttagccggaaacctttgtacctgtccctatggattcgtgggacccagatgtgagactatggtgtgcaataggcattgcgagaacggcggacagtgtcttacaccagatatctgtcaatgcaagcctgggtggtatgggccaacctgctccactgcactctgcgacccagtatgtctgaacggtgggtcatgtaacaaaccaaacacctgcctgtgccctaacggatttttcggcgaacattgtcagaatgccttctgccaccctccctgcaagaacggcggacactgcatgaggaataacgtctgtgtatgccgagaaggctacactggaagacgctttcaaaaacgccatttatag

SEQ ID NO: 61046 - DNA, 513 bp, Artificial Sequence
  Description of Artificial Sequence: Synthetic coding sequence
atgcccggtggagcttgtgtgttggtaatagccctgatgttcctcgcctggggagaggcacaagagtgtagccctggcggtcaccagttcctcagaagcccgtaccgcagcgttagattcgactcatggcatctccagcaaagcgccgtccaagatctcatttgtgatcattctctgtcccccggatggtatagattcctgatcctggaccgaccagctgagatgcccactaagtgtgtcgagatgaatcattgcggcacccaagccccaatttggttgtcacttcgggacagcgagaccctcccttctcccggtgagatcaaacagctaactgcctgcgcaacttggcagttcctgttttctaccacaaaagactgttgccttttccagattcctgtgtcagttagaaattgtggcaactttagtgtgtacctgctgcagcccacccaagggtgtatggggtattgcgctgagggctttttcgcgaaaatcgtcaagtctccacacacctag

SEQ ID NO: 61047 - DNA, 4524 bp, Artificial Sequence
  Description of Artificial Sequence: Synthetic coding sequence
atgacaaccgtagtcgtccacgtcgactcaaaagcagagctcacaactctgcttgagcaatgggagaaggagcacggttccggccaggacatggtgcctattctgacccggatgtctcagctgatagagaaagagaccgaagagtaccggaaaggtgatcccgaccccttcgacgaccgacatccgggaagagcagatcccgaatgtatgcttggtcacctcttgcgcatcctcttcaagaatgacgactttatgaacgccctcgttaacgcgtacgtgatgacttcaagagaaccacctttgaacacagccgcatgtcgcctcctacttgacataatgcccggacttgagacagccgtggtcttccaagaaaaagaagggatcgttgagaacctgtttaaatgggccagagaggccgaccagcctctgaggacgtactcaaccggactgctagggggtgcaatggaaaaccaggatatcgccgctaactaccgcgatgagaatagccaactcgttgcgatcgtcctaaggcgcctccgggagttgcagctccaggaagtggctttgcgtcaggagaacaagcggccatctccccgtaaattgtcaagtgaacccctgctgccactggacgaagaggcagttgacatggactacggggacatggccgtggacgttgttgatggggatcaggaggaggcatccggtgacatggaaatcagctttcatctggattcagggcataagacctcgtcaagagtaaattccactacgaaaccagaggacgggggtttgaaaaagaacaagtctgccaagcagggcgacagggaaaattttcgaaaggccaagcaaaaactcggcttttcctccagcgacccagataggatgttcgtggaactgtccaacagcagctggtccgagatgagtccctgggtcatcgggaccaattacactctttacccaatgacccctgccattgagcaacggttaatccttcagtatttaacgcctctcggcgagtatcaagaactgttacctatttttatgcagttgggaagccgggagttgatgatgttttacatcgatctgaaacaaacgaacgatgttcttctgacgttcgaggccctcaaacatctcgcctctctgttgctccataacaagttcgcaaccgagttcgtggcccatgggggagtgcagaagctactagagatccctagacccagtatggctgccactggtgtcagcatgtgtctgtattacttaagctataatcaggatgcaatggaacgggtttgcatgcatcctcacaatgtcctaagtgacgtcgtcaactacaccttgtggctgatggagtgctcacacgccagcggctgctgtcacgccacgatgtttttttcaatatgttttagctttcgggctgtcctggagttatttgaccgatacgacggactgaggcgactggtaaacttgattagcacacttgagatccttaacctagaagatcagggggcactgctgtccgacgacgagatttttgcgagtcgacagactggaaaacatacctgtatggcactgagaaaatacttcgaggcccatttagccatcaaactggagcaagtcaagcagtcacttcagaggaccgaaggcggtatcctggttcacccacagccaccctacaaggcatgctcatatacccacgagcaaatcgtggaaatgatggagtttcttatcgaatatggccctgctcagctctattgggaacccgcagaggtgttcttgaaattgtcctgcgtgcaacttttgctccagcttatcagcattgcctgtaactggaagacatactatgcccgtaatgacaccgtgcgcttcgcactggacgtcctggcaatcctgaccgtggtgccaaagattcagttgcagctggccgaaagtgtggacgttctggatgaggctgggtccacggtctctacggtgggaatcagtatcatcctgggggtggcagaaggagagttctttatacatgatgccgagattcaaaagagcgcattacaaataatcattaattgcgtttgtggccctgataaccgaatttcttcaattggaaagttcataagcgggaccccaaggcgtaaattgccccagaatcctaagtcctcagaacatacattagccaaaatgtggaatgtcgtacagagcaacaatggtatcaaagtgcttcttagtctcctgtcgatcaagatgcccatcacggacgcggaccagattagagccctggcctgcaaagctctagtggggctgagccggagttccactgtcaggcagatcatatccaaattacctcttttcagcagctgccagatccaacagcttatgaaggagccagtcctccaggataaacggtccgatcatgtaaagttctgtaagtacgctgcagaattgatcgagagggtgagcggaaagccgctgttgatcggcaccgacgtgagtcttgcaaggctccaaaaggccgatgttgtcgcgcaaagtcgaatttcctttcctgagaaagaattactgcttctgattcggaaccatctcatcagcaaggggctgggggaaacagctaccgtcctcacaaaagaagccgacttacctatgactgccgcaagccactcctcagcgtttacacctgtcacagctgcggcaagccctgtgagcctgcctaggacaccccgaatcgccaatggaatcgccaccaggctgggcagtcatgccgctgtcggtgccagtgcaccgtccgcgccaaccgcgcatcctcagccacggccacctcaaggcccactggcactaccaggacctagctacgctggcaatagccctcttatcggtagaatatcatttatcagagagagacccagcccctgtaatggaagaaaaatccgagtgctgaggcagaaaagcgatcacggagcctacagccagagtcccgcaatcaaaaagcagctcgatcggcacctaccttcccctccaaccctcgacagtatcattacagaatacctgagagagcagcacgctcgctgcaagaaccctgttgctacctgccccccttttagtctcttcacccctcaccagtgcccagagcccaagcagagacgccaagccccaattaattttacatcacgcctgaaccgtagggcttccttcccaaagtatgggggagtggacggtgggtgctttgatcgccatctgatattttcccgatttagaccaatctcagtttttcgggaggccaacgaagatgagagcggtttcacctgttgcgcgttttccgccagagaaagatttctcatgctcgggacctgtaccggacaactgaagctgtataacgttttctctggacaagaggaagcaagctacaattgccataactccgcgataacgcaccttgaaccctctagggatggctcactgctcctcactagcgctacctggtcacaacccctcagcgccctgtggggcatgaagagtgttttcgatatgaagcactccttcacagaggatcactacgttgaattttccaagcatagtcaggacagagtcattggaacgaaaggcgacatcgcacatatttacgatattcagaccgggaacaaactcctgaccctatttaatcccgacctggccaataattacaagcggaattgcgctacgttcaatcccactgacgatttggtcctgaacgacggggtgctttgggacgtgcggtcagctcaggccattcacaagttcgacaaattcaacatgaacatctctggggtatttcacccaaacggcctggaagttatcataaataccgaaatttgggatcttcggactttccatctcctgcataccgtccccgctctggaccagtgtcgagtagtgtttaatcacacgggcacagtaatgtacggcgcaatgctgcaggccgacgatgaggacgaccttatggaggaaagaatgaaaagcccatttggctcctctttcagaacgttcaatgcaaccgattataagcctatagccactattgatgtaaagaggaatattttcgatctgtgtacagacaccaaagattgttaccttgccgttatcgagaatcagggtagcatggacgcattgaacatggatactgtctgtaggctgtacgaggtgggacggcagagattagcagaagatgaggatgaggaagaagatcaggaagaagaagagcaggaggaggaagacgacgatgaagacgatgacgatacagacgatcttgatgaattggacactgatcaattattggaggccgaactagaggaggatgacaataacgagaacgccggagaggacggcgataatgacttcagcccttctgatgaagaacttgcaaacttactggaagagggagaggacggcgaggatgaagacagcgacgccgacgaggaagttgagcttatcctgggtgacacagattcttccgataactcagacctggaggatgacattattctgagcttaaatgagtag

SEQ ID NO: 61048 - DNA, 4524 bp, Artificial Sequence
  Description of Artificial Sequence: Synthetic coding sequence
atgacaacagtggtcgtccatgtagattccaaagctgaattaaccacactgctcgagcagtgggaaaaggaacacgggagtgggcaggacatggttccaatactcactcgaatgagccaattgatcgagaaggagaccgaggaatatcgcaaaggtgatcccgatcctttcgacgaccggcaccccggacgtgcagacccagagtgcatgctgggccacctgctaaggatcctcttcaaaaacgatgacttcatgaacgcactagttaacgcttacgtgatgacctcccgcgagccgcctctgaacacagcggcatgtcggcttctgctcgatatcatgcctgggttggaaaccgccgtggtctttcaagaaaaagaaggaatcgtggaaaacctgtttaagtgggccagagaggcggaccagccacttagaacctacagcaccggcctgctgggaggcgctatggagaaccaggatattgctgcaaactatcgggatgaaaacagtcaactagtggctattgttctacgcagattgagagaacttcaacttcaagaagttgcacttcgtcaagaaaacaagcgcccttccccacggaaactgtccagcgaacctctcttgcctctggacgaggaggccgtagacatggactatggcgatatggctgtcgacgtcgtggatggggaccaggaagaggcaagtggagatatggaaatatcttttcatctcgactctggacataagacgtcttctagggtcaacagcaccacaaagcctgaggacggtggcctgaagaagaacaagtccgcgaaacagggcgaccgcgaaaattttcggaaggcaaagcagaaattaggcttttcctcttctgaccccgaccgtatgtttgtggaattgagcaacagctcctggtcagagatgagcccatgggtgattgggactaattataccctataccccatgaccccggcaatcgaacagcgacttatccttcagtacctgacacctctcggagaataccaggaactgttacctatatttatgcaattgggttctagggagcttatgatgttctacatcgacttgaaacagaccaatgacgtgctgctgacgtttgaagcattgaaacatctagcctcactgctcttacataataaattcgccacagagttcgtcgcgcacggcggtgttcagaagttgctagaaatccctaggccctcaatggccgctacaggagtatcaatgtgtctatactatttgagctataaccaggacgcgatggagcgcgtctgcatgcacccacataatgttctgagcgatgttgtgaattataccctgtggctcatggaatgttcccatgcttcaggctgctgtcatgcaaccatgtttttcagcatttgcttctcgtttagagcggtgctcgagctgtttgatagatacgacgggctccgtcggttagtgaaccttataagcacactggagatcctcaatctggaagaccagggcgctctgttgtcagatgacgagattttcgcttcccgacagactggcaagcacacgtgcatggcacttcggaagtattttgaagcccacttggccatcaagctggaacaggtgaagcaatccctacagagaaccgaaggaggcattctggtacatccgcaacccccttacaaagcctgttcttatacccacgagcagattgtggaaatgatggagttcctcattgaatacggcccagctcagctctattgggagcctgccgaggtgttcctcaagctctcctgcgtgcagttgttgctacagctcatttcaatcgcatgcaactggaagacttactacgcaaggaatgatactgtcaggttcgcactagacgtgctggccatcttgaccgttgtgccaaaaatccagctgcagttggctgaatcggtcgatgtcttggatgaggctggatccactgtgtcgacggtgggcatctcaatcatactgggagtcgcagagggtgaattctttatacatgacgcagagatccagaagagcgctttgcagattatcataaattgtgtatgcggtcccgacaaccgcatttctagcatcggcaagtttatctccggcacacccagacgcaagcttccacagaatccaaagagctctgaacacacgctggctaagatgtggaatgtggttcagtccaataacggaatcaaagtcctactgagcctgctttctatcaagatgcccattaccgatgcagaccagatacgcgcattggcctgcaaagccctggtaggcttgtccaggtcttccactgtccggcaaattatctcaaagttgcccctcttttcgtcctgccagattcaacagctaatgaaagagcctgttctccaggataaaagaagcgaccatgtgaagttctgtaagtacgctgccgaactgatagagcgcgtgagcggcaagcccttacttatcgggactgatgtaagcctggcgagactgcagaaagcggacgtggtggctcaatcccgtatcagctttcctgagaaagagctcctgttgcttatcagaaatcatctcatttccaagggactgggggagaccgcaaccgtccttactaaggaggctgatctcccaatgacagctgcctcccactccagtgcattcacacccgttaccgccgctgctagccccgtgtcgctgcccagaacaccacgtatcgctaacggaatcgcgacgcggctaggaagtcacgccgctgtcggcgcttcagctccctctgcccctacggctcacccgcagccccgtccgcctcagggccctctcgctctgcccggtccaagttatgctggcaatagtccactgataggtaggatatcatttattcgcgagaggccttccccctgtaacggcagaaagatacgggtgctccgtcagaagagcgatcacggcgcatacagtcagagtcccgctattaaaaaacagcttgatcgacatctccctagcccgccaacactggacagcatcataacggagtatctgagggagcagcacgctcgctgcaagaatccagtcgcaacctgtccacccttcagcctctttacacctcaccaatgtcccgaacccaagcagaggcgccaagcgcctatcaattttacaagcagattgaaccgcagagccagctttcccaaatacggtggtgtagatggcggttgtttcgacagacacctgatcttttccagatttcggcctatatctgttttccgagaagccaatgaggacgaaagtggcttcacgtgctgcgccttctcggccagagagagattcctcatgctagggacatgtacgggccagctgaagctttataacgtgttcagcggccaggaagaggcaagctacaactgccataacagtgctatcactcatttggagcctagccgggatgggtctttgctgctcacctcagccacttggtctcagcccctgtctgcactgtggggaatgaagtctgtgttcgacatgaagcatagctttaccgaggaccactacgtggagtttagcaagcactcccaggatcgagttattggcactaagggggatatcgctcatatctatgacatccagaccggtaataagctgttaaccttgttcaatccagacctggcaaacaactacaaacggaattgcgcaaccttcaatccaacagatgacctcgtactgaatgatggggtgctgtgggatgttagatcagcccaggctatccataagtttgataagttcaacatgaatatttcaggtgtgtttcacccaaatggcttagaggtcataattaatacagaaatctgggacctgagaacgtttcacttactgcacacagtgccagcactggatcaatgccgcgtagtttttaaccacaccgggaccgtcatgtatggcgcaatgcttcaggcagatgacgaggatgatttaatggaagaaaggatgaaatctccatttgggtcatcgtttcggacttttaatgctacagactataagcctatagccactatcgacgttaaacgcaatatcttcgacctgtgcactgacaccaaagattgctaccttgcagttatcgagaatcaagggtccatggatgctttgaacatggacacggtgtgtaggctgtacgaggtaggtagacagaggctggccgaggacgaggatgaagaagaggaccaggaggaggaagagcaggaggaggaagatgatgatgaggacgatgacgacacagatgatctggatgaacttgacacagaccagttattggaagcagaattggaggaagacgataataacgagaatgccggagaagacggtgacaacgattttagcccaagtgacgaggagctcgccaatctccttgaagagggcgaggacggcgaagacgaagactcagacgccgacgaagaggtggaactcatcctgggagacaccgactcctctgacaacagtgaccttgaagacgatataatcctcagtcttaacgagtag

SEQ ID NO: 61049 - DNA, 984 bp, Artificial Sequence
  Description of Artificial Sequence: Synthetic coding sequence
atggctgaattgcccggtccgtttctctgtggagccttgctgggctttctgtgcttgagcggtctcgccgtggaagtgaaggtccccacggaaccactgtccacaccactggggaaaaccgccgagctcacttgcacctactctacctcggttggcgacagttttgcactggaatggagtttcgtgcagccaggcaagccgatcagcgaatcacatcccatactctacttcactaacggccacctctatcctacagggtcgaaaagtaagcgggtgtccctgctgcaaaacccgcctaccgtgggtgttgccaccttgaaactgacagacgtacaccctagtgacacaggcacttacctgtgccaagtaaataacccaccagacttctatactaacggtctggggctgatcaatctgactgtgctggtcccgccatccaaccctttatgcagccagtccggacagaccagtgtgggagggagcaccgcactcaggtgctcctccagtgaaggtgcgcctaagccagtttataactgggtgaggttaggcacttttcccactccctcacccggttcaatggtccaggatgaggtcagcgggcagctaattctcaccaatctctcgctgacctctagtgggacctacaggtgtgtggccacgaatcagatgggaagcgccagttgtgaattgactctttcggtcacagaacccagtcaaggcagggtcgcgggtgcgctgataggtgttctgcttggagttttactattgtccgtggctgccttttgcttagtgcggtttcagaaagagcggggaaagaaacctaaagagacctacggcggttctgacctgagagaggacgccattgccccagggatctcagagcacacttgcatgcgagccgacagtagcaaagggttcctcgagcgaccctctagtgcatccaccgtaactactacaaaatcaaaattgccaatggttgtctag

SEQ ID NO: 61050 - DNA, 855 bp, Artificial Sequence
  Description of Artificial Sequence: Synthetic coding sequence
atggctgagctgccaggtccatttctgtgtggcgctctgttaggctttctttgtctctcgggcctggctgtggaggtgaaagtgcccactgaacccttatcaactcccctggggaaaactgccgaactcacctgtacctacagcacttctgtgggtgacagcttcgccctcgaatggagcttcgtgcagcccggtaagcctatcagcgagagccatccaattctgtacttcaccaatgggcatttatacccaaccggaagcaagtctaagagggtgtcactgctgcaaaacccacccactgtcggtgttgctacccttaaattaacggatgtgcacccaagcgatacgggaacatacctttgccaggttaacaacccacccgatttctatacaaacggactgggcctcatcaatttgactgtgctagtgcctccctcgaaccctctgtgttctcaaagtgggcagacgagcgtgggcggaagcacggcgcttcggtgttcgtctagtgaaggcgcaccaaagcctgtatacaactgggtccgcctgggaacatttcctactccaagccccggtagcatggtccaggatgaagtcagcggtcagctcatcctaaccaatttgtcactaacatcatctgggacgtataggtgcgtagcaactaatcagatgggcagcgcctcttgcgaactgaccctgagcgtgacagagccctcccagggccgagtcgctggggctttgattggcgtcctgctgggcgtgctactgctgtctgtcgcggctttctgtttggtgcgcttccagaaagagcgaggaaaaaaaccaaaggagacctacggaggatccgacctgcggtag

SEQ ID NO: 61051 - DNA, 363 bp, Artificial Sequence
  Description of Artificial Sequence: Synthetic coding sequence
atggattggaactggcggattctgtttttggtggtgatcgctgccggagcacaaagccaggttcagctggttcagtcaggcgctgaagttaaaaagccaggggcaagcgtgaaggtgtcttgcaaggcgtctgggtataccatcacatcctattgtatgcactgggtgcaccaggtgcatgcgcagggcctagaatggatgggactggtctgtccctccgacgggtctacatcatacgcccagaagttccaggccagggtaacaatcacgagagataccagcatgtccacagcttatatggagctgtcaagcttgcgcagcgaggacaccgctatgtattactgtgtacgggatacaatgtag

SEQ ID NO: 61052 - DNA, 564 bp, Artificial Sequence
  Description of Artificial Sequence: Synthetic coding sequence
atgggggcaccactcgctgtagcattaggggctttacactacctggcactgttcttgcaactcggaggcgcaacacgccctgctggacacgcaccgtgggataatcatgtgagcggccacgcgctgttcacagagaccccacatgatatgactgccagaacaggagaggatgtggaaatggcgtgctcattccggggttctggctctccctcttactcacttgagattcaatggtggtatgtgcgctctcacagggattggaccgacaagcaggcatgggcctctaatcaggtagtcaaagtcgtcggtagtaacatctctcataagttgcgattgagccgggtgaaaccgaccgatgaaggaacatacgagtgccgtgtcattgacttctctgacgggaaagccaggcaccacaaagttaaagcttatctgcgggtccagcccggagagaatagcgtgttgcatctgcccgaggcccctcccgcagcgccagcccctcccccacctaaacccggaaaggagctgcgcaagaggagcgtcgaccaggaggcatgcagcctctag

SEQ ID NO: 61053 - DNA, 615 bp, Artificial Sequence
  Description of Artificial Sequence: Synthetic coding sequence
atgggtgcgcctctggccgtggccctgggagccttgcattacctcgccctatttttgcaattgggaggggcaacacgcccagctgggcacgccccttgggacaatcacgtttccggtcatgcgctgttcactgaaaccccacatgatatgaccgcacgcacgggggaagatgtggaaatggcttgctctttcagggggtcggggagccctagctactccttggagatacagtggtggtatgtgaggtcccaccgtgattggactgataaacaagcttgggcgtccaatcaactgaaagctagccagcaggaagatgcaggaaaagaagctaccaaaatttcggtcgttaaagtggtggggtcaaacattagccacaaattgaggctttcccgggtgaagcctaccgacgaggggacttatgagtgtcgcgtcatcgattttagcgacggaaaggctaggcaccataaagttaaggcttatctgcgcgtgcaacctggcgaaaacagcgtgctgcatctgcccgaggccccacccgcagccccagcaccccctcctccgaagcctggtaaagaacttagaaagcggtctgtggatcaagaagcctgtagcctctag

SEQ ID NO: 61054 - DNA, 450 bp, Artificial Sequence
  Description of Artificial Sequence: Synthetic coding sequence
atgggggcacccttggcagttgcgctaggcgctttacattatcttgccctattcttacagctgggcggagctacccgccctgccggacatgccccatgggacaaccatgtaagcggtcatgctctcttcactgagacaccacatgacatgactgccagaaccggagaggatgtcgagatggcatgctccttccgaggttcaggttccccaagttattccttagagatccagtggtggtacgtgcgttcacatcgagactggactgacaaacaagcatgggccagcaatcaggttgtgaaagtggtgggatccaatatctctcataaattaagactatccagagtcaagcccaccgacgagggtacttacgaatgccgcgtgatcgatttctcagacggcaaagccagacatcataaggtgaaagcctacttgcgagtgcagccgggttag

SEQ ID NO: 61055 - DNA, 858 bp, Artificial Sequence
  Description of Artificial Sequence: Synthetic coding sequence
atggagcaaagaaaccgattaggcgctctgggatatttacctcctctcttgttgcatgcgctgctcctgttcgtggccgatgctgctttcacagaagtcccaaaggatgttaccgtgcgtgagggcgatgatatagaaatgccttgcgcttttcgcgcttcaggcgcaactagttactctctggagatccaatggtggtatctgaaggagccaccaagagaattgcttcatgagctcgctctttctgttccaggcgctagatcaaaggtgacaaataaggatgccaccaagataagcacggtacgcgtgcagggaaacgacatatcccatcgtctgagactgagcgctgttaggctgcaagacgaaggagtctatgagtgcagagttagcgattactctgatgacgatacccaagaacataaggctcaggcgatgctgcgcgtgctgtccaggttcgctccccctaacatgcaggctgcagaggccgtcagtcacatccagtctagcggtcccaggagacacggcccagcctcagccgctaatgccaacaacgccggtgccgcaagtagaaccacttccgaacccggacgcggtgataagagccctccgcctggaagcccacctgcggctatcgaccccgctgtgcctgaggccgcagctgcgagtgcagcccacaccccgactacaaccgtggccgctgccgctgctgctagttcggcatcaccaccttccgggcaggctgtgctgctgcggcagagacacggctcagggacaggtcgttcttacacaactgaccctctcctaagcctactcttgctagctctccataaatttctgagactgctgttaggccattag

SEQ ID NO: 61056 - DNA, 2034 bp, Artificial Sequence
  Description of Artificial Sequence: Synthetic coding sequence
atggccaaagtgaacatcacacgtgacctgatccgcagacagattaaagaacggggagctctctccttcgaacgccgttatcacgtcacagatccttttatcaggcggttggggctggaggcggaactgcaagggcattccgggtgcgtgaattgcctggagtggaatgagaagggcgacctccttgcatcagggtcggacgaccagcacacaatcgtgtgggaccctcttcaccataagaaactcctgagtatgcacactgggcataccgcaaacattttctcagtgaagtttctgcctcacgccggtgacagaatcctaatcacaggggcagccgactccaaggtgcatgtccatgacttaaccgtgaaggaaaccatccacatgtttggggaccatactaacagggtcaaaagaatagcaacggcaccgatgtggccaaacaccttctggtccgctgcggaggacggattgattagacagtacgacctgagggagaacagcaagcactcagaagtcttaatagatctcaccgagtactgcggccaactagttgaagcaaagtgcctgaccgttaatccacaagacaataattgcctggctgtgggggcatcaggacctttcgttcgactctatgacatccggatgatacacaatcatcgcaaatccatgaaacagtcaccctcagcgggtgtacataccttttgcgatagacagaagcctctgcctgacggagctgcccaatactatgtggcaggacaccttcctgtgaagctacctgattacaataaccggctccgcgtgctggtggccacatacgtgactttcagtccgaatggtaccgagcttctggtgaatatgggcggagagcaggtatatctgttcgacctgacctataagcagcggccatacacctttcttcttccaagaaaatgccactcctcaggggaggtgcaaaatggcaaaatgagtactaatggcgtcagtaatggggtatcaaacggcctacatctgcactcaaacggttttcggctcccagaatctcgtggacacgtgagtcctcaggtagaactcccaccgtatctggagagagttaagcagcaagcaaatgaggcgttcgcttgtcagcagtggacccaggccatccagctgtattccaaagcagtgcagagagcgcctcataatgccatgctgtacggcaatagagccgctgcgtacatgaaacggaaatgggacggcgaccattatgacgcattgagggactgtctcaaggccattagcctcaacccttgtcatctcaaagcacactttcgtttggcaagatgtttgttcgagctgaagtatgtggctgaagctcttgaatgtcttgatgatttcaagggcaaatttcccgagcaagctcactcctccgcttgcgacgcacttggcagggatatcacagccgctttattttccaagaacgatggggaagaaaagaaaggacccggtggcggagcacctgtcagattaagaagtacatcacgaaaagacagtataagtgaagacgaaatggttctccgcgagcgctcttacgattatcagttccgttactgtgggcactgcaacacaacaacagacattaaagaggctaactttttcggaagcaatgcacagtacatcgtgtccggaagcgatgacggcagcttctttatttgggagaaggagacaacaaatctcgtacgggtcctgcagggagacgagtcgattgttaactgcctgcagccccatccaagctactgctttctcgccacgtctggcatcgaccctgtggtgcgcttgtggaacccgagacccgagagcgaagacctgaccgggagagtcgtggaagatatggaaggcgcaagtcaggccaatcagagacggatgaacgctgacccattggaagttatgctccttaacatgggctacagaatcactggtctgagttcaggcggtgccggagcgtcagacgatgaagacagctccgaaggacaggtgcaatgcagaccgtcttag

SEQ ID NO: 61057 - DNA, 2031 bp, Artificial Sequence
  Description of Artificial Sequence: Synthetic coding sequence
atggctaaggtgaatattactagagacctgattagaaggcagataaaggaaagaggggcactttccttcgagcggaggtaccacgtgaccgaccccttcattcggcgtttgggcctcgaagccgaattgcagggccattctgggtgcgtgaattgcctcgagtggaacgagaaaggggacctccttgcctccggcagcgacgatcagcatacgatagtgtgggacccattgcaccataaaaagcttctaagtatgcacacaggacacactgctaatattttcagcgttaagtttttgcctcacgcgggtgacagaatcctgattacaggcgctgcggacagcaaggttcacgttcacgatctgacagtcaaggaaaccatccatatgtttggggatcacaccaaccgggtgaagagaattgcgaccgcccctatgtggcccaatacattttggtcagctgccgaagacggactgatccggcaatacgacttgagagagaacagcaaacactccgaggtgcttatcgatctcaccgagtactgcgggcaactcgtggaggcgaagtgtctcaccgtgaatcctcaggacaacaactgccttgctgtcggggcaagcggtccttttgttcgactgtatgacatccgaatgatccataaccaccggaagtccatgaagcagtcaccaagcgcgggagtccataccttttgtgatcgacagaagccgttgcctgatggtgcagcccagtattatgttgctggacacctcccagtcaagctccccgattacaacaacaggcttagagtactcgtcgccacctatgttacttttagtcctaacggcaccgagctgctggtgaatatggggggtgagcaggtctatctcttcgacctcacctataaacagcggccatacaccttccttttacctagaaagtgccactcatcaggagtgcaaaacgggaaaatgtctacgaatggcgtgtccaatggagtctctaatgggctgcacttacacagcaacggctttaggctgcctgaatctcggggacacgtatccccccaggttgagctgcccccatatttggagagggtgaagcaacaggcgaacgaggcatttgcctgtcagcagtggacgcaggcaatccagctgtatagcaaagccgtgcagagagcgcctcacaacgccatgctttatggtaaccgcgcagctgcctacatgaagaggaaatgggacggggatcactacgacgccttacgcgattgcctgaaggcgatctcgctcaatccatgtcatctgaaggctcacttccgcctggctaggtgcctctttgagctaaaatatgtggcggaggccctggaatgtctggacgatttcaaaggtaagttccctgaacaggcacactcctcagcgtgcgacgctctagggagggacatcacagccgcattatttagcaagaatgatggggaagaaaaaaaggggcctgggggaggggctccagtgcgtcttagaagtacctccagaaaggactccatcagcgaggacgaaatggtcctccgggagcggtcgtacgattaccagttccggtattgtggacattgtaacactaccaccgacattaaagaggccaatttcttcggtagcaatgcccagtatatcgtttccgggtcggatgacggttctttctttatctgggagaaggagacgacaaaccttgttcgcgtactccagggtgacgagagtatcgtgaattgtctgcagcctcatcctagctattgcttcctggctacgagcggtatagaccccgtagtccgcttgtggaacccacggccagaatcagaggacctgaccggcagggtcgtggaggacatggaaggcgcatctcaagccaatcagcgtagaatgaacgccgatcctttagaagtcatgctgctcaacatggggtacagaatcacaggactgtcctccggaggcgctggcgcatccgacgacgaggattcttctgaaggacaggttcagtgccggcctagctag

SEQ ID NO: 61058 - DNA, 1203 bp, Artificial Sequence
  Description of Artificial Sequence: Synthetic coding sequence
atggccgctgaaattcagcccaagccactcacaaggaaaccgatcctgcttcagcggatggagggcagccaggaagtagtaaacatggcagtgatagtgcccaaggaggagggagtgatttcagtatccgaggatcgaacagtgcgagtttggctgaagcgggactccggccagtattggccttcggtttaccacgcgatgccctctccatgctcttgtatgtctttcaacccggagacacgcagactgtcaataggcttagataacggtaccatttccgagtttatcctctccgaggactacaacaagatgacccccgtaaaaaactaccaggcccaccagtcccgggtgacaatgatcctgtttgtattagaacttgaatgggtgctcagtactgggcaggataagcagttcgcttggcattgctccgagtctggccagcggttgggcggttatcgcacttccgccgtggcatcaggcttgcagtttgacgtcgaaacacgacatgtttttatcggcgaccactcagggcaagtcacaatccttaagctagagcaggagaattgcaccctggtgacgacctttcggggacacacagggggtgtcaccgcattgtgctgggacccagtgcagcgtgttctcttttcagggtccagcgatcattctgtgattatgtgggacatcggcggtcgcaaaggcactgccattgagctacagggacataacgatagagtacaggccctgtcctacgctcagcatacacgtcagctcatatcctgtggcggagacggcggaattgtggtgtggaatatggacgttgaacgtcaggagacccccgaatggttggattcagacagctgccagaagtgcgaccagccctttttctggaattttaagcagatgtgggacagcaaaaagattggcctacgacagcaccactgcaggaagtgcggcaaggccgtgtgtgggaagtgtagctcaaagagaagttccataccactgatgggattcgagttcgaggtgcgagtttgtgactcctgccacgaggctattaccgacgaagaacgagccccaaccgcaaccttccatgactcgaaacacaacatagtgcatgtgcattttgacgcaacgaggggctggttgctgacttctggcaccgacaaagttatcaagttgtgggacatgacccccgtagtaagttag

SEQ ID NO: 61059 - DNA, 1266 bp, Artificial Sequence
  Description of Artificial Sequence: Synthetic coding sequence
atggcctctttccctccaagagttaatgaaaaggagattgtccgcctgcgaaccattggtgagctgctggccccagccgcacctttcgacaaaaagtgtgggagagagaactggactgtggcctttgctcctgatggatcttattttgcctggagtcagggacaccggaccgtgaagcttgttccatggtcacaatgcctacagaattttctgctacatgggaccaaaaacgtgacgaactcttcctcattgcgtctacctcgtcagaattccgacggcggacagaaaaacaagcctcgcgagcatataatagattgcggagatattgtgtggtcccttgcatttggctcttccgtgcccgagaagcagtctcgctgtgtgaacattgaatggcatcggttcaggttcggccaggatcagctactgctagccaccggactaaataatgggcgaatcaagatttgggacgtttacaccggcaaacttctgttaaacttggttgaccacactgaagtggtgcgcgacctgactttcgccccagatggctcgctgatcctggtgtcggcctcacgagataaaaccctacgcgtgtgggatctcaaggatgacggcaacatgatgaaggttctaagaggtcaccaaaattgggtgtatagttgcgctttcagccctgacagcagcatgctgtgcagcgtcggcgcttctaaagccgtatttctttggaatatggataaatatactatgatcaggaaactggagggacaccaccacgatgtggtcgcttgcgatttttctcccgacggggctctgttggctacagcttcgtacgatactagggtgtacatttgggatcctcacaatggggacatcttgatggagtttggccatctgttcccccctcccactccgatttttgccggtggggctaatgatcggtgggtgcggtcagtgagtttctcacatgatggtcttcacgtggctagtctggccgacgacaaaatggttcgcttctggcgtatagacgaagattaccccgtccaggtcgctccgctgtccaatggactgtgctgcgcattttctacagacggatctgtcctggcagccggaactcatgatgggagtgtgtatttctgggcaacgccacgccaagtaccgtctttacagcacttgtgtaggatgtccattcgtcgggtgatgcccacccaggaggtgcaggaattgccaattccttctaaactgctggaattcttatcttaccgaatctag

SEQ ID NO: 61060 - DNA, 828 bp, Artificial Sequence
  Description of Artificial Sequence: Synthetic coding sequence
atggccagcttcccaccaagagtgaatgagaaagagatcggcaagcttttgctcaatctggtggatcacaccgaggtcgtaagggacctgaccttcgctccggatgggtcacttattcttgtgtccgcttcaagagacaagaccctgcgggtatgggatttgaaggacgatggcaatatgatgaaagtgcttcggggtcaccagaactgggtttactcatgtgctttttctcccgacagttcaatgctatgttcagtgggggctagcaaggccgtcttcctttggaatatggacaaatacacaatgatccgcaagctggaaggacaccaccacgatgtggtggcctgtgacttttcgcctgatggagcactgctggcaacagcctcctacgacacccgcgtgtatatatgggacccacacaatggcgatatcctgatggaattcggccacttgtttccccctcccacaccaatctttgccggaggcgctaatgaccggtgggttcgtagcgtctctttttcccacgatggtctgcacgtggcctccttagccgacgataaaatggtgagattttggcggattgacgaggattatccagtacaagttgctccattgtccaatggattgtgctgcgccttctcaaccgatggaagcgtcctggctgctggcacccatgatggatcagtgtacttctgggccacgccaagacaggttccatctctccagcatttgtgtcggatgtcgattagacgagtcatgccaactcaggaggttcaggagttacctatcccttctaaattactggagtttctgagttacaggatctag

SEQ ID NO: 61061 - DNA, 642 bp, Artificial Sequence
  Description of Artificial Sequence: Synthetic coding sequence
atggctagcttcccgccaagggtgaatgagaaagagatcgacggatcttactttgcttggtctcaaggacacaggacagtaaaattggtgccatggtcgcagtgtctacagaattttctgctgcacgggacgaaaaacgtgactaattccagcagtctccggctgccaagacaaaattccgacgggggacagaagaataaacccagggaacacatcatcgactgtggagatatcgtctggtctctcgctttcggctcctctgtcccagaaaagcaatcccgatgtgtcaacatcgagtggcacaggttcaggttcggtcaggaccaactcctcctggcaaccggcctaaacaacgggagaataaagatttgggacgtatatacagggaagttgctgctgaacctggtcgaccacacggaagtcgtgagagacctgacatttgcccctgacggatctctgatacttgtcagtgctagtcgtgataaaaccctgagggtatgggatctgaaagacgacggtaatatgatgaaggtgctccgaggccatcagaattgggtatattcttgcgcctttagccccgactcttcaatgctgtgctcagttggagcaagtaaggcggtggtggccgcaattctagtttag

SEQ ID NO: 61062 - DNA, 1215 bp, Artificial Sequence
  Description of Artificial Sequence: Synthetic coding sequence
atggaggccggagaggagcccttgctgctggcagagctgaaaccaggcaggcctcatcagtttgactggaagtcctcatgcgagacttggagtgtggcttttagccccgacgggagttggttcgcgtggagccaaggacactgtatagttaagctgatcccttggcccctcgaagagcagtttatcccaaaaggctttgaggcgaaatccagaagtagtaaaaatgagactaaaggcaggggttcccccaaggagaaaaccctcgactgcggacagattgtatggggtctcgcgttttctccatggccatcaccccctagcaggaagctctgggcaagacaccacccccaggtacccgacgtttcctgccttgtcctcgcgaccggattaaatgatgggcagatcaaaatctgggaggttcaaaccgggctcctcttactgaacctgtccgggcaccaggacgttgtgcgggacttgtcttttacgccaagcggatctttgatactggtaagcgccagcagggacaagacactgagaatttgggatttgaacaaacacggaaaacagatccaggtgttgagtggccacctgcagtgggtttattgttgttctatctctcctgactgttctatgttatgctccgccgctggcgaaaagtccgtgtttctgtggagcatgagaagctacacgctaatccggaagttggaaggccatcagagtagtgtggtgtcatgtgatttcagtcctgacagtgccctgctcgtgacggctagctacgatacaaatgtgatcatgtgggatccttatacgggggaaagactgagaagtttacaccatactcaggttgaccctgctatggatgactctgatgtgcatattagtagtctacggagtgtatgcttcagcccagaaggtctctaccttgccactgtcgccgatgatcgactgcttcggatttgggctttggaattgaagaccccaatcgcctttgcgcctatgaccaatggtctctgctgcaccttctttccccatgggggtgtaatagccacgggcacaagggatgggcacgtacagttctggacagctccgagagtcctttcttcgcttaagcacctctgcagaaaagctttacggagcttcctgacaacctaccaggtgctcgctctgccgattccgaagaaaatgaaggagtttctcacataccgaactttttag

SEQ ID NO: 61063 - DNA, 540 bp, Artificial Sequence
  Description of Artificial Sequence: Synthetic coding sequence
atgagatcttacactctcatccgaaagctagagggccatcagagcagtgtagtgtcatgcgatttctcccccgattctgccctcctcgtcactgcctcatacgatactaacgtaattatgtgggatccctacactggagaaagactaaggtcattacaccacacacaggtggatcccgctatggacgattccgacgtgcacatatcctcgctgagaagcgtatgcttcagccccgaggggctatacctcgcaaccgtcgccgatgacagattgctccgcatatgggccctcgagctgaaaactccaattgcattcgccccaatgacgaatggcctctgctgtacattctttccacacggaggagtcattgcgaccgggaccagggatggacacgtgcagttctggacagcccctcgagtgctgtcatccttgaagcatctgtgccggaaggccctcaggtcttttctaactacctaccaggtcttggcgctaccaatccccaagaagatgaaggagtttcttacttacaggaccttctag

SEQ ID NO: 61064 - DNA, 585 bp, Artificial Sequence
  Description of Artificial Sequence: Synthetic coding sequence
atgttgtgctccgccgctggtgaaaagagtgtgttcctgtggtctatgaggtcgtacactctgataaggaagttggagggacatcagtcttccgtggtttcctgtgacttctcaccagattctgcactgctggtgacagcctcgtatgacaccaacgtgataatgtgggacccctatacgggtgagaggctgagaagcctacatcacacccaagtcgaccccgcaatggacgacagcgatgtccacatctcttccttacgctcagtctgcttcagccctgaagggttgtacctagctacagtcgcggatgatcgcttgctgaggatatgggcgctggagttgaagacacccatcgctttcgcgccaatgacgaatgggctctgttgcaccttttttcctcacggaggcgtcattgcaacaggcacaagggacggccatgtgcaattctggaccgcccctcgggtgctgtcttccctaaaacacctctgccggaaggcgctgagatcgtttctgaccacgtatcaggtcctggccctgcctattcccaaaaagatgaaggagtttctgacctacagaacattttag

SEQ ID NO: 61065 - DNA, 1458 bp, Artificial Sequence
  Description of Artificial Sequence: Synthetic coding sequence
atggcggcagtctggcagcaggtcctggccgtcgacgccagatacaatgcgtatcgaaccccaaccttccctcagtttcgcactcagtatataaggaggcggtctcagctgctcagggaaaatgcaaaggcagggcaccccccagcactcagacggcagtatctgcgcttacgcggacaattgcttggacagagatacgggccactgagcgagccaggaagtgcacgcgcatactccaattcaatagtccggtcgagccggacaactctcgataggatggaggactttgaggatgatcccagggccctgggcgctcggggtcacagaagatccgtttctagaggcagctaccagctgcaggcacaaatgaatcgcgctgtgtacgaagatcggcctccaggatcggtggtgcctacctcagcagccgaggcaagcagggccatggccggagatacttccctatctgagaactacgcctttgcaggcatgtaccacgtctttgatcagcacgtggatgaggccgtccccagagtgcgctttgcaaacgacgaccgtcatcgtttggcctgttgtagcctagacggaagcatttctctctgtcagcttgtgcccgctccgcctacagtcttacgggtactcagaggacatactcggggagtctcagacttcgcatggtctctcagtaatgatattttagtcagcacaagtctggacgctaccatgagaatatgggcaagcgaggatgggaggtgtatccgcgaaatacctgatcccgatagcgcagagttgctgtgttgcacgtttcaaccagtcaataacaatctgaccgtggtcggcaatgccaagcacaatgtccacgtgatgaatatctccaccgggaagaaggtgaagggtggatcctccaagctcacgggcagggtgctcgctctcagctttgatgccccaggcagacttttgtgggcaggcgacgaccacggttcagtcttctccttcctttttgacatggccactggaaagcttacgaaagcaaagcgcctagttgttcatgaagggagccccgtgactagtatctcagcgagaagctgggtgagcagggaagctcgcgatccctcgctgcttataaacgcctgcctgaacaagcttctcctatatcgggtcgtggataacgaaggtaccttgcaattaaagcggagtttccccatcgaacagagttctcacccggtcagatctatcttctgtccattaatgtccttccgccaaggagcctgcgtcgttacgggctcagaagacatgtgtgttcacttttttgacgtcgagcgcgctgcgaaggccgcagtgaacaaactccagggccacagcgcccctgtcctggacgtctcctttaattgtgacgaatcactgcttgcctccagcgacgcgtctggcatggtcatcgtgtggcgacgggaacaaaaatag

SEQ ID NO: 61066 - DNA, 1299 bp, Artificial Sequence
  Description of Artificial Sequence: Synthetic coding sequence
atggccgcacccatggaggtggcagtatgtactgactccgccgcaccaatgtggagctgcatcgtctgggagttacatagcggggctaacctgttgacctaccgcggaggtcaggccggtccaaggggcctcgctttgctgaacggtgagtacctcctggccgctcagctcggtaaaaattacatttctgcatgggaattgcagcggaaggaccagctccagcagaagatcatgtgtcccggtccggtaacgtgtctgaccgcatctccgaatggcctgtatgtgctagccggagtggcagaatctattcatctgtgggaagtgtcaacggggaacctgctcgtaatcctctctcgtcactatcaggacgttagctgccttcagttcactggcgacagtagccacttcataagcgggggaaaagactgcctcgtattagtctggtctctgtgctccgttcttcaggcggacccctctagaattcctgctcccaggcatgtctggagccatcatgccctcccgatcactgacttgcactgcgggtttgggggaccgcttgctagagtggctaccagttcacttgatcaaaccgtgaagttatgggaagtcagttccggagagctcctgctatcggtgctgttcgatgtgagtattatggccgtgactatggatctggccgaacaccacatgttttgcggaggctctgagggttctatcttccaggttgacctgttcacttggccaggtcagcgcgaacgaagctttcatcctgaacaggatgctggcaaagtcttcaagggtcaccgcaaccaagttacctgcctctctgtcagcaccgatgggtccgtcctgctgtccggcagtcacgatgaaacggtgcgtctgtgggacgtgcaatcaaaacagtgcattcgcacggtcgcgctcaagggaccggtgacaaatgctgctattcttctggcacccgtgtctatgctgtcaagtgattttaggcccagtcttccgttgccccatttcaataaacatctgctgggggcagagcatggtgacgagccgagacacggcggactcacacttcgacttggcctgcatcagcagggatcagagccctcctatctggatcgcacggaacagctgcaggccgtgctctgctctacgatggaaaaatccgtcctgggcggtcaggatcagctcagagtgcgtgtcaccgagctagaagacgaagtacgcaacctccgaaagatcaaccgggacctctttgatttctccaccaggttcataactcgacctgccaaatag

SEQ ID NO: 61067 - DNA, 1746 bp, Artificial Sequence
  Description of Artificial Sequence: Synthetic coding sequence
atggcaaccgaaggcggagggaaggagatgaacgagatcaagactcagttcactacaagggaaggcctctacaaactgttgccgcactcagagtacagtcgcccaaacagggtaccttttaacagtcaaggaagcaatccagtacgcgtcagcttcgttaatctgaacgatcagtcgggtaacggtgaccggctttgcttcaacgtgggacgagaattatacttctacatttacaagggcgtccggaaggcagcagacctttcaaaacccattgataagcggatttataaaggcacgcagcctacatgccatgacttcaatcacctgacagctaccgctgagagtgtgtctctcctggtgggattttctgctggtcaggtacagctgattgatccaattaagaaagagacatctaagctatttaacgaggaaagactgattgataaaagcagagtcacatgtgtgaaatgggtacccggtagcgaaagcctgttcctggttgcccattcatctgggaatatgtacctttataatgtggagcacacttgtggcacaaccgccccacattatcagctcctaaaacagggtgagagcttcgcggtgcatacatgtaagtcaaaaagcacacgcaatccactccttaaatggactgtgggggagggtgcgttaaacgagttcgcatttagcccggacggcaaatttctggcttgcgtttctcaggacggtttcttacgcgttttcaactttgattccgttgagctgcatgggactatgaaatcctatttcgggggacttctgtgcgtttgctggtctcctgatggaaaatatatcgtgaccgggggtgaggacgatctcgtaacagtgtggtcttttgttgattgcagagtaattgcaagagggcatggccataagagctgggtcagtgtggtggcatttgatccttacacgacatcagtcgaggagggagatcccatggaattcagcggaagtgatgaggattttcaggatctgcttcattttgggagggacagagccaattctactcaaagccgattgtccaagcgcaattccacagactcccgacccgtgagcgtcacgtaccgattcggttcagtcgggcaggacactcaactgtgcctctgggacctgaccgaggacatcctctttcctcatcagcccctgagcagagcgcgtacgcacaccaacgtgatgaatgcaaccagtccccctgccggaagtaatgggaactccgtgactacccctggaaactccgtcccacctccactacctagatctaatagcctgccccacagtgcagtgagcaatgctggttcaaaatcatcagtaatggatggagccattgcatctggggtgtcaaaatttgcgactctgagcctgcacgaccgcaaagaaagacatcacgagaaggaccataaaagaaatcactctatgggacacattagctccaagtctagtgataaactgaacctagtgaccaagactaagaccgatccagctaagactctggggactcctctgtgcccaaggatggaggacgttcccctcttagagccactcatctgcaaaaaaatcgcacatgagaggttaactgtgctgatattccttgaagattgtatagtgactgcctgtcaagagggcttcatctgcacctggggacgcccaggcaaagtgggatcgctctcgtctccatcccaagcgtcttcgcccggaggcaccgtggtttag

SEQ ID NO: 61068 - DNA, 1710 bp, Artificial Sequence
  Description of Artificial Sequence: Synthetic coding sequence
atggccaccgagggcggagggaaggaaatgaatgaaatcaaaacacaattcacaactcgcgagggactgtataagttactccctcacagcgaatacagtagacccaatcgagtgccttttaactcccagggctcgaatcccgtgcgggttagctttgtcaacctgaacgaccagtcagggaatggcgacagattgtgttttaatgtggggagggagctttacttttatatctataaaggggttaggaaagccgctgatctgtctaaacccatagataagcgcatctataagggcacacagccaacatgtcatgacttcaaccatctcaccgcaactgccgagagtgtgtccctcctggtgggattctcagccggacaggtgcagctcattgatccaatcaagaaagagactagtaaactgtttaacgaggaaagattgatcgataagtccagggtgacgtgcgtaaaatgggttcctggcagcgaaagccttttccttgtcgctcattcttctggcaatatgtacctctataatgtggagcacacctgtgggacaactgcaccgcactaccagcttttaaaacagggggagtcttttgctgtgcacacatgtaagagcaaaagcacacgcaaccctctgctaaaatggaccgtcggtgagggcgctctgaatgagttcgcctttagccccgatggcaagttcctggcatgtgtctcacaggatggatttctccgggtgtttaacttcgacagcgtcgagttgcacgggaccatgaaaagctactttggaggtctcctatgtgtgtgttggtcgccagatggaaagtacattgtgactgggggagaggacgacttggttacggtgtggtccttcgtggattgtagagtgatcgctaggggccacggacacaaaagttgggtgtccgttgtagctttcgacccctatacaacttcggtcgaagaaggcgaccctatggagttttctggttctgatgaggactttcaggacttgttacatttcggtcgagatcgcgcaaatagcactcagagtagactgagtaaacggaatagtacagatagtcgccctgtgagcgtaacatacagattcggttctgtgggacaagacacacagttgtgcctctgggatctcaccgaagacatcctgttcccgcaccagcctctgtcacgggctcgaacccatactaatgtgatgaacgccacctctccaccggcaggttctaacgggaactccgtgacaacccccggaaatagtgtgcccccaccactgcccaggtccaactctctccctcacagtgctgtgtcaaatgctggcagtaagagctctgtaatggacggggctattgcctcaggcgtgtcaaagttcgccaccctgtccctacacgatcgcaaagagcgacatcatgaaaaagaccataagcgcaatcactctatgggccacatctctagcaaatcttctgacaagctgaatctggtcactaagacaaaaactgatccggctaaaactctaggcactcccctttgccctcgtatggaagatgtccctctgctggaacctctgatttgcaagaaaattgcgcacgagcggctgaccgttttaattttcttagaggactgtattgtcacagcatgccaagagggctttatatgtacctggggtcggcctggaaaggtggtgagttttaacccatag

SEQ ID NO: 61069 - DNA, 1536 bp, Artificial Sequence
  Description of Artificial Sequence: Synthetic coding sequence
atgaacgaaattaagacccagtttactacgagggaagggctttacaaattgctgccacatagcgagtacagcaggcctaatcgggtacccttcaattctcagggctcaaatcccgtccgggtgtctttcgtaaacttaaacgaccagtctggcaatggggaccgtttatgttttaacgtggggagagagctttatttttatatctacaaaggagtgcggaagcgtctgatcgataagagcagggtaacttgtgtgaagtgggtccctggctcagaaagcctgttcctggtggcccattcctccggtaacatgtacttatataatgtggaacacacttgtggcacaacagcgccacattaccagcttctcaaacagggcgagtcctttgcagtgcatacttgtaagagcaaatctacccggaacccccttttaaagtggacagtgggcgaaggagccctgaacgaatttgcctttagtccagacggcaagtttttggcctgcgtgagccaggatggctttctccgggtctttaactttgactctgtcgagttgcacggaaccatgaagtcttactttggaggcctcctgtgcgtgtgctggagccctgacggcaagtatattgtgactggtggggaggatgacctggtgacagtatggtcgtttgtggactgtagagtgatcgcgcgaggacacggacacaagtcctgggtctcagtggtggcctttgatccatatactaccagcgtggaggaaggagatcccatggagttctccgggagcgatgaagacttccaggacctgctgcacttcggcagagatagggcgaattctacacagtcccgattgtccaaacgtaattcaaccgatagtaggccagtgtctgtgacataccggtttgggtctgtcggacaggatacacagctttgtctttgggatctcactgaggacattctgttcccgcaccagccgctctcacgtgcccgtacacacaccaatgtgatgaatgcaacgagcccaccagccggttccaatgggaatagtgtgaccactcctggcaattccgtgcccccacctctgcctcgaagcaatagcctcccccatagtgccgtgagcaatgccggtagtaagagttcggtcatggacggagccatagcaagtggtgtatcaaagtttgcgacgttgagtctccatgaccggaaggagcgccatcacgagaaagatcacaaaagaaaccattcaatgggacacatctcatctaagtcttctgataaactaaatctggtgaccaaaacaaaaacagaccctgctaaaactctgggaactccactttgcccacgaatggaagacgtcccccttctggagccactaatctgtaagaagatcgctcacgagcgcctcacagttctgatctttctggaagattgcattgtgaccgcctgccaggagggatttatttgtacatgggggaggcctggaaaagttgggagtctgtcttctccatctcaagctagttcacctggcggaacagtggtgtag

SEQ ID NO: 61070 - DNA, 1338 bp, Artificial Sequence
  Description of Artificial Sequence: Synthetic coding sequence
atgtgggctgggagctgtactagcataagtactcggggttcagcgcgtcagagccacgagcgacttatcgataaatcaagagtgacctgtgttaagtgggtgcccggttctgaaagcttattcctcgtggctcactctagcgggaacatgtatctatacaacgtggagcatacctgtggcaccactgcaccacattatcaactcctgaagcagggggaatctttcgcggtccatacctgtaaatccaaatcgactcggaacccgctcctgaagtggaccgtgggcgagggggcattgaatgagtttgcattctcccccgacgggaagtttctagcttgcgtgagtcaggacggctttctcagggtgtttaatttcgatagcgtagaattgcacggcacaatgaagtcgtatttcggcggtctgctctgtgtttgctggtcacctgacggcaaatatatcgtgactggcggagaggacgatttggtgactgtgtggagcttcgtggattgcagggtaatagccaggggtcatgggcacaagtcctgggtgtcagtcgttgctttcgatccttacaccacctctgtggaggagggcgatcccatggagttctccgggagcgatgaagactttcaggatcttctgcacttcgggcgtgatagggccaatagtacacaatcgcgcttgagcaagagaaatagcacagatagtcgcccagttagtgttacttaccgatttggctccgtgggccaggacacacaactctgcctttgggacctgaccgaagacatcctatttccgcatcagccgctttcaagggctcggacgcacaccaacgtcatgaatgcaacctccccccctgcgggaagtaatggtaacagtgtgacaacacccggtaatagcgtgccccctcctctgccaaggtctaacagcctgccccattctgcagtctccaatgctggtagcaagagctctgtcatggatggcgcaatcgctagcggtgtttccaaattcgcaaccttaagcctgcatgataggaaagaaagacatcacgagaaagatcataaacgcaatcacagtatgggccatattagctccaaaagttctgacaagttaaatctggtgactaagaccaagaccgacccagcgaaaactttgggtacacctctctgtccccgtatggaggatgtgcctctgctggagcccctcatctgcaagaagatcgcccacgagcggttaactgttctcattttcctggaagattgcattgtaaccgcttgccaggaaggctttatatgtacctgggggagaccgggtaaggtggtttcgttcaatccgtag

SEQ ID NO: 61071 - DNA, 1803 bp, Artificial Sequence
  Description of Artificial Sequence: Synthetic coding sequence
atggctacagaggggggaggaaaagagatgaacgagatcaaaacgcagtttacaacccgcgagggactgtataagctgctccctcatagcgagtattccaggccgaaccgagttcccttcaatagtcaaggaagtaacccagtcagggtgagtttcgtcaatctgaatgatcagagtggaaacggagatcggctctgtttcaacgtgggcagggagctatatttttatatctacaagggcgtgcgcaaggccgctgacctttccaagcctattgacaaacgcatctacaagggcacccaaccaacctgccacgactttaatcacctgaccgctaccgcagagtccgtttcacttttggtgggattctccgccggtcaagtccaattaatcgatcccatcaaaaaggagaccagcaagctgtttaacgaggagaattcctgccaacacctgtggaaggttgactggaatgaggaaaggcaaaacgagggatccaagaccagcgaggaggctctagtgactgtgcagagactaattgacaagtctagggttacatgcgtcaaatgggtacccggaagtgaaagcctgttcctggttgcacactcatcgggaaacatgtacttgtataatgttgagcacacatgtgggacaaccgcccctcattaccaactgctgaagcaaggagaatctttcgcagtccatacctgtaaatcaaaatccaccaggaacccactgttgaagtggaccgtgggtgaaggtgccctgaacgaatttgcatttagtcccgacggaaaattcctggcctgtgtatcccaggacgggttccttcgggtgtttaacttcgacagcgtcgagctgcacggcaccatgaagagctacttcggtggactgttgtgcgtgtgctggtcccctgatggtaaatatatcgtgacagggggtgaggacgacttagtcaccgtgtggtcattcgtagactgccgcgtgatcgcgagaggtcatggacacaagagctgggttagcgtagttgcattcgatccgtacactacctcagtggaagagggcgaccctatggagttttcggggtccgacgaagattttcaggatctcctgcacttcggtagggaccgcgcaaatagcacacagagcaggctgtccaagcgaaactccacagactcaagacctgtgtctgtcacatatcgctttggaagtgtgggtcaggacactcagttgtgtctgtgggacctgactgaagatattctgttcccacatcagcctctctccagggcccgtacccacactaacgtgatgaatgccaccagccctccagccggaagcaacggcaacagtgtgactactcccggaaatagcgtccccccaccactaccgcgatctaactcgctgccccacagcgcagtttctaatgcaggtagcaaatcctctgttatggacggagctatcgcgtcaggagtgtcgaaattcgccacactgtcattgcacgacagaaaagagcggcaccatgagaaggatcacaagagaaaccattcaatgggccacatttcgtccaagtcgagcgacaaattgaatcttgtgaccaagactaagaccgatcccgctaagacacttggtactcctctgtgtccaaggatggaggacgttccgcttttagagccattaatctgtaagaagatcgctcatgagagactaaccgtgctcattttcctggaggactgtattgtcaccgcttgtcaggagggcttcatttgcacctgggggcgaccaggtaaagttgtatcctttaacccctag

SEQ ID NO: 61072 - DNA, 939 bp, Artificial Sequence
  Description of Artificial Sequence: Synthetic coding sequence
atgaaaagttactttggagggctgctgtgcgtgtgctggtctccagatggcaagtatatagtgaccggcggagaggatgaccttgtaaccgtatggagtttcgtggactgtcgggtgatagcacgcggacatggtcataagtcttgggtgtccgttgtggcattcgacccttatacaacttccgtcgaggaaggcgaccccatggaattcagtgggtctgatgaggacttccaggacttgctacattttgggcgagaccgcgctaattctacccagagccgcctgagcaagagaaacagtactgatagccggcctgtgagcgtcacataccgatttgggtccgtaggccaggacacccaactgtgcctgtgggatcttacggaggacattttgtttccacaccagcctctgagccgtgcacgaacccacactaatgtcatgaatgcaacaagccctcctgccggtagcaacgggaactccgtgaccacgccgggaaactcggttcccccaccactgccacgctcaaatagtttgccgcatagcgcagtgtccaacgccggtagtaagtctagtgttatggacggagcgatagccagtggtgttagcaagtttgccaccttaagcctccacgacagaaaggaacgccatcatgagaaagatcataagaggaaccattcaatggggcacataagctctaagagttcagacaaactcaatctcgttaccaaaaccaaaacggaccccgcaaagaccctgggtactccactgtgcccgaggatggaggatgttccacttctggaaccactcatctgtaaaaaaattgcccacgaaaggctaaccgtgcttatttttctggaagactgcatcgtgacagcctgtcaggaagggttcatctgtacctgggggcgaccgggtaaggtagtgagttttaatccatag

SEQ ID NO: 61073 - DNA, 1191 bp, Artificial Sequence
  Description of Artificial Sequence: Synthetic coding sequence
atgtacctgtacaatgtggagcacacttgtgggacaacggccccacactatcagctcttgaagcagggtgagtcattcgctgtccacacatgcaagtccaagtccaccaggaatccccttctcaagtggactgtgggagagggggcactgaatgagtttgccttcagtcctgatgggaagtttctagcatgtgttagtcaggacggcttcctgagagtgttcaactttgacagtgtggagctgcacggcacgatgaagtcctattttgggggtctcctctgtgtgtgctggagccccgacggaaagtatattgtgaccggtggggaggacgatctcgttacggtatggtcattcgtcgattgccgcgtaatcgcgagggggcatgggcataaaagttgggtgtcagtagtagccttcgatccttataccacgtccgtggaagagggcgacccaatggagttttctggctctgacgaggatttccaggacttactgcactttggtagggaccgggcaaattctacccagagccgactctcaaaacgcaacagcactgactcacgaccggtctcggtgacttatcgtttcggcagcgtcggtcaggatacacagctgtgcctatgggatttaaccgaagacattctctttccacaccagcccctgagtcgagccaggactcacacaaacgttatgaacgccacctctcctcccgctgggtcgaatggaaactcagtgacaactcccggaaacagtgtcccaccacccctgcctaggagcaactcgctaccccattccgctgtgtccaatgcaggatcaaagtccagcgtgatggatggtgccattgccagcggcgtgtccaaatttgcgacgctgtccctgcatgacagaaaagagcgacaccatgaaaaagaccacaagagaaaccactccatggggcacatctcttccaaatcaagtgataagttaaacctagttacgaagacaaaaactgacccggctaagacactcggaacgccactctgtccacgaatggaagatgttccgcttctcgagcccctaatctgcaaaaagatcgcccatgagcgcctcactgtgcttatctttctggaggattgtattgtgaccgcctgccaggagggcttcatctgtacgtggggacgtcctggcaaggttgtcagtttcaatccatag

SEQ ID NO: 61074 - DNA, 1527 bp, Artificial Sequence
  Description of Artificial Sequence: Synthetic coding sequence
atggccaccgaagggggaggaaaggagatgaacgaaatcaaaactcagttcaccacacgggaaggtctgtacaaattactcccacactccgaatatagcagacccaaccgagtgcccttcaactctcagggctccaatcctgtaagagtctcttttgtgaacttgaatgaccagtcaggtaacggtgaccgactttgttttaacgtcgggagggaactgtacttttacatttacaagggagtcaggaagcgcctgattgacaagtcacgggttacttgcgttaaatgggtcccaggttctgagagccttttcctggtggctcacagcagcggcaacatgtacctttacaatgttgagcatacctgtggaaccactgccccacattaccagttgctgaaacagggcgagagctttgcggtgcatacttgcaaaagcaagtccaccaggaaccccctgctcaaatggacggtgggagaaggggcactcaacgaatttgcattctcccctgacggtaagtttttggcctgcgtttcacaggacggtttcctgcgggtgtttaatttcgatagcgttgagttgcatggcacgatgaagtcatactttggaggtctgctttgtgtgtgctggagccccgatgggaagtatatcgtcacagggggtgaggatgatttggtaacagtgtggagcttcgtcgactgcagagtgattgccagaggtcacggacacaagtcctgggtgagtgtagtggcgtttgacccttatactacctcggtggaggaaggggatccaatggagtttagcgggagtgatgaggacttccaagacctgctccacttcgggagggatcgcgcaaacagcactcaaagcaggctttctaaacgtaattccaccgatagccgaccagtatctgtgacctatcgttttggcagtgtgggtcaagatacacagttatgtctctgggacctcacagaagatatcctctttcctcaccagcccctctcccgtgcgcgaacccacaccaacgtgatgaatgctacttcccccccagctggcagtaacgggaactctgtaaccacgcctggcaatagcgtacccccacccctgcctcgcagcaactctctgccccattcagctgtgagcaatgccggaagtaagagtagtgtcatggacggggcaatcgcttccggtgtgtctaaattcgccactctctccttacacgataggaaggaaagacaccacgaaaaggatcacaagcgcaaccactcaatgggacacatatcgtctaaatcatccgacaagctaaaccttgtgacaaagaccaaaactgacccagccaagacattgggcaccccactctgccctaggatggaagacgttccattactggagcccctgatctgtaagaaaattgcacatgagcggctaaccgtgctgattttcttggaagactgtattgtgactgcatgccaggaaggttttatctgcacatgggggagaccaggtaaggtggttagtttcaatccatag

SEQ ID NO: 61075 - DNA, 588 bp, Artificial Sequence
  Description of Artificial Sequence: Synthetic coding sequence
atggccaccgaaggaggcggtaaagagatgaatgagattaagacccagtttaccacccgagaggggctgtataagctgttaccgcatagcgagtactccagacctaaccgcgttccttttaatagccagggcagtaatcctgtacgagtctcctttgtgaatctgaacgaccagagcgggaatggtgatcggctgtgcttcaatgttggcagagaattgtacttctacatctataaaggtgtgagaaaggctgccgacctctctaagcccatcgacaagagaatctataaaggaacacagccaacctgtcatgatttcaaccatttaacagctacggcagaatcagtaagcttgcttgtgggcttctccgccggacaagtacaactgatcgatcctatcaagaaagagacctccaaactgtttaacgaggaaaactcatgtcagcacctgtggaaagtagactggaacgaagagaggcaaaacgagggcagcaagaccagtgaggaagctcttgttacagttcagcctgcagagcacttctgccggcaggaagaccgaatgcaaggagtgcttcaggatcagaattag

SEQ ID NO: 61076 - DNA, 1563 bp, Artificial Sequence
  Description of Artificial Sequence: Synthetic coding sequence
atggccacggagggcggaggaaaagaaatgaacgaaattaaaacacagtttaccactagggagggcctgtacaaacttctgccgcatagcgagtattctagacctaaccgggtgcccttcaacagtcagggctccaacccagttagggtctcattcgtgaaccttaatgaccagagtggtaacggcgacagattatgtttcaatgtgggcagagagctatatttctatatctacaagggggtcagaaagagactgatcgacaaatccagggtgacctgcgtgaaatgggtgcccggttccgaaagtctattcctcgttgcacactccagcgggaacatgtatctctataacgtggaacatacctgcgggacaaccgctccacactatcagttattgaaacagggagagtcatttgccgtgcacacatgcaaaagtaagtcgaccaggaatcctctgttgaagtggacagtgggagagggagcactgaatgaatttgcattctcgccagatggcaagttcctggcatgcgtgtcacaagacggtttcttgcgggtgttcaattttgattcagttgagctgcatgggacaatgaagagttatttcggcggtttgctgtgtgtgtgttggtcacctgatggcaagtacattgtcactgggggtgaagacgacctcgtgaccgtgtggtccttcgtcgactgcagggtgatcgctcggggtcacggtcacaagtcctgggtgagtgttgtcgcctttgatccatacaccaccagcgtcgaagagggggatccaatggagttctctggatcagatgaagatttccaggacctgctccatttcggacgggatcgggcaaactcgacacagagcagactgtccaaaaggaattccacagacagccgccctgtgtcagtcacctaccgattcgggagtgttggacaggatacccaactgtgcctttgggatctgaccgaggatattttgttcccgcatcagcctctctcgcgtgcacgcacgcacaccaacgtcatgaacgccacttccccgccagcgggaagcaacggcaattctgttacaacccctggaaactccgttccgccacccttaccacggtccaactccctgccacactcggccgtgtcaaatgccggaagcaagagcagcgtgatggacggcgctatagcatcaggagtgagtaagttcgcgaccctgtcactgcatgataggaaggagagacatcacgaaaaagaccacaagcgaaaccattccatgggccacatctcaagcaagtctagtgataagctgaatctggtcacaaaaactaagaccgatccagccaaaacgctagggaccccactctgtccccgaatggaggatgtacctttactggagccccttatttgtaagaagattgctcatgagagattaaccgttttgatatttctggaggactgtatcgttacagcctgtcaggaaggctttatttgcacttggggcaggcctggaaaggtagggagtctttcctcacccagccaggcatcgtctcccggaggcactgtcgtgtag

SEQ ID NO: 61077 - DNA, 2763 bp, Artificial Sequence
  Description of Artificial Sequence: Synthetic coding sequence
atgggcaaaaagcgtacaactagcggcgagggcagggagcgacagcgcctgcctgcgaggagatttagaaccactagtccagcagcactccgcgctgactctgtggacggcggtagcctactggctccactgttgggactgactgacagggcatttagtgactgcccggatcttgcggacggcgctatggaaaaaatgagccgtgtcaccaccgccctgggtgggtccgtgctgacagggagaaccatgcactgtcatctggacgcacctgccaacgcgattagtgtgtgtcgcgatgcagctcaggtcgtcgttgcgggaagaagcatcttcaagatttacgccattgaagaagaacagttcgtcgaaaagctgaatctgagggtcggtagaaaaccttccctgaatctcagctgcgctgacgtcgtctggcaccaaatggatgaaaatctcctggctacagcagccaccaatggggtggtggtgacctggaacttgggccgaccatccagaaataagcaggaccaactcttcaccgagcacaaaaggacagtgaataaagtgtgctttcatcccactgaggcacacgtcctcctttcaggttcccaggacggattcatgaaatgctttgatctgagacgaaaagatagcgtgtctactttctccggggaagcgacagaggctggcccaagggaatgggcaatggcgggttgcgtgccaattttgcctgttctctcctgtagaatcctccgtctgcatcactcctttgcccacggtcctatgcaggatgctgagtccactgccaacgacgcacgcgaaagttggggctgcccactatatcccctggggctttgctctggcccacaagcgggtcagtccgaaagcgtaagagatgtccaattttccattcgtgactacttcaccttcgcgtcaacatttgagaatggtaatgtgcaactctgggacataaggcgtcctgacaggtgcgaacgaatgttcacggctcacaacggcccagtcttttgctgtgattggcatcctgaggacaggggctggcttgctaccgggggacgcgacaagatggtgaaggtatgggatatgaccacgcaccgggctaaggagatgcattgcgtgcagaccatcgccagcgttgctcgagttaaatggcgcccagagtgtagacaccacctcgccacatgctccatgatggtggaccacaacatttatgtatgggacgttcgtcgcccttttgtgcccgctgcaatgttcgaggagcatagagatgtcacaactggtatcgcatggcgacacccacacgacccaagtttccttctgagcggcagcaaagacagtagtttatgtcaacacctgtttcgcgatgcaagccaaccggtggagcgagccaatcctgagggtctgtgttatgggctgttcggcgacctggccttcgcggctaaggaatcgctggttgcagcagagagcgggcgaaaaccctatacgggcgatcggaggcatccgatcttctttaagagaaagcttgatcctgccgagccgtttgctgggttagcatctagcgctctctccgtgtttgaaaccgaacctgggggtggaggcatgcgctggttcgtagatactgcggagaggtacgccctggcgggtagacctctcgccgagctatgtgatcacaatgctaaggtggccagggaattaggtcggaatcaggtcgcgcagacttggaccatgttaaggatcatatactgctctcccggtctggtcccgactgctaatttgaatcatagcgtgggcaagggagggtcatgcggcctcccattaatgaattctttcaacttaaaggacatggctcccggtttgggctctgaaaccaggttagaccgctctaaaggcgacgcacgcagtgatacagtgttattggactcttccgctactctgatcaccaatgaggataatgaggagacagaaggctcagacgttcctgccgactatcttttaggagacgtcgaaggggaggaggacgaattgtacttattggatcccgaacacgctcaccccgaagacccggagtgtgtgctgccccaggaggcgttccctctaagacacgagattgtagataccccaccaggcccagagcacctccaagacaaggcagatagcccacacgtgtcaggctccgaggccgacgtggccagcctagccccagtcgattcttctttttcccttctgtcagttagccacgccctttacgatagccgactccccccagacttcttcggcgtgcttgtgagagacatgcttcatttttacgctgaacagggagatgtgcagatggccgtctccgtgctgattgtccttggagagagggtcagaaaagacatcgatgagcagacacaggaacactggtatacatcttatattgaccttttgcaacgcttccgactctggaacgtaagcaatgaggtggttaagctgtcaacgtcgagggccgtttcatgtctcaaccaggcaagtaccaccttgcacgtgaactgctcacactgcaagagaccgatgtcgagtcgcggatgggtttgcgatcgatgccatagatgtgcatctatgtgtgctgtctgccaccatgttgtcaagggtctctttgtgtggtgccagggctgctcccatggtggacatttacaacacatcatgaaatggctggagggatcctcgcattgcccagcaggttgcggacacctgtgtgaatactcatag

SEQ ID NO: 61078 - DNA, 2373 bp, Artificial Sequence
  Description of Artificial Sequence: Synthetic coding sequence
atggagaaaatgagcagggtaaccaccgccctgggcggtagtgtgctcactggtaggacaatgcattgtcatctggatgcacccgcaaacgctattagcgtgtgtagggacgctgcccaagtcgtcgttgctggccgatctatcttcaagatttacgctatagaggaggaacagttcgtggaaaagctcaacctaagagttggacggaagccttcacttaacctatcttgtgcggacgtggtttggcatcagatggatgagaacttgctagctaccgccgctaccaatggcgtggtggttacgtggaaccttggccgacccagtcgcaataaacaggaccaactgtttaccgaacacaagcgtaccgtcaataaagtctgcttccaccctacagaggctcacgttcttcttagtgggagtcaggacggttttatgaagtgctttgatctccggaggaaagattctgtcagtaccttctctgggcagtcggaaagcgtccgagacgtccaattttctatacgcgattattttacctttgctagcactttcgaaaacggcaacgtgcagctttgggacattcgcaggcctgatcgctgtgaacgaatgtttacagcgcacaatgggcctgtgttttgttgcgattggcacccagaggaccgcggttggttagccaccggcggaagggataagatggtcaaagtttgggacatgactacgcaccgtgcaaaggagatgcactgcgtgcagacgatagcttccgtggctcgagtgaagtggaggcccgagtgccggcatcacctggccacctgctctatgatggtcgatcacaacatatatgtgtgggacgtccgcaggccttttgttcccgcagccatgtttgaagaacacagagacgttactacaggcattgcatggaggcatccacacgacccttccttcctgctgtcaggaagcaaggatagctcactgtgtcagcatcttttccgggacgccagccagcccgtggaacgagctaaccccgaaggactgtgttatggactgtttggcgacctcgcattcgcagccaaagaaagtttggtcgctgccgagtctgggagaaaaccttacactggcgacagacgacatcccatctttttcaagaggaaactggacccagccgagccatttgctggcctcgctagctcagctttgagtgtgttcgagacagagcctggtggtggcggtatgcgctggtttgttgacacggcggaacgctacgccctggccggtaggcctctggctgaactgtgcgatcacaacgcgaaggtggccagggaactggggagaaaccaagttgctcagacctggacaatgctgcgcatcatctactgctcccccggtctggttcccaccgccaacctgaaccatagcgtgggtaagggaggctcctgcggtttgccactgatgaattcctttaacctcaaggacatggccccaggcctgggaagtgagaccagactggataggtccaaaggggacgccagatcagataccgtactgctggatagctctgccacactgattactaatgaggacaatgaggaaactgaaggaagcgacgtgcctgcagactatttgctgggagacgttgaaggcgaagaagatgagctgtacttgcttgaccctgaacatgcacacccagaagaccctgagtgcgttttgccccaggaagccttccctctgagacatgagatagtggacacaccccctggtccagagcacctgcaagacaaggctgacagtccccatgtgtctgggagtgaggcagatgttgcatcgctggcaccagtcgactcgtcatttagcctgctgtccgtgtcgcacgccctatacgatagccgcctgcccccagacttctttggcgtgctggtgcgagacatgctgcacttctatgcagagcagggcgacgtgcagatggcagtctctgtgctgatcgttctcggggagcgcgtccggaaggacatcgatgagcagacacaagaacactggtacacatcctatatcgacctacttcagcgctttcggctctggaacgtgtctaacgaggttgttaagctttccacctcaagggctgtgagctgcctgaatcaggcctcaacaaccctccacgttaattgctctcattgtaagcggcctatgtcctcccgcggttgggtgtgtgaccgatgtcacaggtgcgctagtatgtgtgccgtatgccaccacgtcgttaaggggctcttcgtttggtgtcaaggatgctcgcacggcggacacttacagcacattatgaagtggttagagggctcttctcactgtccagccggttgcggacatctgtgcgaatacagttag

SEQ ID NO: 61079 - DNA, 1635 bp, Artificial Sequence
  Description of Artificial Sequence: Synthetic coding sequence
atgaccgcccgaaccttaagcttgatggcatccctggtggcttatgacgactccgattcagaagcagaaaccgaacatgctgggagctttaacgcaacaggccagcagaaagacacaagcggggttgccaggccaccaggccaggattttgcatcaggcactctggatgtgcccaaggctggtgctcagccaaccaaacacggttcctgcgaggaccccggtggctatcgtctacccctggcacagctggggagaagcgattggggatcttgtccaagccaacggttacagtggcccggaaaggagccacaggtcacattcccgatcaaggagcccagctgcagcagtctgtggacttcacacgtgcccgcaagccacatgccacttgcagccgctagattcaagcaggtgaagctatctcggaatttcccaaagagctcatttcatgcccagtcggagtcagagactgtgggcaagaacggctcctcctttcagaagaaaaagtgtgaggactgcgtggtcccttacacccctaggagactgcgccaaaggcaagcgctgtctaccgagaccggcaagggtaaagatgtcgagccgcagggacctccggcaggtcgggcacctgcccctctatacgtgggacccggtgtgtctgagttcatacaaccctatctgaattcacactataaagagactactgtacccaggaaagttttgttccatctgcggggacaccggggtcctgtgaatacaatacaatggtgtcccgtactgagcaaatcgcatatgctgctgtcgacctctatggataaaactttcaaggtgtggaatgctgttgactccggccattgtttgcaaacctatagccttcacactgaagcagtgagagccgctcggtgggcaccctgtggcaggaggatcctaagtggcggattcgactttgcgctccaccttacggatttggagacggggacccaactgttcagcgggcgttcagactttcggataacaaccctgaagtttcatcctaaggatcacaacatcttcctctgtgggggattcagctccgagatgaaggcttgggatatccggacaggaaaggtgatgaggtcttataaggccactatccagcaaacactggacattctctttttacgtgaggggtctgagttcttaagttctacagacgcttcaacacgcgactctgctgatagaacgatcatcgcatgggactttaggacttctgctaagatcagcaaccagatatttcacgagcgcttcacgtgtccgtcactcgctctccacccgcgagaacctgtgtttttagcacagacaaacggcaactaccttgccctgtttagtacagtgtggccctaccgtatgtcacgacggaggcgctatgagggccacaaggtagagggctatagcgtcggatgcgagtgttccccaggaggggacctcctggttaccgggtctgcggacggccgagtactgatgtacagcttccggactgcctctcgggcttgcacccttcagggccatacacaagcatgtgtgggcacaacttaccacccagtgctgccttcagtgctggctacatgttcctggggaggggacatgaagatttggcactag

SEQ ID NO: 61080 - DNA, 1635 bp, Artificial Sequence
  Description of Artificial Sequence: Synthetic coding sequence
atgacagcgaggactctcagtctcatggcatccctcgtcgcatatgacgactccgacagcgaagctgagacagagcatgctggatccttcaatgctactggccagcagaaggacacctccggtgtagcacgtccaccgggtcaggactttgcatccggcacactcgatgtccccaaggccggtgctcagcctacaaagcacggctcttgcgaggacccaggcggatatcgtctgccgttggctcagctgggaaggagtgactggggttcctgcccttcccagcgccttcagtggcccggaaaggagcctcaggtcacgtttcccattaaagaacctagttgtagctccttatggacctctcatgtgccagcctcccatatgcctctcgcggctgccagatttaagcaggtaaaattgagtaggaacttccccaaatccagtttccacgcccaatcggagtcagagaccgtaggcaagaacggaagcagtttccaaaagaagaagtgtgaagactgcgtggtgccatatacccccaggcgtctgaggcaacgccaggctcttagcacggagacagggaagggaaaagatgtggaaccacaagggccacctgcgggtagggcacccgcacccctatacgtcgggcctggtgtgagcgaatttatccaaccctacctcaattcacactacaaagaaactactgttccgaggaaggtcctcttccacctgaggggccataggggaccagtgaacactatccagtggtgtcccgtgctctcaaagtcccacatgcttcttagcacaagtatggataagacatttaaggtttggaacgcagtcgattcaggacattgcctgcagacttactcactccacacagaagctgttcgggctgcaaggtgggccccttgtggcagaagaattctcagcggcggttttgactttgccttgcaccttaccgacttagaaaccggaacccagttgttcagcggacgctccgatttccggattaccactctgaagtttcatcctaaggaccacaacattttcctgtgcggtggcttctccagcgagatgaaggcttgggatattaggactggcaaggtgatgcgaagttataaagccaccatacagcaaaccctggatatcttattcctgcgcgaggggtcagagtttctctcatcaaccgacgcatcaacccgggactccgcggaccgtaccatcatagcatgggactttcgcaccagtgccaaaatatctaaccagatattccacgaaaggtttacctgtccctccctagccctgcatccaagggaacctgtttttcttgcgcagacaaatggcaactacctcgcgctcttttccacagtttggccttaccgcatgagcagacggagacgttacgaaggccacaaggtggagggctacagcgtgggatgcgagtgcagtccaggcggtgatcttctggttacaggctccgccgacggccgagtactcatgtactctttccgcacagcgtcacgcgcatgtacactgcagggccacacacaggcttgtgtcggaacaacgtaccatccagtcttgccttcagttctcgctacatgttcctgggggggtgatatgaaaatctggcattag

SEQ ID NO: 61081 - DNA, 864 bp, Artificial Sequence
  Description of Artificial Sequence: Synthetic coding sequence
atgcctgcactgtgtctggtgctgtgttggtttcagggcttgctcggggaagtgtggaatgccgtggacagcgggcattgtctccagacctactcactgcacacagaggctgtgcgcgcagctcgatgggcgccttgcggcaggagaattcttagcggagggttcgattttgccctgcacctgactgacctggagaccggtacccaactatttagcggacgatctgattttcgaatcactaccctgaaatttcacccaaaggaccataatatcttcctttgtggcggattcagttccgagatgaaggcctgggatatacgtacggggaaggtgatgcgcagttataaagctaccatccaacagactttagacatactatttttgcgagagggatctgagttcctcagcagtactgacgcctccacacgagatagcgccgacaggaccataatagcctgggacttcaggacgtctgccaaaatatccaatcagatcttccacgagaggttcacttgtccatcccttgccctccacccaagggagccagtgtttctcgcccagacaaacggcaattacctcgctctgttcagcaccgtttggccataccgaatgtccagaagaagaaggtacgaaggacataaagtggagggatacagcgtaggctgcgagtgcagtcccggtggcgatttacttgtgacaggctctgccgacggccgtgtgctgatgtacagttttagaaccgccagcagggcttgtacactgcagggacatacccaggcctgtgtcggcaccacttatcacccagtgctgccatctgttctggcaacttgctcctggggcggagatatgaagatctggcactag

SEQ ID NO: 61082 - DNA, 1635 bp, Artificial Sequence
  Description of Artificial Sequence: Synthetic coding sequence
atgaccgccaggaccttgagtcttatggcatccctggtagcatatgacgacagcgattccgaagcggagacagagcatgccggtagcttcaacgctaccggtcagcagaaagatacttccggagtggcacgcccacccggacaggacttcgctagcgggacgctagacgtgcccaaagctggcgctcagcctacaaaacacggcagttgtgaagaccctggaggttatcggctgcctctggcacagctgggtcgttccgattggggcagctgtccaagccaaagactgcagtggcccggaaaggagccgcaagtcacattccctattaaggaaccttcatgctcctccttgtggaccagtcatgtgccagcttcccacatgcccctggctgctgctagatttaagcaagttaaactttctcggaactttcctaagtcaagtttccatgcccagtctgagtcagaaacagtgggcaaaaacgggagctctttccaaaaaaagaaatgcgaggactgcgtagttccatatacccccaggagactgcgacagcggcaggccttgagcacggagaccggcaaaggaaaggacgtagagcctcagggccctccagctggcagggctcctgctccactatacgttgggcctggagttagtgaatttatccagccctatctgaattcacactacaaggagaccacagttccccgaaaggtgttattccatcttcggggacaccgcggacctgttaacaccatccagtggtgccctgtcctttcaaagtctcacatgcttctctctacctccatggacaaaacatttaaagtttggaacgcagtggactcaggacactgcctgcagacatactctcttcatactgaagcagtgagagctgccaggtgggcaccatgtggcaggcgaattctatctgggggatttgactttgctctgcatctgactgacctcgagaccggcacacaactttttagcggcagatcagacttccgcatcaccactctaaaatttcatccaaaagaccataatatctttttgtgtggcggattctcctctgaaatgaaggcttgggatatcaggaccggcaaggtgatgcgcagctataaagctacaattcagcagaccctggacatcctcttcctcagggaaggaagcgagtttctttcatcaacagatgcgtctacgagagattctgcggatcggaccatcatcgcttgggacttcaggacatccgcgaagatctcaaaccaaatcttccacgaacgctttacctgtccctcgctggcattgcacccccgtgagccggtgtttttagcccagacgaatgggaattacctcgcgctcttcagtacagtgtggccctaccgaatgagtcggcgaagacgctacgagggacacaaggtggaaggatactcagtgggctgcgaatgctccccaggaggcgatctgctcgttaccggttctgccgacggcagagtcttaatgtattcctttcggaccgcaagccgtgcgtgcacacttcaggggcacacacaggcgtgcgttggtacgacgtaccaccctgtgctgcctagtgtgctcgccacatgctcatggggtggagacatgaaaatctggcactag

SEQ ID NO: 61083 - DNA, 2574 bp, Artificial Sequence
  Description of Artificial Sequence: Synthetic coding sequence
atggagaatcctcaagacatctttagcagtaacgggggatgcctgtctgatatcgtgatcgagaaatatctggttgagtcaaaagagagcgtgagccacgtgcaactagcttgttccatgcaagattgtgctttccccctggacgggacagaactgtgtatctggaatacgaaggatcccagccatcagttattgatattgcgaggtcaccaccaaccaatcacagcaatggcctttggaaataaggtgaatcctctcctcatttgctctgctagtctcgattacgtgattatgtggaacctggatgagtgtcgggagaaagtcctgcagggactggtgcctagaggaactgtgatgggctccctgctcggtaaggttctctgcttacagttgtccctcgatgaccatgtcgtagccgtgtgtgccggtaataagatcttcatgctggatatcgagcagagattctctgttacatacatcgagcgaccggatgtgaacaatcgtcacaaagtcccccctccaacctttcttcatacattttcccagacacaggccgttagggccgagctgcagggccaccttgggccagtcaccgcggtagaattttgtccctggcgcgctgggacactaatctcagctagtgaggatcgcggtttcaaagtgtgggaccattgtactggatctctgatatattcttcttcggtattgtcggcgtacccactcctctctctgttcattgatgcagagagcagacaattggtcaccgggtgtgcagacggtcagctgtggatcttttcgctcatggacggacaccactatcggagagtggcgagagtggatctgaggaaaaagacggaaacctttagtactaggagagtgaagtctggcctatgctcccagccagaggaatctcagcttccaagtactagtgccctcggcaagggggaacaggttgaagtgacctttcccgtactgaggctggccccttgcgatttaagtttgattccgaactcggcatgcggatgtttgtcaagcgagaacacacgatgtgtgtggatcggaagctccgtgggactgttcgttttcaatctagcgaacctggaggtggaggccgcactctactacaaagactttcaatccctgtcaattctcctcgcagggtcatgcgctctgaggaaccggacagccgaccaaaaagtgctttgcctcctcgcctcacttttcggcggaaagatcgccgtgttagagattaatccggcagccctggttagagctcagcagtgcccaagtatgggtcagagtctcagcgtacctgcttcatcgtgcgtgctgccgacctctcctctctacctaggaatcgccaaggagaagagcactaaagcagcctccgagcagaggcgtgctgcccgtaatgttatgaaagatcaaaggctggtgttccatagcaaggttagatccagcggttacgcctctgcacctcacgtgacaatgttttctcccaagacaaacatcaaatccgaaggcaagggctcttcacgatcgcggtcttcatgtgcgagggaagcttaccctgtagagtgtgccgtgcctactaagcccggtccacaggttgccgcagcccctacatgtacaagagtctgttgtatccagtattctggagatgggcaatggctggcgtgcggactcgctaaccaccttctcctcgtctttgatgcaagcctcaccggcacccccgctgtgtttagtggtcatgacggcgcagtcaacgcagtctgctggtctcaagaccgccgatggctgttgtctgctgctcgggacggtacactgcgcatgtggtccgccagaggagcagagctggctctccttctggggaaagacatgttttctaagcccattcagagtgcccagttttactatattgacgcattcattttgctctcaagtggaccggagttccagctattgcggtatcacattgatacttgcaaggacgaaataaagagatataagcagaaatcgaagagcaaattgatttgtcggctgtccacaacgggcgctgtcgacatgacctctttgtcagccgttaatgacttttactctcatatcgtcctggccgctgggaggaaccgaaccgtcgaggtgtttgatctgaatgcaggttgtagtgcagctgttatcgcagaggctcatagcaggccagtgcatcaaatctgtcagaacaaagggtcatcatttactacacagcaaccccaggcttacaacctgtttctgacgacggccatcggtgatggcatgaggctgtgggatctaagaacactgaggtgtgagaggcacttcgaaggtcatcccacccgcggatacccctgtggaattgctttctccccctgtggaaggtttgccgcatgtggcgctgaggaccggcacgcgtacgtttatgaaatgggcagctccactttctctcaccggctggctggccacacagacaccgtcactggtgtagcattcaacccctcggcccctcagctggcaacggcaactctcgacggcaagctgcagcttttcctggctgagtag

SEQ ID NO: 61084 - DNA, 546 bp, Artificial Sequence
  Description of Artificial Sequence: Synthetic coding sequence
atggaaaacccacaggacatcttctcaagcaatggtggctgtctttcggacatcgtcatagagaaatatctggtggaatctaaggagtcggtctcccacgtgcaactagcttgttcgatgcaagattgcgcgtttcctctggacggaacggaactatgcatctggaacaccaaggacccttcccaccagttactgattttaagaggtcatcaccagcccattaccgctatggcgtttggtaataaggtcaaccctctcctgatctgttctgcctcgcttgattacgtgattatgtggaatctggatgagtgtcgggaaaaggtgttgcagggactggtgcccagagggacagtaatgggcagtctgttaggaaaggtgctgtgtctgcagttgtctctggatgaccacgtggtggcagtttgtgcaggcaataagatcttcatgctggatattgagcacatcttattttccgtgtacagcctcatgcagaaagccggatcctggagtccgggagtgctcacggctagtttcggcagctcggtgtag

SEQ ID NO: 61085 - DNA, 2193 bp, Artificial Sequence
  Description of Artificial Sequence: Synthetic coding sequence
atggagaatccacaggatatcttttcgagcaacgggggatgcctttctgatatcgttatagagaaataccttgttgaaagcaaagagtcggtgtcgcacgttcaattggcatgcagcatgcaggattgcgcctttcccttggacggcacggaactgtgtatctggaataccaaggatccatcccatcagttgctcatactgaggggccaccaccagcccataacagcaatggccttcggcaacaaggtgaatcccttgctgatttgctctgcttctctggactacgttattatgtggaacttagacgaatgtagagagaaggtgctgcaagcctaccctctgttgtcactatttattgacgcagagtcccggcaattggtcactgggtgtgcagacggacaactgtggattttcagtctgatggacggtcaccattatcgccgtgtggcaagagtggatttaagaaaaaaaactgaaacattcagcacgcggagggttaagagcgggctgtgttcccagcccgaagagagccagctcccttcaacaagcgctctgggcaagggagaacaggtcgaagttactttcccagttctcagactcgccccttgcgatctatcattaatccctaacagtgcttgcggatgcctgtcgtcggagaatacaagatgcgtgtggatagggtcctctgtgggtctgtttgtgttcaacctggccaatctcgaggttgaggccgctttgtattacaaggactttcagagtctcagcatcctgctcgccggatcctgcgctttaaggaaccgcaccgctgaccagaaggtcctgtgtctgttggctagcctgtttggcggaaagatcgccgtgctcgagattaatccggcagctctcgtaagagcacaacagtgccctagcatggggcaatctctgagtgtgccggcaagcagctgtgtgctgccaacatcccctctatatctgggaattgcaaaggagaagagcaccaaggctgccagtgagcagcgaagagctgcccgtaacgtaatgaaggaccagcgattagtctttcattccaaggtgcggtcctccgggtatgcctccgctccccatgtgacgatgttttcacctaaaaccaacattaaatctgagggcaaggggtcgtcacgcagtcgctcatcttgtgcacgtgaggcctatcccgtggagtgcgctgtcccaactaagccgggaccccaggtcgccgcagctcccacatgtactcgcgtgtgttgcatccaatatagcggcgatgggcagtggctcgcgtgtggtttggcaaaccaccttttgctcgtctttgacgccagcctgacaggaacccccgcagtgttttcagggcatgacggcgctgttaacgccgtttgctggagccaggaccgccgatggctcctatccgccgctcgggatggaacgctgcgcatgtggagcgcccgtggcgctgagttggctctgttgctcggcaaagatatgttcagcaagccgatccagtccgcacagttctactatattgatgcctttattctcctctcatctggcccagaattccagctgctacggtaccacatagatacatgcaaggatgagattaagaggtataaacagaagtcaaaatccaagcttatatgtcggctatccactacaggtgctgtggatatgactagtctgtctgcggtgaatgatttctattcccatattgtgctggcggcaggaagaaaccggacagtggaagtgttcgatctaaacgccggttgctcggctgccgtgattgctgaggcacattcacgaccggtccaccagatttgtcaaaacaaggggagtagctttaccacccagcaaccgcaagcatacaacctgtttctaacaactgccatcggggacggtatgagactctgggatttgcgaaccctgcggtgcgagcgacactttgagggccaccccacgaggggttacccctgtggaattgccttttcgccttgtggccgatttgccgcttgcggggcagaggacaggcatgcatatgtctatgaaatgggatctagcacgttctctcaccggctggcgggacatacagatacagtgaccggtgtcgccttcaacccaagcgccccacagctcgctaccgccaccctagacggtaaattgcaactcttcctcgccgagtag

SEQ ID NO: 61086 - DNA, 2688 bp, Artificial Sequence
  Description of Artificial Sequence: Synthetic coding sequence
atggagaatccacaggatattttctcctccaatggcggttgcctgagcgacatcgtcattgaaaaatatttggtggagtcaaaagagagtgtctctcatgttcaactcgcgtgtagcatgcaggattgtgcttttcccctcgacggcactgagctttgcatctggaacaccaaggatccttctcatcagcttctcatcctacgcggtcatcatcagccgatcacagccatggcatttggcaataaggtgaacccactcctgatctgcagcgcctcgctggactacgtaatcatgtggaacctagacgaatgtcgggagaaggtactgcagggcctggtcccgaggggcaccgtcatgggatcgctgctggggaaagtcctctgtctgcaacttagcctggacgatcacgtggtggcagtgtgtgcgggaaacaaaatattcatgctggacatcgaacagcgatttagtgtgacatatatcgagagacctgatgtcaacaacaggcataaggtgcctccacccacatttctccatacgttttcgcagacgcaggcagtaagggcggagctgcagggccatcttggacccgtcacagcggtggagttctgcccatggcgggctggcacccttatcagcgcctctgaagatagaggatttaaagtgtgggaccactgtaccggctctctcatctactcatctagcgttcttagcgcttacccattactgtctctgttcatcgacgcagagagccgacaactggtaacagggtgcgccgacggacagctctggatcttttctctcatggatggccatcattacaggagagttgccagagtcgacctgcgcaagaagactgagactttcagtactaggcgggtgaaatctgggctctgttcgcaaccagaagagtcccagctgccatcaacctcagctctcggtaagggcgagcaagtggaggtgacattccccgtgctcagattggctccctgcgatctgagcctgattcccaattctgcttgcgggtgtttgagctccgagaatacaagatgtgtgtggatcggaagctctgttggtctgtttgtgtttaacctcgctaatctggaggtagaggcagccttgtactataaggattttcaaagcctgtctattttgctggcgggaagttgcgcgctgcgcaaccgcactgctgatcagaaagtactttgccttctggcgtcacttttcggtgggaaaattgctgtgctcgaaatcaaccctgccgctttggttcgcgcacagcagtgccccagcatgggacagtcattgtcagttcccgcttcttcttgcgtattgccaacttccccattgtaccttggcattgccaaggaaaagtccacaaaagccgctagtgagcaacggagagctgctaggaacgtgatgaaagatcaaaggctggtcttccactcgaaagttcggtctagtggatatgcgtctgcccctcacgtgaccatgttttcccccaaaactaacataaaatctgaggggaagggcagctcaaggtcacggagtagctgcgctagagaggcctatcccgtggagtgcgctgtcccaacaaaaccaggaccgcaggtggcagcagccccaacttgcacacgggtttgttgcatccagtacagcggggatggacagtggctggcctgcggcctagcgaaccacttgcttttggtgttcgatgcctctttaaccggcacacccgcagtgttttcaggtcatgacggagcagtgaatgccgtatgctggtcacaggataggcgatggctgttatcggccgctcgtgacggtactcttcgcatgtggtccgcccgtggcgctgagctcgcccttttgctagggaaggacatgtttagcaaacccattcaaagtgcacagttctactatatcgatgcattcatcctgctatcatctgggcctgaatttcaattactcaggtaccatatcgacacatgcaaggacgaaataaaaagatacaaacagaaaagtaagtccaagttgatatgcaggctcagtactaccggtgccgtggacatgacttccttaagtgccgtgaacgacttctacagccatatcgtgttggctgctggcagaaatagaacggtggaggtgtttgacttgaatgccggttgtagtgccgcagtcatcgcagaagctcactctaggccggttcaccagatttgtcagaataagggaagctccttcaccacacagcagccacaagcgtataatctctttctgacaaccgctatcggagacggaatgagactctgggatttgcggacgctgcgatgcgagcgccattttgaaggacatccgacgcggggttatccatgtggcatcgcgttcagtccctgtggcaggtttgccgcatgcggcgctgaggacagacacgcctatgtctacgaaatgggtagtagtacgttcagccacaggctggcgggacacaccgatactgtgaccggagttgcatttaacccctctgctcctcagatggaaagccgctcagtagcccatgcaggggtccagtggcacgacctgggctccttacagccaccgccatcgcgctttaagcaatttttctgtctttctctgccttcgtcctgggattattccttgccgcagctgccttggatggtgaattcatcatctttttag

SEQ ID NO: 61087 - DNA, 267 bp, Artificial Sequence
  Description of Artificial Sequence: Synthetic coding sequence
atggagaaccctcaggacatctttagcagtaatgggggatgcctatcagacatcgtgatcgaaaaatatcttgtagaaagtaaggagagcgtgtcacacgtccagctggcttgctccatgcaagattgtgccttcccccttgatggaacagaactatgtatctggaatactaaggatccaagccatcagttactgatcctccggggacatcatcagcctatcaccgccatggcctttgggaacaaggtcaatccactgctgatctag

SEQ ID NO: 61088 - DNA, 1101 bp, Artificial Sequence
  Description of Artificial Sequence: Synthetic coding sequence
atgctcctgctccgatgccaactaaaacaagctcctcctcagaaagtgagtttcagattctgcgtagtaatgggcaaacagcagtctaagctcaaacatagcacttacaagtatggtccagacgagatcattgaggaacggattcagaccaaagccttccaggaatactctccagcgcacatggatactgtgtccgtggtagctgcactgaacagtgacttgtgtgtttctggaggcaaagataaaaccgtcgtcgcgtacaattggaaaaccggaaacgtcgtgaagagatttaaaggtcatgagcacgagatcaccaaggtggcctgtattcccaagagcagccagtttttcagcgctagccgtgataggatggtcatgatgtgggatttgcacggtagctcgcagcctagacagcaactgtgcgggcacgccatggtggtaacgggactcgctgtgagccctgattcctcccagctgtgtacaggatcgcgggacaatactctgttgctgtgggacgtggtgactggccagagtgttgaacgcgcaagcgtaagccgcaacgtggtgacacatctgtgctgggtcccccgagagccatatatactccagacgtcggaggataaaaccttgcggctatgggattcacgcggattgcaggtggcccatatgttccccgctaagcagcacatacagacttactgcgaggtgtctgtcgatggtcacaagtgcatttcctgctcaaatggctttgggggtgagggctgcgaagcaaccttgtgggacttgcggcagacccgtaataggatctgtgagtacaaaggccacttccagacagtggcaagttgcgtattcctgcccagggctcttgcgcttatgccgctcatcgccacatcatctcatgactgcaaagtaaagatttggaatcaagatactggcgcatgtctttttaccctctccctggatgggagcggcccactgacaagtctggccgtgggggatgcaatctcattgctatgtgccagtttcaacagaggcatacacctgctgagaatggaccacagccagggacttgaactgcaagaggtggccgcattttag

SEQ ID NO: 61089 - DNA, 1104 bp, Artificial Sequence
  Description of Artificial Sequence: Synthetic coding sequence
atgcttctcctgagatgccaactgaaacaggctcccccacaaaaggtgtcatttcggttttgtgtggtgatggggaagcaacagtcaaagctcaagcactccacctataagtatggcagaccagatgagataatcgaggaaagaatccagaccaaggctttccaggagtattcccccgctcacatggacacagtctctgtcgtggccgctctgaactcggatctgtgcgtcagcggagggaaagacaagacagtagttgcctacaactggaagacaggtaacgtagttaaacgattcaagggccacgagcatgaaatcactaaggttgcgtgcattcccaagtcatcacagttctttagtgcatctagagacaggatggtgatgatgtgggatctccacggaagctcccagcccagacagcaactctgtggccacgctatggtggttaccgggttagcagtcagccctgatagctcccagctctgtaccgggtcgcgcgataacacgttgctgctctgggatgtcgtgacaggccagagcgttgagagggcctccgtgagccgtaacgtggtcacccatttgtgttgggtgcccagggagccttatattttgcagacgtccgaggataaaaccctccgactttgggacagtcgcggtctccaggtcgcccatatgtttcctgccaagcagcacatccagacctactgtgaggtgtctgtcgacggacataaatgtatttcctgcagcaacgggtttgggggagaaggatgcgaagccaccctgtgggatctgagacagactaggaacaggatttgtgagtacaaggggcactttcagacggtggcgagttgcgtgttccttccgagagcattggcactgatgccgctgatcgctacttcatctcatgactgtaaagttaagatatggaatcaggacacaggcgcatgcttattcactctgtctttagacggcagcggtcctctcacatccctggccgtcggagatgcaatctccctcctatgtgcaagttttaatcgtgggattcacttactgaggatggaccattcccaggggctcgagcttcaggaagtcgctgccttttag

SEQ ID NO: 61090 - DNA, 729 bp, Artificial Sequence
  Description of Artificial Sequence: Synthetic coding sequence
atggtcatgatgtgggatttgcacggcagcagccagcctcgacagcaactttgtggccacgcaatggtggtgacagggttggccgtcagtccggattcttctcaactgtgtaccggctcaagagataataccctcctcctttgggacgtcgtaacaggccagagtgtcgagcgcgcatctgtgtcacgaaacgtggtaacccacctgtgctgggttccacgggagccttacattcttcagacgtcggaggacaagacactaagactctgggattcccgagggcttcaggttgcacatatgttccccgcaaaacagcatatacagacctattgtgaagtgagtgtggacggtcacaagtgtatctcatgtagtaatggctttggcggagaaggatgtgaagccacactgtgggacctgaggcaaactcgcaacaggatctgcgagtataagggccatttccagactgtggcgtcatgcgtgttcctcccacgagctctagctctcatgccactgatcgctacatcttcccacgactgtaaggtcaagatctggaaccaggacaccggcgcatgtctctttactctgagtctggacggctccggccctctgacctcactcgccgtcggggatgctatctcactgctctgcgcctcttttaaccggggtatccatcttttaagaatggaccattctcagggcctagaattgcaggaggtggctgcgttttag

SEQ ID NO: 61091 - DNA, 4011 bp, Artificial Sequence
  Description of Artificial Sequence: Synthetic coding sequence
atggccactgaaatcgggtctccccctcggttcttccatatgccgcgattccagcatcaagcacctaggcagctgttttacaagaggcctgattttgctcaacagcaagcaatgcagcagctgacgttcgacgggaaacgcatgcgaaaagccgtcaatcggaaaactatagattacaatcctagtgtcatcaaatatctagaaaatcgcatttggcagagagatcaacgcgacatgagggccattcagccggatgcagggtattataatgatctcgtccctccaatcggaatgcttaataatcctatgaatgcagtcactaccaaattcgtacgtacctcaacaaacaaagtgaagtgccctgtgtttgtagtgcgatggacacccgagggccgacgtctcgtaactggtgcctcatccggagagtttacactctggaacggcctcaccttcaattttgagacaattcttcaggcccatgattcacctgtgagggccatgacttggtcacacaacgatatgtggatgctgacagcggaccacggcggttacgtaaaatattggcaatcgaacatgaacaatgtgaaaatgtttcaagcacacaaggaagcgatccgagaggcgagtttcagcccaactgataataaattcgccacctgcagcgatgacggcaccgtgaggatctgggacttcctgcgctgccatgaggagcggatcctccgcggtcacggggcagatgtgaaatgcgtcgattggcatcctactaagggcttagtcgtctccgggagtaaagatagtcagcagccaattaaattttgggaccccaagacaggacagtcgctggctacactgcacgcacataaaaacacggttatggaggtcaaactcaacctgaacggcaactggctccttaccgcgtcccgggaccatctgtgcaagctgttcgatattcgcaacctgaaggaagaattgcaggtgttcagagggcacaagaaagaggcaactgccgttgcttggcaccccgtccacgaaggcctctttgccagcgggggttctgacgggtctctcctgttttggcatgtgggcgtcgagaaggaagttggagggatggagatggcacacgagggcatgatctggtcactggcgtggcacccgctgggtcacatcctgtgcagcggcagtaacgatcacacctctaagttctggacaaggaacaggcccggagacaaaatgagagaccgttataatttgaatctactgccgggaatgagtgaagacggagtcgagtatgatgatctggagcccaattcactagctgtcatccctgggatgggaatcccagagcagctgaaattggcaatggaacaggaacagatgggaaaagacgaatccaacgagatcgaaatgactatccctggcctggactggggtatggaagaggtgatgcaaaaggaccagaagaaagtgccccagaagaaggtgccgtatgctaagcccatacccgcacagttccaacaggcctggatgcagaacaaggttcctattccagcaccaaatgaggtcctgaatgacagaaaagaagacatcaaactcgaggaaaaaaagaagacccaagctgaaatcgagcaagagatggccacactgcagtacaccaatccgcagcttctagagcaattgaagatcgagcgtttggcccagaaacaggttgaacagattcaaccacctccgtctagcgggaccccgttgctcgggccacagcccttcccaggccagggcccaatgagtcagataccacaaggatttcaacagccccatcccagtcagcagatgccgatgaatatggctcagatggggcctcctggtccacagggacagtttcggccaccgggaccccaagggcagatgggacctcagggccctccgctgcaccagggaggagggggtcctcaggggtttatgggtccgcaagggcctcaaggcccaccccagggattgccgaggccccaggacatgcacggtccacagggcatgcagcgccatcccggtccgcacgggcctttgggcccacagggcccacctggaccacagggctccagcgggcctcaaggccatatgggcccacagggcccacctggccctcagggacacatagggccacaaggcccacctggcccacaggggcacctgggacctcaagggcctccagggacacaggggatgcaggggccaccaggcccaaggggcatgcagggccctcctcacccacatggcatccaagggggtcccggatctcagggaatccagggcccagtatcccagggccctctaatggggctgaacccaagaggcatgcagggtcccccagggccacgcgaaaaccaggggcctgctcctcagggcatgatcatgggacatccaccccaggaaatgaggggaccacatccacctggcggactgttggggcatggccctcaggaaatgcggggacctcaggaaattcgcggaatgcagggccctcctccccagggctccatgttggggcctccccaggaactgagggggccaccaggctcacagagccagcagggaccgccacagggcagtcttggcccaccccctcagggcggtatgcagggacctccgggtccacagggccagcagaaccccgcacgaggccctcatccgtctcagggcccaatccctttccagcagcagaaaacccctctgctgggagacggtcccagagcaccatttaaccaagaggggcagagtaccggccctccacccctgataccaggtctgggacagcagggagctcagggccgaattcccccactgaatcccggacagggacccggaccaaataagggggactcccggggtcccccaaaccatcacatgggcccaatgtctgaacgacgccacgagcaaagcggaggcccagaacacggcccagagcggggtccatttcgcggtgggcaggattgtaggggccctcctgatagaaggggccctcatccagacttcccggacgatttttcccggccagatgattttcaccctgacaaacggttcggccaccgcctgagggagtttgaaggtcgagggggacctctccctcaggaggagaagtggaggagagggggtccaggccctcccttccccccagaccatcgggagttttctgagggtgatggtcggggagccgcacgaggacctcctggcgcttgggaaggtaggagaccaggtgacgaacggttccccagggatccagaggatcccagattccgcggacgcagggaggagtcattcaggcgtggagcacctcctcgccacgaaggcagggctccgccacgaggacgtgatggtttccctggaccagaagatttcggacccgaagaaaactttgatgctagtgaagaagctgcgagggggcgagacctccggggaagagggagggggactccacgcggaggaagaaaagggctgctgcccacaccagacgagttccctagatttgagggcggacgcaagccagacagttgggatggaaacagggagccgggacccggtcacgagcattttagggacacacctcgacctgaccaccccccacacgatggccattcaccagcttcccgagagcggtcctcctcccttcagggaatggatatggcctctctaccccctaggaagcggccttggcatgacgggccagggacctcagagcacagggaaatggaagctcccggagggccttccgaagacagaggtggcaaggggagaggtggacccggtccagcccagcgtgtgcccaagtccgggagaagtagctctctggacggggagcaccatgatggctaccacagagatgagccgtttggcggaccacctggctcagggactcctagtagagggggtaggtccggaagcaattggggcaggggcagcaacatgaactcaggcccacccagacgcggagcttctagagggggaggaagggggaggtag

SEQ ID NO: 61092 - DNA, 774 bp, Artificial Sequence
  Description of Artificial Sequence: Synthetic coding sequence
atggccactgaaatcgggagccccccacgcttctttcacatgcctcgtttccagcaccaagcccctaggcaactgttttacaagcgacctgactttgcgcagcaacaagccatgcagcaactgaccttcgacggaaagagaatgaggaaggctgtaaaccggaaaaccatcgattataatccttctgtcattaagtacttagagaatcggatctggcaacgcgatcaacgggatatgagggctattcagcctgacgctggctactacaacgaccttgtgccacctatcggcatgctgaataatcccatgaacgccgtgacaacgaagttcgtccggaccagcaccaacaaggttaagtgtcctgtgtttgtagtgcgctggacccccgagggacgccgactagttactggggcatccagcggagaattcacgttatggaacggcctcacctttaatttcgaaacaattctgcaggcacacgacagccctgtcagggccatgacttggtcccacaacgatatgtggatgctgacggccgaccacggcggatacgtgaaatactggcagtccaacatgaataacgtaaagatgttccaggctcacaaggaggccattagggaagcctccttctcaccaactgataataaattcgccacctgtagcgatgatgggacagtgagaatctgggatttcttgcgatgccacgaggagcgcattttgagagacacctgcttccaccactgccgctgttatttcctatcggtgaaacggtag

SEQ ID NO: 61093 - DNA, 357 bp, Artificial Sequence
  Description of Artificial Sequence: Synthetic coding sequence
atggctacagagatcggctcccctcctcgattttttcacatgcccagatttcagcaccaggccccacgacagctattctataagaggcccgacttcgcccagcagcaggccatgcagcaattaacctttgatggaaaacgcatgcgcaaggccgtcaatcggaagaccatcgattacaatccatctgtcatcaagtacctggaaaatagaatatggcaaagggatcaacgggatatgcgagccattcagccagacgccggttactataatgacctggtgccgcctatcggtatgttaaacaatccaatgaatgccgtaacgactaagttcgttcgtacatcaaccaataaagtctag

SEQ ID NO: 61094 - DNA, 981 bp, Artificial Sequence
  Description of Artificial Sequence: Synthetic coding sequence
atggccactgaaatcggctctccccctagattctttcacatgcctcggtttcaacatcaggcacccaggcagcttttctataagagaccagacttcgcccagcagcaggccatgcagcagctgacctttgatggcaagcgaatgcgcaaggccgtaaacagaaaaacaatagactacaatccatcagtgattaagtacttggagaacagaatatggcagagagaccagagggacatgcgggcaattcagcctgacgccggatattataatgacctggtgccccctattggtatgcttaacaaccccatgaacgccgtcactacaaaatttgtgcggactagcaccaacaaagtgaagtgcccggtcttcgttgtgaggtggacaccagaggggaggaggctagtaactggagcgtcttccggagagtttacgttgtggaacggcctaaccttcaactttgaaacaatactgcaggcccatgactcccctgttcgcgcaatgacatggtctcataatgacatgtggatgctgaccgcggaccatgggggttacgtgaaatactggcagagtaacatgaacaatgtaaaaatgtttcaggctcacaaggaagcgatcagggaagcaagattcatccacaatattccttttagcgttgtgcctatcgtgatggtgaaactcttttccaaatgtattctgggggcagagatgcatggcctgtgtcagttcctggggaactttctgcatcccattaacacgatctttttcttcgtcttcactcactctccgttctgctggcacctgtcagaggtggttctgtcacggtatcagcccctgcaatacgtgagggacgtcctgtctgcagcgttctgcaccggattcctgttctccttcatgatcaataacgtttatactctctttcttttcataatctattgcgttcggcaggaatatttcatccctaataaggaattctcgctttag

SEQ ID NO: 61095 - DNA, 1485 bp, Artificial Sequence
  Description of Artificial Sequence: Synthetic coding sequence
atgcccacagaaagtgcatcctgctccacagcgcgtcagacgaagcagaaacgaaaatctcactctttaagcatacgcaggaccaactccagtgaacaggagcgtaccggcctccctcgcgacatgctggaggggcaggatagcaaactacccagctcggtgcggtccacactgctcgaactgtttggccaaatcgagagggagtttgagaacctgtacattgaaaacctggagctgaggagagagatcgatactctgaatgaacgtctggcagcggaaggccaggccatagacggcgctgagctgtcaaagggacagctaaagacaaaggccagtcactcaactagccagttgtctcagaaactgaagacgacgtacaaagcatcaactagtaaaattgtgtcctcgttcaaaacaactacaagccgggctgcctgccagttggtgaaagagtacatcggtcatagggacggcatttgggacgtctccgtggccaaaacccagccagtagtcctaggaacggcaagcgcagatcacactgccctcctgtggtcaatagagactggaaagtgtctggttaaatatgccggacacgtcggaagcgtcaatagtatcaaatttcatccatctgaacagctggccctgacggcttctggtgaccagacagcccacatttggcgctatgctgtccagctgccgaccccccagcctgtcgccgatactagcatcagcggggaagacgaggtggagtgctctgacaaggatgagcctgatctagacggcgacgttagtagtgactgtcctacaatcagagtgcctctgacgtcgctgaagagccaccagggcgtggtgatcgcctctgactggctcgtgggtgggaaacaggcggtcaccgcctcgtgggatcgcactgcaaacctgtacgacgtggagacatcagagcttgtccactcactcacagggcacgatcaagaactgactcactgctgtacgcaccctacccagaggctggtcgtcaccagcagcagggatactacattcaggctttgggacttccgcgaccccagtatccacagcgtaaatgtgttccagggacacaccgatacagtgacttccgcggtttttacggtaggggacaatgtcgtgtcaggatctgacgacaggaccgtgaaggtgtgggatctgaagaatatgcgcagccccatcgccacgattcggacagatagcgctatcaaccgcatcaatgtctgtgtgggccagaagatcatagccctgccccatgacaaccggcaggtacggctgttcgatatgtcaggtgttcgactggccaggttgccccgaagctcgcgacaggggcaccggagaatggtgtgttgtagtgcgtggtctgaggatcaccccgtgtgcaatttatttacatgtggattcgataggcaggccatcgggtggaatattaacattcctgctctgcttcaggagaaatag

SEQ ID NO: 61096 - DNA, 1485 bp, Artificial Sequence
  Description of Artificial Sequence: Synthetic coding sequence
atgccaaccgaatccgcttcctgtagcacagctcggcagaccaagcagaagagaaagagccactccttgagcattaggagaacaaattccagtgaacaggaacggactggtctcccaagagatatgctcgaaggccaggatagcaaactgccctcttccgtgagatcaaccctgttggagttgtttgggcaaattgaacgggagtttgaaaacctgtatatagagaacctggagttgcgccgagagattgacactcttaatgagcgtctggccgctgaaggccaagctatcgacggtgctgagctgtcaaaagggcagctgaagacaaaagcatctcattccacctcacaattgtcacaaaagctgaagaccacctataaagctagtacttccaagattgttagctccttcaagaccacaacgtcacgggctgcttgccagctcgtgaaagaatacatcgggcatagggacggcatctgggatgtcagtgtcgccaagactcagcctgtggtgttagggacagcgtctgccgatcatacagcactgctctggtcaatcgaaactggaaaatgtttggtcaaatatgcgggtcatgtgggcagcgtgaattcaatcaaatttcatccttccgagcagctcgccctgaccgcttctggcgaccagacagctcacatttggcgctacgccgtacaactaccgacgccccagcccgttgccgacacttccatctctggagaagatgaggtggagtgctctgataaggacgaaccagatctggatggcgatgtgtcttctgactgccccactattagggtgcctttgacctctctaaagtcccatcaaggcgttgtgatcgcatctgactggctcgtgggcggaaagcaggccgttaccgcaagctgggacagaaccgctaacttatacgatgtcgagacctccgaacttgtacacagccttacaggccatgaccaagagctgacccactgctgcacacaccctacgcagcgcctggtcgtgacttcatcacgtgacaccacattcaggttgtgggatttccgggaccctagtatccactccgtgaacgttttccaggggcacaccgacaccgtgacgagcgctgttttcaccgtgggcgataacgtcgtgagcggcagtgatgatagaacagtgaaggtatgggatctgaagaatatgagatctccgatagccactatccggaccgacagcgcaatcaaccgtataaacgtttgtgttggccagaagattatcgcactgcctcatgacaaccggcaggtccgcctgttcgatatgtctggggtcagattggcacgacttcctagaagttccagacagggccataggcggatggtctgttgctcagcctggagtgaggatcacccagtgtgcaatttgtttacgtgtggcttcgatcggcaggctatcggttggaacatcaacattcctgcactcctgcaagagaaatag

SEQ ID NO: 61097 - DNA, 750 bp, Artificial Sequence
  Description of Artificial Sequence: Synthetic coding sequence
atgcctactgaaagcgcttcctgcagcacggcgaggcagactaagcagaagcgcaaatcacactcattgagcattaggaggaccaattcctccgaacaggagcgaaccggtctgcctcgagacatgctcgaggggcaagactccaagctaccttcttccgtgcgttcgactttattagagctgttcggacagatcgaacgcgagttcgagaacctttatatcgaaaacctcgaactccggagagaaatcgatacattgaacgagcgcctggctgctgaagggcaggcgattgacggggcagagctgtcaaagggtcagctaaaaaccaaagcctcacacagcacatcgcaactgagtcagaaactcaagactacatataaagcctccacctctaaaatcgtctcttcgttcaagaccaccacttcccgtgccgcttgccagcttgtgaaagaatatattggtcacagagacgggatttgggacgtgtccgtggccaagactcagcccgtggtgctcggcaccgccagcgctgaccacaccgcacttctctggagcatcgaaaccggcaagtgcctggtgaagtatgccggtcacgtaggcagtgttaactctataaagtttcacccgagtgagcagctggcgctgaccgctagcggcgaccagacagctcatatttggagatacgcggtgcaactgcccaccccacagccagtggctgacacaagcgtatcaacattcccctatttgtag

SEQ ID NO: 61098 - DNA, 630 bp, Artificial Sequence
  Description of Artificial Sequence: Synthetic coding sequence
atgtcgagtgacagcgagtgggacaggtcagcatgctccgacagtaaactcccttctagcgtgagatccacactgctggaactcttcggccagatagaaagagaattcgagaacttatacattgaaaatttagaactgcgtagagaaatcgacacactgaacgaaaggctggcagctgagggacaggccatcgatggggcagagctctctaagggtcaactaaagaccaaggccagccattctactagccagctgagtcagaaactgaagaccacttacaaggccagtacgagtaaaattgtgtccagctttaaaaccactacaagccgtgcagcttgtcagctagtcaaagaatatattggacatcgtgacggcatttgggatgtgtcagtggccaaaactcaacccgtagtgcttgggaccgctagtgcagatcataccgcccttctgtggtccattgagacggggaaatgcctcgtcaagtacgccggtcatgttggatctgttaatagtattaaattccatccctctgagcagttagccctgactgccagcggtgaccagacggcgcacatctggcgctatgccgtgcagcttccaactcctcagcccgtggccgatacctcctag

SEQ ID NO: 61099 - DNA, 945 bp, Artificial Sequence
  Description of Artificial Sequence: Synthetic coding sequence
atgaactctggtgtcccagccactttggctgtacgtcgtgtcaagttctttggacagcacgggggagaagttaattcatcggccttctcacctgatggtcagatgctgttgacgggctcagaagacggttgtgtatatggttgggagacaaggtcgggtcagctgctgtggcgcttgggaggccatactggccctgttaagttttgtcgattctcacctgacggccacctgttcgcctctgcctcctgcgactgtacggtgcgactgtgggacgtggctcgcgcaaaatgtctgcgagtgctgaagggccatcagcggagtgttgagaccgtaagtttttcacccgattctcggcagctggcaagcggtggctgggacaaacgcgtaatgttgtgggatgtgcaatcaggccagatgcttcggcttctggtggggcaccgtgactccatccagagcagcgacttctcccctaccgtaaactgcctggctaccggttcatgggattccaccgtgcacatctgggatctgagaatggtgactccagcagtgagccatcaagcactggaggggcactctgccaatatcagctgtttgtgctattccgcctccggactcctggccagtggaagttgggacaaaaccattcacatctggaaaccaacaacgtcttccctgttgatccaactcaagggccacgtgacttgggtgaagtctattgccttcagccccgatgaactgtggctggcttcggcgggatacagccgcatggtaaaagtgtgggactgtaacaccggaaagtgccttgaaacccttaagggagtactggacgttgcacatacatgcgcctttacacctgacgggaagatactggtgtccggtgcagccgaccagactcgtcgacaaatttcccggacatcaaagtcccctagagacccccaaacctag

SEQ ID NO: 61100 - DNA, 1380 bp, Artificial Sequence
  Description of Artificial Sequence: Synthetic coding sequence
atgctgaggtggctcatcggaggtggaagagaaccacaaggactggcagagaagagtcctctccagacaatcggcgaggaacagacacagaatccgtacaccgagctgctggtgctcaaggctcaccacgatattgtgagatttctggttcagctcgacgattacagatttgcatctgcaggggacgacggaatcgtggttgtgtggaatgcccagaccggagaaaagctcctcgagctgaatggtcacactcagaagatcactgcaatcatcactttcccatcactagaaagctgtgaggagaaaaatcaactgattctgacggccagcgcagatagaactgtgattgtctgggatggagacactacaaggcaagtccaaagaattagttgctttcagagcactgtaaagtgtttaaccgttctgcagcggctggatgtttggctgtctggtggcaatgatctatgcgtgtggaatcggaaactggatctcctgtgcaagactagtcatctgagcgataccgggatttctgcccttgtggaaatacccaagaattgtgtcgtggcggcagtcggaaaggagctgattatctttcgcctggtggcccctacagagggctctctcgaatgggatattttggaagtgaaaagactgctcgatcaccaagacaatattttatcactgataaatgttaacgaccttagcttcgtgactggatcgcatgtcggagaattaatcatttgggacgcgctggactggaccatgcaggcttatgagcgaaatttctgggatccctcaccacagctcgatacacagcaagagatcaaactgtgccagaaaagcaacgatatcagcattcatcactttacgtgcgatgaggaaaatgtgttcgccgctgtgggccgtggcctgtatgtgtacagtttgcagatgaagagagtgatagcttgccagaagacagcgcacgactccaatgtgctgcatgtggctagactgcctaaccgccaactaatctcttgcagcgaagatggcagcgtgaggatctgggagctacgggaaaaacagcaattggcagctgagcctgtccctacaggtttctttaacatgtggggctttggcagggtctcaaaacaggcctcccaacctgtgaagaagcaacaggagaatgccacatcctgctctcttgagttaataggcgacttgattgggcactcaagcagtgtagaaatgttcttgtactttgaggaccatgggctggtcacctgttctgccgatcatctcatcatcctgtggaagaacggagaaagagaatccggactgaggtcgcttaggctgtttcagaagctggaggagaacggtgatttgtatctggccgtctag

SEQ ID NO: 61101 - DNA, 618 bp, Artificial Sequence
  Description of Artificial Sequence: Synthetic coding sequence
atgcaagcctatgaacgaaacttctgggatccttccccacagttggatacccaacaggagatcaaactttgtcagaaaagtaacgacatctctattcatcactttacatgtgacgaagagaatgtgtttgccgctgtagggagggggctgtatgtgtatagcctgcaaatgaagcgcgtcatagcttgccagaaaaccgcccatgacagcaatgtcctgcacgtggccagattgcctaacagacaactgatctcttgctctgaggacgggagcgtgagaatctgggaactgcgcgaaaagcagcagctggccgctgagccagtgcccaccgggttctttaacatgtgggggtttggcagagtttcgaagcaagcaagccagcctgtgaaaaaacagcaggagaacgccaccagttgcagtctcgagctgattggcgacttaattggtcactctagctccgtggagatgttcctgtattttgaggatcacggactggtgacttgctctgccgatcacctcatcatcctttggaagaatggagaacgagaatcaggcctgaggtccttacggttgtttcagaagctggaggagaacggagatctttacctggcggtgtag

SEQ ID NO: 61102 - DNA, 1086 bp, Artificial Sequence
  Description of Artificial Sequence: Synthetic coding sequence
atgacccagcagcctctcaggggcgtaaccagcctgaggttcaaccaggatcaatcttgtttctgctgcgccatggagacgggcgtacgcatatacaatgtcgagcctctgatggagaaaggacaccttgaccatgaacaggtgggatctatgggcttggtggagatgctgcaccgtagtaaccttttggccttggttggtggcggatcgtctccaaagttctcggagatctcagccgtgctaatctgggacgacgcccgtgagggaaaggatagtaaggaaaagctggtactggagttcacttttaccaaacccgtattatccgtccgaatgcggcacgataagattgtgatagtgttgaagaatcgcatttacgtttacagttttcccgacaatccacgcaagctattcgagtttgacacacgcgataacccgaagggactgtgcgatctgtgcccatcattggagaaacagctgttggtgtttccgggtcacaaatgtggtagcctgcagttggtggatttagccagcacaaaaccgggtaccagtagcgccccattcaccataaatgctcaccagtctgatattgcctgtgtcagcctgaatcagccaggaaccgtagttgcctctgccagtcagaaaggcacactgattcgccttttcgacacacagagcaaagagaaactggtcgaattgcggagagggaccgaccctgccaccctttactgtataaacttttctcatgatagttcattcctgtgcgcatcttctgacaagggcaccgtacatattttcgccctcaaagacaccagactgaaccgaagatcagctctcgccagagtgggaaaagtggggcctatgataggtcagtacgtggattcgcaatggtcactggcgagcttcacagtccctgcagagtccgcctgcatatgtgcctttggcagaaacacctccaagaatgtaaacagcgtcatcgcaatctgcgtcgacggcaccttccataagtacgtgtttacacctgatggaaactgtaatagggaggccttcgatgtatatctcgatatctgcgatgatgatgacttttag

SEQ ID NO: 61103 - DNA, 1833 bp, Artificial Sequence
  Description of Artificial Sequence: Synthetic coding sequence
atggaaactgcccctaagcccggtaaagatgtcccaccgaagaaagataagctccagacaaaaaggaagaaaccaaggaggtactgggaggaggagactgtccctacaaccgccggagcatctcctggaccccctcgcaacaagaagaacagagaactccggccacaacgacctaaaaacgcgtacatcctgaagaaaagcaggatatccaagaagcctcaggtgcctaaaaagccaagagagtggaagaatccagagagccagcgcggtctttccggaacacaggatcccttccctggacctgcacccgtgcccgtcgaagtggtgcagaagttctgccgaatcgacaagtctagaaagctgcctcactcaaaggccaagacacggtcacgtctggaggtagccgaagccgaagaagaggaaaccagcatcaaagccgctcggtccgagctcttacttgccgaagaacctggcttcctggaaggagaggacggtgaagataccgccaagatctgtcaggccgacatcgtagaggcagtggatattgcctctgcagccaagcacttcgatctgaatctacgccagttcggcccttataggctcaactattctaggaccggaaggcatctagcattcggcggaaggcggggtcacgtggccgcactggactgggtgactaaaaagctgatgtgtgagatcaatgtcatggaagctgtgcgcgatattagatttctgcactcagaagcgctgctggctgtggctcaaaaccggtggctgcacatttacgacaaccagggtattgaattgcactgcattcgcaggtgcgacagggtgacaaggctcgagtttctgcccttccactttctgctggccaccgcatccgagacagggtttcttacctacctagacgtgtctgtaggcaagatagtggcagcactcaacgctagggcaggcaggctggatgtcatgtcacagaatccctacaacgctgtgattcacctcggccattccaacgggaccgtaagtctgtggtcccctgctatgaaagagcccctggccaagatcttatgtcaccgtggaggagtccgggcagttgccgtggactccacaggcacttatatggccacatcaggcttagatcaccagctgaaaattttcgacctacggggtacttaccagccactgagtacccggactctcccccatggagccggacatcttgccttctcccagcggggattgctggttgcaggaatgggcgacgtagttaacatctgggctggccaggggaaggcttcccctcctagcctcgagcagccctacctaacccacagactaagtgggccagtgcacggactgcagttttgtccgttcgaagatgtcttgggcgtcgggcacacagggggaatcacatctatgctggtacctggagccggagagcccaatttcgacggcctggaatccaatccatacagatctcggaagcaaaggcaggagtgggaggtcaaagcattacttgagaaagtgcccgctgagctgatttgtctggatcccagggccctcgctgaggttgacgtaattagtctggagcagggaaaaaaggagcagattgagcgactgggatatgatcctcaggctaaggcaccgtttcagcccaagcccaagcagaagggcaggtctagcacagcatccctggtgaagcgtaagcggaaggtgatggatgaggaacatcgcgataaggtgaggcagtctctgcagcagcagcatcacaaggaggccaaggctaaacctactggcgcacgcccttctgcactagatcggttcgtccgctag

SEQ ID NO: 61104 - DNA, 1833 bp, Artificial Sequence
  Description of Artificial Sequence: Synthetic coding sequence
atggagacagcaccaaagcccggaaaggacgtgcctcctaagaaggataaactgcaaaccaaacgtaaaaagcctcgaagatattgggaagaggaaacggttcccaccacagctggcgctagtcctggccctcctcggaacaagaagaaccgagaactgcgcccacaacgacctaagaatgcatacattctgaaaaaatccaggatctcaaaaaaaccccaggttccaaagaagccacgtgaatggaagaatcctgagagtcaacggggtttgtccggggctcaggatccatttccaggtccggcacccgtaccggtggaagtcgtccagaagttttgtcgcatcgacaaaagtcgcaaactgccacattccaaggcaaagacccggtccaggctggaggtggctgaagccgaagaggaggagacaagcattaaagcggcacgctcagaactgctgctagccgaggaacctggttttttggagggagaagacggcgaagacactgccaagatatgtcaagctgatatcgtggaggcagtagacattgcttccgccgcaaagcattttgacctgaacctgcggcaattcggaccttatagattgaactatagccgaaccggtcgccatctggcctttgggggacgcagaggtcacgtggctgcactggactgggtgactaagaaactgatgtgtgaaataaacgtcatggaggccgttcgagatatcagattcctgcactccgaggcactgctggctgtagcacagaacaggtggttacatatatacgacaatcaaggtatcgagctgcactgcatcaggaggtgcgatcgggtcacacgcttagagtttctgccttttcacttccttctggcaacagcctccgaaacagggttcctcacttatttggatgtgagcgtgggcaagattgtagctgctctcaacgctcgcgcaggtcgcctggatgtgatgtctcagaacccttacaacgccgtgatccatctgggccattccaatgggacagcttccctatggagtcccgctatgaaggagcctctggcgaagattctgtgtcacagaggaggggtgcgcgctgtagcagtggatagtaccggaacctacatggctacttcgggactagaccaccaacttaaaatcttcgatttaaggggcacgtaccagcctctgtcgacgaggacacttccgcatggggctggtcatctagctttttctcagcgaggattattagtcgccggaatgggcgacgtggtaaacatttgggccggacaagggaaggctagtcccccaagcctagagcagccttatttaacacataggctctctggccctgttcacggtctacagttctgtcctttcgaggatgtactaggggtgggacataccgggggtattacttccatgctggtgcctggtgccggagaacctaactttgacggactcgaaagcaacccctatcgctcacggaaacaaagacaggagtgggaggtcaaagcactgctggagaaggttcctgccgaattaatatgtcttgacccccgagctctcgcggaggttgacgtgatctccctcgagcagggtaagaaggaacaaattgagagacttggatatgacccacaggctaaagcaccatttcagccaaaacctaagcagaagggtcgtagttcaacagccagcctggtgaagcgtaagagaaaagtcatggatgaggaacacagagataaagtgagacagagcctgcagcagcaacaccacaaggaagcaaaggccaagcctacaggagctcgtccgtcagcccttgatcgctttgtccgttag

SEQ ID NO: 61105 - DNA, 969 bp, Artificial Sequence
  Description of Artificial Sequence: Synthetic coding sequence
aaatcacgaataagcaagaagccccaggtgccaaagaagcccagagagtggaagaaccccgagtctcaaaggggactttcaggagcccaagacccttttccgggtcccgctcccgttccggttgaggtagtgcaaaaattctgcaggattgacaagagccgcaagctcccgcacagcaaagctaagacacgctctcgcctggaagtggcagaggccgaggaagaagagacaagcatcaaggccgctagaagcgagctgctgttagccgaggagcctgggttccttgagggcgaggatggcgaagacactgcaaagatatgccaagcggacattgtggaagcagtggatatcgcatcagctgctaagttcggtccataccggcttaattacagtcggactggtagacatctggcgttcggcggtcgtcggggtcatgtggctgcgctcgattgggtcaccaaaaaactcatgtgtgagatcaacgtcatggaagctgttcgggatatacgcttcctccattctgaagctctattggctgtggcacagaatagatggctgcatatctatgacaaccaaggaatcgagcttcactgcatcaggagatgtgacagagttactcgtttggaattcctcccctttcacttcctgctggcaacagcgtccgaaaccggatttctcacttacttggacgtttccgtgggcaaaatcgtcgccgctctgaatgcaagagccggtagacttgacgtgatgtcccagaacccttacaacgccgtgatccatttgggtcattcaaatggtaccgcctctctgtggagtccggctatgaaagaaccacttgctaaaattctgtgccaccgcggtggggtgagggcagttgccgtggattcgactgggacctacatggccacgagcggcctggaccaccaacttaaaatctttgacctccgtggtacttatcagccactctag

SEQ ID NO: 61106 - DNA, 1833 bp, Artificial Sequence
  Description of Artificial Sequence: Synthetic coding sequence
atggagaccgcccctaagccaggaaaagacgtcccaccgaaaaaggacaaactacagacaaaaaggaagaagcctaggcggtactgggaggaggagaccgttcccacaaccgcaggagcctctccgggaccaccacgtaacaaaaaaaatagagaactacgaccccagagacctaagaacgcatatattctaaagaagtctaggattagtaaaaagccgcaggtccccaagaagccaagagagtggaaaaatccagagtcccagagggggctgtccggagcccaagacccatttcctgggccagcccctgttcccgtcgaggtcgtacagaagttttgtcgaatcgataaatccagaaaactaccacactccaaagccaagactaggtcaagacttgaagtcgcagaggcagaagaggaagagacctctattaaggccgcaagatccgaactacttctcgccgaggagcctggcttcctagaaggtgaggatggagaagatacagctaagatctgtcaggcagacatcgtggaggccgtggatatcgccagcgcggctaagcatttcgacctgaatctgcggcagttcggaccataccgattgaactactcacggactgggagacacctggcctttggaggacgcagggggcatgttgctgccctggattgggtgacaaaaaagctgatgtgtgagattaacgtaatggaggcggtgagggacatcagattcttacactctgaggccctactggccgtggcccagaaccggtggttacacatctacgacaatcaggggatcgaattacactgcatccgacggtgcgatcgcgtgacccgcctcgaatttctgcccttccatttcttgctggccactgcgtcggagacgggctttttaacctacctggatgtgtctgttggaaagatcgttgcagctctgaacgccagggccggacgtctcgacgtgatgtcgcagaacccttacaacgctgtgatccacctgggacattctaatggaacagtgtcattatggtccccagccatgaaagaaccccttgctaagatattgtgccaccgcggaggagttcgcgctgtcgcagtggactctacaggcacttatatggccacatcgggcctcgaccaccagctgaagatctttgatctcaggggtacctaccaacccctaagtactagaactctaccccatggggctgggcacctggcttttagccagcggggactgttggtggctggtatgggtgacgtcgtcaacatctgggctggacagggcaaggcctctccacccagcctcgaacagccatatctcacgcaccggctgtcaggccctgtgcacggcttacagttttgcccttttgaggatgttctgggagtgggacacaccgggggaatcacgtcaatgctggtgcccggtgccggagagcctaattttgacggcctagagtctaatccctaccgttcacgaaaacagcggcaggagtgggaggtgaaagctctacttgaaaaagtgccagcagaactgatttgcctggacccgagagctctggctgaagtcgatgtcatctccctcgaacaggggaaaaaggaacagattgagagattgggctacgaccctcaagcaaaagccccatttcagccaaaacccaagcagaaagggagatcctcgaccgcgtccctagttaagcgcaagagaaaggtgatggacgaggaacatcgcgacaaggtccgccagagccttcaacagcagcaccataaggaggctaaagccaaaccaacaggtgcacgcccttctgcactggacagatttgtcagatag

SEQ ID NO: 61107 - DNA, 1833 bp, Artificial Sequence
  Description of Artificial Sequence: Synthetic coding sequence
atggagacggcaccgaagcctggcaaagacgttcccccaaaaaaggataaactccagactaagcgtaaaaagccacgccgttactgggaagaggaaacagtgcccaccactgccggtgccagccctggcccaccccgaaataagaagaaccgtgagctaaggccccaaaggccaaagaacgcttatatcctcaaaaagtccaggattagtaaaaagccacaggtgcccaagaagcctagggagtggaaaaaccctgaatcgcagcgcggactgagcggagcccaggacccgttccccggaccggctccggtgcccgtggaggtcgtccagaagttctgtcggatagataagtctcgtaagctcccccatagcaaagctaaaacccgctcacggttagaggtagcagaagctgaggaggaggagaccagcatcaaagcagccaggtctgaactgctactggcggaggagccgggattccttgagggagaggatggcgaggacaccgcgaaaatttgccaggccgacattgtggaggcagtggatattgcttccgcagcaaaacactttgatttgaatctcagacaattcgggccataccggctgaactatagccgaaccggcagacatctcgcgttcggtgggcgacgcggtcatgtagctgcactggactgggttaccaaaaaattaatgtgtgagatcaatgtgatggaggccgtgagggatattcgcttccttcactctgaggcactcttggcagtggcccagaacaggtggctgcacatatatgataatcagggaatcgagctgcactgtatcaggaggtgcgaccgcgttactcgcctagagttcctgccgtttcactttcttctggcaaccgcttctgagacgggatttctgacatacctggatgtgtccgtagggaagatagtggctgcactcaatgccagagcgggaaggttagacgtaatgagtcagaatccttacaatgccgtcatccatctgggccattccaacggcacagtgagcttgtggagtcctgcgatgaaggagcctctggccaagattctatgccaccgcggtggggtgagagctgttgctgttgatagtactgggacttacatggctacctctggcctggatcatcagctgaaaatctttgatctcaggggaacatatcagccactttctacccgcactctgcctcacggtgcgggacacctcgcattcagccagcgaggcctcctggtagctggaatgggtgatgtagtgaatatttgggccggacaggggaaggcctcccctcccagcctcgagcagccgtacctgactcatcgcctgagcggacctgtgcatggcctacaattttgcccctttgaagacgtacttggtgtgggccataccggaggcatcacatcgatgcttgttcccggtgctggagagcctaactttgacggcttggaaagtaacccataccgtagtcgcaagcagcggcaagagtgggaggtgaaggcactactggagaaggtcccagccgagctgatctgccttgaccctcgggcattggccgaggtcgacgttataagtctcgaacagggcaagaaagagcagatcgaaagactgggatacgacccccaagctaaggcgccatttcaacccaaaccaaagcagaagggcagaagttccaccgccagtctggttaagcgcaagcgcaaggtgatggatgaggaacatcgggataaggtcagacagagcttacaacagcagcatcacaaagaggctaaagccaaacctaccggcgcaagacctagcgctttggaccgctttgtccggtag

SEQ ID NO: 61108 - DNA, 969 bp, Artificial Sequence
  Description of Artificial Sequence: Synthetic coding sequence
aagagcaggatcagcaaaaagccccaggtgcctaagaagccccgagagtggaaaaaccccgagtctcagcgtggactttcaggcgctcaggacccgtttcctggccctgcccctgtgccagtagaggtcgttcaaaaattttgtcgaatagataagagccgaaaattgccgcatagtaaagcaaaaacacgttcaagactggaggtcgccgaagccgaagaggaagaaacctctatcaaagccgctaggtccgagctcctgctcgccgaggagcccggattcttggaaggggaggacggggaggatacggctaaaatctgtcaggctgatatcgttgaggccgtggacatcgcatccgctgctaagttcggcccttatcggttaaattattcgcggaccgggaggcacctggcttttggagggcgacgtggccacgttgctgcccttgactgggtgaccaaaaaactgatgtgcgaaatcaatgtaatggaggctgttagagacataaggtttctgcattctgaggccctcttggccgttgcccagaaccggtggttacatatatacgataatcagggcatcgagttgcactgcatacgacgatgtgacagggtcacacggcttgagtttctgcctttccattttctcctggcaactgcttccgaaacaggctttttgacttatctggatgtttcagtcggcaaaattgtggctgcactgaacgctcgggcagggagactggacgtgatgtcccagaacccatacaatgccgtgattcaccttggccattccaacggcacggtgtccctatggagccccgctatgaaggaacctctggcgaaaattctgtgccatagaggcggagtgcgcgctgtcgcggtcgattctacaggcacctacatggctacaagtggccttgatcaccaacttaagatctttgatctaagggggacgtatcagcctctttag

SEQ ID NO: 61109 - DNA, 969 bp, Artificial Sequence
  Description of Artificial Sequence: Synthetic coding sequence
aagtcccgcatctctaaaaagccacaggttcctaaaaagccccgagagtggaagaatccagagtcacagcgcggactgtctggaacacaggatccatttcccggacccgcacctgtgcctgtggaggtcgtacagaaattttgtaggattgacaagtcaaggaaacttcctcatagcaaagctaagacaagaagccgcttggaggtggcagaggccgaagaggaagagacatctataaaagccgctagaagcgaactgctcctggccgaagaacctgggtttctagaaggggaagacggcgaggacactgcgaaaatttgccaggcggatattgtggaagccgtggacattgcctcagcagctaagtttgggccatatagattgaactactccaggaccggcaggcaccttgcgttcgggggtagacggggtcatgtcgccgctctggactgggtgaccaaaaagctgatgtgtgagatcaatgttatggaagccgtacgggacattagatttctgcacagcgaagcgctccttgccgtcgcccagaacagatggctccatatctatgacaaccagggcattgagctgcattgtatccggagatgtgaccgcgtgactcgactggaattcctgccgttccacttcttactggctacagctagcgagacgggcttcctgacgtatttggacgtgagtgtcggcaagatcgtggctgccttgaacgccagggcaggcagattagatgtgatgtcccagaatccctataacgccgtaatccatctgggccattccaacggtaccgtaagtctttggtctcccgcaatgaaagaaccgcttgccaaaatactatgtcatcgcggaggcgtcagggctgttgcagtagactccacgggcacttatatggccacctcaggcctggaccaccaactgaagatcttcgaccttagaggtacctatcagccgttgtag

SEQ ID NO: 61110 - DNA, 969 bp, Artificial Sequence
  Description of Artificial Sequence: Synthetic coding sequence
aagtcaagaatttctaaaaaaccccaggtgcctaagaagcctcgggagtggaagaatcctgagagccagagggggctctccggtgcgcaggatcccttcccaggaccagcccctgtgcccgtcgaggttgtacagaagttttgtcgaattgacaagtccagaaagctgccacatagcaaggccaagacccgcagccgcttagaagtggccgaagccgaggaagaagaaaccagcattaaagccgcaagatcggagctcctccttgcagaagaacctggattcctggagggtgaagacggagaagataccgcaaaaatatgccaggctgatatcgtggaagccgtggacatcgcctctgccgctaagtttggaccctacagactcaattactccagaaccggcagacatttagcatttggtggacgcaggggacacgtggctgcactagattgggttactaaaaaactaatgtgtgagatcaatgtgatggaggctgtgagagatatccggttcctgcactctgaggccctacttgccgttgcgcagaaccggtggctgcatatctatgacaaccaagggatcgagctacattgcattcgcaggtgcgaccgggtgactcgcctcgaatttctacctttccactttctgctcgcaaccgcctctgaaactggatttctcacgtatctggatgtctctgtggggaaaatcgtcgctgccctcaacgcacgggcaggcagactggatgtcatgagtcagaacccatacaacgcagtgattcatctgggtcactctaacggaacagtctctttatggtcacctgcaatgaaagagcctctggccaaaatcctttgtcatagaggaggagttagagcagtggctgttgactccacaggcacctatatggctacctccggcctggatcaccagctcaagatattcgacctgcgaggaacatatcagccactctag

SEQ ID NO: 61111 - DNA, 969 bp, Artificial Sequence
  Description of Artificial Sequence: Synthetic coding sequence
aagagtcgcatctctaaaaaaccccaggtgcccaagaaacctagagagtggaagaaccctgaatcccagagaggcctgtccggcgcacaggacccatttccaggaccggctccagtacctgtggaggttgttcagaagttctgccgaatcgataagagccgtaagctcccacacagtaaggctaagacccggtctcggttagaggttgcagaagctgaagaggaggaaacctctattaaggcagcgagatctgagctcctgctcgcagaagagcccggtttcctagagggagaggatggtgaggatactgcaaaaatatgccaagccgatattgtcgaagctgtagacatcgcgtccgctgctaagtttggtccataccgcctgaactattccagaacggggcgacacttagctttcgggggaaggcgtggccacgttgcagcgctcgactgggtcaccaaaaagctgatgtgtgagataaatgtgatggaggccgtgagagatatcaggtttctgcatagtgaagccttgctagccgtcgcccaaaatcggtggctgcacatctacgataaccagggcattgaattgcattgcattcgtcgttgtgatcgcgtgacgcgcctcgaatttttgccgttccacttcctgctggcaactgcttccgagactggatttctgacatatctggacgtgagcgtgggtaaaattgttgctgccctgaacgcgcgagcgggaaggctcgatgttatgtcccagaatccttacaatgctgttattcatcttgggcacagcaatggcaccgttagtctgtggtcaccagcaatgaaggagcctctggcaaagattctgtgtcaccgtgggggtgtgcgtgccgtggccgtcgattcaacaggaacatatatggcgactagcggtcttgatcaccagctgaagatatttgacctccgtgggacgtaccagccattgtag

SEQ ID NO: 61112 - DNA, 1833 bp, Artificial Sequence
  Description of Artificial Sequence: Synthetic coding sequence
atggagaccgctcctaagccaggcaaggacgtcccaccgaagaaagacaagctgcagaccaagaggaagaaacctcgcagatattgggaagaggagacggtcccaaccaccgccggagccagtcccggaccaccacggaacaagaagaatcgagagctcaggccacagagaccgaagaacgcgtacatcctaaaaaaatcccgtattagcaaaaagccgcaggtgccaaaaaagccaagggagtggaagaatccagaatcgcaaagaggcttgtccggggcacaggacccgttccctgggccagctcctgtgcccgtcgaagtagttcagaagttctgccggattgataaaagccggaagctgcctcatagtaaggcaaagacacgttccagattggaagttgccgaagccgaagaggaggaaactagcatcaaggcagccagatctgagctgctgttagccgaggaacccggattccttgagggcgaggacggagaagataccgccaaaatttgccaggcggatattgtagaagcagtcgatatcgcatctgctgctaaacactttgacctgaacctgcgtcagttcgggccatacagactcaactactctagaactgggcgtcatctggctttcggaggccgacgaggccatgttgcggctttggattgggtgactaaaaagttaatgtgcgagataaacgtcatggaggctgtgcgcgacattcggttcctgcacagcgaagcccttctggcagtggctcagaatagatggcttcatatatatgacaatcagggtatcgagctgcattgtatccgaagatgtgatcgcgtcacccgcctggagtttctaccattccactttcttctggcaactgcttctgaaactggctttctgacttatctcgacgtgtcagtcggtaaaatagtggcggctctcaatgcacgcgctgggagactcgacgtgatgtcacaaaatccttacaacgcagtgattcacctggggcactccaacggcacggtaagtctgtggtctcccgctatgaaggaacccttagcgaaaatcctttgtcatcggggaggtgtcagagcggtggcagtcgactctacaggcacctatatggccacctccggccttgatcatcaattaaagatatttgacctccgcggaacctaccagcccctgtccactcgaacattgccccacggggctggtcatctcgctttcagccagagaggcttgctggtggcgggaatgggcgatgttgtcaatatttgggccggacaggggaaggcttcaccaccgtcgctggagcagccctatctgacccaccggctgtccggccctgtccacggcctgcaattctgcccctttgaggatgtcctaggcgtaggccatacaggcggtatcacctccatgctcgttcccggagcgggtgagccaaatttcgatggtctagaatccaatccatacaggtcacgcaaacagcgccaggaatgggaggttaaggccctgttggagaaggtgcccgctgagctgatctgtctggaccccagggccctcgcagaagtggacgttattagcctggagcagggaaagaaggagcagatcgagcggcttggttatgaccctcaagcgaaagctccttttcaaccaaaaccgaagcagaagggtcgcagttccaccgcttccctagtgaagagaaagcgcaaagtgatggacgaggagcaccgtgacaaggtgcgccagtccctgcaacagcaacaccataaggaggctaaagccaaaccgaccggtgctaggcctagcgcccttgacagattcgtgagatag

SEQ ID NO: 61113 - DNA, 2676 bp, Artificial Sequence
  Description of Artificial Sequence: Synthetic coding sequence
atgacagcagaggagaccgtgaatgtgaaagaggtcgagatcatcaaactgattctcgattttctaaactcaaaaaaactccacatttcaatgttggctctggagaaagaaagcggggttatcaacggtctgttcagcgacgatatgttgtttcttaggtttaggtatattatcctgaagcagaaatttctcgaggccctttgcgtgaacaacgctatgtctgcagaagacgagccacaacacttggagtttaccatgcaagaagcggtccagtgtctgcatgctctggaagaatactgcccgagtaaggatgactattccaagttatgcttgctgctgaccttacccaggttgactaatcacgccgaatttaaggactggaacccttcgaccgctcgggtgcattgcttcgaagaggcatgtgtcatggttgccgagttcataccagccgaccgtaaactgtctgaagctggtttcaaagcctctaacaaccggctttttcagctggtcatgaaagggctcctgtatgaatgttgcgtcgaattctgtcagtccaaggctaccggggaggaaatcactgaatcagaagtcctgctgggcatcgatcttttgtgcgggaatggatgtgatgacctcgatctctccctcctaagttggctgcaaaatctgccatcaagcgttttctcctgtgcatttgagcaaaaaatgttaaatattcacgtcgataaactgttgaaacccacaaaggccgcttatgccgacttgctcactccactaatctcaaaactctcaccttacccatctagcccaatgagaaggccacaatccgccgacgcctatatgacgcgctctctgaatccagccttggacggccttacctgtggcctgacgagtcacgacaaaagaataagcgacctggggaacaaaacctccccaatgagtcacagctttgcaaactttcactacccgggagttcaaaatttatcccggtctcttatgttagagaatacggaatgccactcaatttacgaagagtcacccgagcgagacaccccggttgatgcccagcgccctatagggtccgagatcctgggacagtcttccgtgtccgaaaaagagcctgctaatggcgcacagaatccgggtcctgctaaacaggaaaaaaatgaactgcgggactccacagagcagttccaagagtactataggcagagactgagataccagcagcacctggaacaaaaggaacaacaaaggcagatttaccagcagatgctgttggagggcggagttaaccaggaagatggtcctgaccagcaacagaatctcacagaacagtttctgaaccgcagtatccagaaactgggtgagctgaacatcgggatggacggactgggaaatgaggtctccgctctgaatcaacagtgtaacggatctaaaggaaacggctcgaacggtagctctgtgacatccttcactaccccgcctcaggatagctcacaaagattgactcacgacgcttccaatattcacactagtactccccgtaacccaggatctacgaaccatatcccatttctggaagagagcccttgcggctcacagatctctagcgaacactccgtcataaagccacccctgggtgatagtccgggtagtctgagtagatctaagggtgaagaagatgacaaaagtaaaaaacagttcgtatgcattaatattttggaggacacacaggctgttagagcagtcgccttccaccctgcaggtgggctgtacgcggtgggcagtaacagcaagacgctgcgggtgtgtgcataccccgatgtgatagacccttcagctcacgagaccccgaaacagcctgtggtcaggttcaagcgaaataaacaccacaagggcagcatttactgtgtggcttggtccccttgtggccaactgctggcgaccggatccaacgataaatacgttaaggtgcttccctttaacgcagagacttgcaatgcaaccggccctgatctggagttttctatgcacgacggaacaataagagacctcgcattcatggaaggcccagagagtggcggtgctatcctgatcagtgccggtgcaggtgactgtaatatctatactactgactgccagcgtggacagggcctccacgccctcagcgggcataccgggcatattctggccctttatacgtggtctggatggatgattgcctcaggatcccaagataagaccgtgaggttttgggacttgcgcgttccctcatgtgtcagagtggtcggcaccacctttcatggcaccgggtctgcagtcgcgtctgtcgccgtcgacccatccggcaggctgctggcgaccggccaggaagatagttcctgtatgctatacgatatccggggaggtagaatggtgcagtcctaccaccctcacagctctgacgtgcgcagtgtgaggttctcccccggtgcacactatctccttaccggaagttatgatatgaaaatcaaggtaaccgacctgcagggcgacttgaccaaacaattacccatcatggtggtgggcgagcataaggataaagtgattcaatgtcgctggcacacgcaggatctgagctttctgtctagtagtgccgatcggactgtcaccttatggacatataatggatag

SEQ ID NO: 61114 - DNA, 2676 bp, Artificial Sequence
  Description of Artificial Sequence: Synthetic coding sequence
atgacggcagaggagacagtgaatgtgaaagaggtggagatcattaagctgattctggactttttgaattccaagaagctccatattagtatgctcgctctcgagaaagaatcaggcgtaatcaacggacttttctcagatgacatgctatttctgcgattccgttacatcattctgaagcagaaattccttgaggcgttgtgtgtgaacaacgcgatgtctgccgaggacgagccccagcatctggagttcacaatgcaagaggctgtgcagtgtctgcacgcactcgaggaatactgtcctagcaaggacgactattctaagctgtgtctgctgttaactctacccagactgactaatcacgcagaattcaaggactggaatccctcaactgctagagtgcactgcttcgaggaggcatgcgtcatggtcgctgagttcatcccagccgacaggaaactgtctgaggcagggtttaaggcttctaataatagactcttccagcttgtaatgaaaggccttttgtacgagtgttgcgttgagttttgtcagagtaaggcgaccggtgaggagatcacagagagcgaagttctcctggggattgatcttctgtgcggcaatggatgcgacgatctggatctcagtctcttgtcctggctccagaacttgccatcttcggtatttagctgtgctttcgagcagaagatgcttaacatccacgttgataagttacttaaaccgacaaaggctgcttatgccgacctgcttactccactgatcagcaaactctccccatatcccagttcccccatgagaaggccacagagcgctgacgcgtacatgactagaagcctaaaccctgctctggatggactgacctgcggcctgacgtcccatgacaagcgaattagtgacttgggaaataagacatcccccatgtcgcatagcttcgccaacttccattacccaggagtacagaatctcagccgaagcctcatgctggaaaatacagagtgtcactccatctatgaggagagccctgaaagagacacaccggttgatgcccagcggccaatcgggtcagaaatcctagggcagagctcagtcagcgaaaaggaaccagctaacggggctcagaatcccggtccggcaaagcaagaaaaaaacgagctgagggattcaaccgagcagttccaggaatattacagacagagactgcgctaccagcagcacctggagcagaaagagcagcagcgccagatttaccagcagatgctgttggaggggggagttaaccaggaagatggtcccgatcagcagcagaatctcacagagcagtttttgaacagaagcatacaaaagcttggtgagctcaacatcggcatggatgggcttgggaacgaagtgtccgcattaaaccagcaatgcaatgggtccaagggcaatggctccaatggcagcagtgtgaccagctttactactccccctcaggattcctctcagagattgacccacgatgcaagtaacattcacacctctacacccaggaacccagggagcacgaatcacattcccttcctggaggagagcccctgtggttcccaaatttctagtgaacactcagtgattaaaccacccctcggtgattcacctggtagcctcagcaggagcaagggggaggaagacgataaaagcaaaaagcaattcgtatgcatcaacattctggaggatacacaggccgttcgggcagttgccttccacccagctgggggactctacgcggtggggtctaactctaaaacactgcgcgtgtgcgcgtaccccgacgtgatcgacccctcagcccacgaaacaccgaagcagccagtggtgaggttcaagaggaataaacatcacaagggaagtatttattgcgtcgcatggagcccctgcggccagctgttggcaacgggctccaacgacaaatacgtgaaggttctgcccttcaatgccgagacatgcaacgctacagggcctgacctggagttcagcatgcacgatggtaccataagggatttagcattcatggaaggaccggagtctgggggagcgatcctgatctctgccggtgcaggtgactgcaacatatataccactgactgccagcggggacagggactacacgctctgagtggacacaccggtcacatactggccctatatacttggtcaggctggatgatagcatccggctcacaagacaagaccgtgagattctgggacctacgggtgccctcatgcgtgcgcgtggtcgggacaacctttcacggaactggctctgccgtagcatcagtggcggtcgacccaagcggcagactcctcgccactggacaggaggattcatcctgtatgctctacgatatccgcggtggccgtatggtgcagagttatcatcctcattcttccgatgtgaggagtgtacgtttctcccctggtgcacattatttgcttactggtagctatgacatgaaaatcaaagtaaccgatctgcagggagatctgacaaagcagttacctattatggttgtgggggagcacaaggataaagttattcagtgtagatggcacacacaggatttatccttccttagctcctccgcagatcggaccgtgaccttgtggacctataacggatag

SEQ ID NO: 61115 - DNA, 2760 bp, Artificial Sequence
  Description of Artificial Sequence: Synthetic coding sequence
atgacagctgaagaaacggtgaacgtgaaagaggtggagataataaaattgatactggatttcctgaatagcaagaagctccacatctccatgcttgctcttgaaaaagaatctggcgtcatcaatgggctgttctcagacgatatgctgttcctcaggcagttaatcctggacggccagtgggatgaggtcctgcaattcattcaaccgctggagtgcatggagaaattcgataaaaaaaggttccggtacattattttaaaacaaaaatttctggaggctctgtgtgtgaataatgcaatgtctgccgaagatgagccacagcatctggaattcaccatgcaggaggccgtgcagtgcctccacgctcttgaagaatactgtccttcaaaagacgactattctaagctctgtctcctgctaacattgcctcgcctaactaatcacgccgagttcaaagattggaacccaagtactgccagggtccattgctttgaagaagcatgcgtgatggtcgctgagtttatacccgctgacaggaaactgtcagaagctggctttaaagctagcaacaataggctctttcagctcgttatgaagggccttctttatgagtgttgtgtcgaattctgccaatccaaagccactggcgaggaaattacggaatccgaggtcctgctgggcattgacttgctgtgtggtaatgggtgtgacgatctcgatctgtccctcttgtcatggctgcagaacctgcctagctcagtcttttcctgtgcattcgaacaaaaaatgctaaatatccatgtggataagctcctgaagcccacgaaggccgcttatgcagacctccttacacccctgatatccaagctctccccctaccccagtagcccgatgagaagaccccaaagcgcagatgcctacatgactagatctctcaatccagctttggacggactgacatgcggtctgacttcacacgataaacggatcagcgatctcggaaacaagactagtccaatgtctcatagtttcgctaactttcactaccctggggttcagaatctgagtagatctctgatgctggagaacaccgaatgccactcgatttacgaggaaagtcctgagcgcgatacacccgtagacgcgcagcggcctatcgggagcgagatcctcgggcagtcaagcgtttccgagaaggaacctgccaatggggctcagaacccagggcctgccaagcaggagaagaatgagctgcgcgattccaccgagcagtttcaggaatactaccggcagcgcctgagataccagcagcatctggagcaaaaagagcaacaaagacagatctatcagcagatgttgcttgaaggcggagtgaatcaggaggatggcccagatcagcaacagaatttgactgagcaattcctgaatcgtagtatccagaaactgggtgagctgaacattggcatggacggcctggggaacgaggtttccgcacttaatcagcagtgcaacggctccaagggcaatgggagtaatggttcctcagtcaccagctttaccacgcctccccaggactcgagccagagactgacccatgatgcgtcaaacattcacaccagcacaccaaggaatcccggttcaactaatcacattccgtttctagaagagtccccatgcggctcgcaaatctcgtccgaacactctgttatcaaaccacctctaggcgacagccccggttccttatcccgatccaagggggaggaggatgataaatcaaagaaacaatttgtttgcataaacatactggaagatacccaggccgtgagagcagtggcctttcaccctgcagggggattgtacgccgtggggtcgaacagtaaaaccttgagggtgtgcgcatatcctgacgtgattgatccaagtgctcatgagacgcctaagcagcctgtggtgaggtttaagaggaacaaacaccacaaagggagcatatactgcgttgcctggagcccatgcggtcagcttctcgcaacaggcagcaacgacaaatacgttaaggtgctgccatttaacgccgaaacatgtaatgcaaccgggcctgacctcgagtttagtatgcatgatggtacaatacgggatctcgcctttatggagggtcccgagagcggtggagccatcctgatttccgctggagcaggtgactgtaatatatataccacagactgtcagcggggacaaggcctacacgctctgtccggccacaccggccatatcctcgcactttacacttggtcaggctggatgatcgcatcgggctcccaggacaagactgtcagattctgggatctcagagtccctagttgcgtgagggtggtgggtaccacattccacggaaccggctccgctgtcgcctcggtggctgtggaccccagtggccgactgctcgctacggggcaggaggacagtagctgtatgctgtatgatatcaggggcggaaggatggttcagagctaccacccccacagtagtgatgttcgatcagtgagatttagccccggtgcccactatctccttacaggcagttatgacatgaaaattaaggtgacagaccttcaaggagacctgacgaaacagttgcccattatggtggtcggggagcataaagataaggtcattcaatgcaggtggcatacacaggatcttagcttcttatcttcctccgctgataggacagttactctttggacctataatggctag

SEQ ID NO: 61116 - DNA, 2763 bp, Artificial Sequence
  Description of Artificial Sequence: Synthetic coding sequence
atgacagcagaagaaactgtgaatgtgaaggaggtggagattattaaactgatccttgattttctgaattccaagaaactgcatataagcatgttagccctggaaaaggagtccggggttataaacgggttattttccgacgacatgctctttctgcggcaactgatcttagacggccagtgggacgaagtgcttcagtttatccagcctcttgagtgcatggagaagtttgataagaaacggtttcggtatatcatactgaaacagaagttcctagaagcactctgtgtgaacaacgcgatgagtgccgaggatgagccccagcacttggagttcaccatgcaagaagctgtgcagtgcctccatgccctggaggagtattgtccatcaaaggatgactattccaagctctgccttcttttgaccctgccaagattaacaaaccacgccgaattcaaagattggaacccctccacagcgagggtccactgtttcgaggaagcatgtgtcatggtggcagaattcataccagcagataggaaactctccgaggcaggatttaaagcttcgaataatcggctgttccagctcgtcatgaagggcttactctacgagtgttgtgttgaattctgccagagtaaggcaactggtgaggagatcacggaatccgaggttctgttggggatcgatttgctctgtgggaacgggtgcgacgacctggatcttagtctgttatcatggctgcagaaccttccctcttcggtgttcagctgcgcatttgagcagaagatgctcaatatccacgttgataagctcctgaaaccaactaaggcagcttatgcagacctcctgacgcccctgattagcaagttgagcccttacccctcaagcccaatgcggaggccccagtcggctgatgcatacatgacgaggagcttaaaccctgcactcgatggacttacctgtggcctgacttcccacgataaacgaatctcagacttagggaataagacatcacccatgtcgcactccttcgcgaactttcactaccccggagtccagaacctgagccgatctctgatgcttgagaatactgagtgccactccatctacgaagaatctcctgaacggagcgatacccccgtggacgcccagcggcctattggatcagagatcctgggacaatccagcgtgtctgagaaggaaccagcaaatggagcacaaaacccaggaccagcaaaacaggaaaaaaacgagttaagagatagtacagaacaattccaagaatactaccgccagagacttaggtaccagcaacacctcgagcagaaggaacaacagcggcaaatataccagcagatgttgcttgagggcggtgttaaccaggaagacggtccagatcaacagcagaacctgacagagcaattcctcaatcggagtatacaaaaacttggggagctgaatataggcatggatggcttggggaatgaagtcagtgccctgaaccaacagtgtaacggctcgaaaggtaacggctccaatggttcaagcgtcaccagttttacaacgccacctcaagattcctctcagcgcctcacacatgatgcatctaatattcacacatcgactcccagaaaccctggttccaccaaccacatccctttccttgaggagtccccttgcggcagccagatttcatctgaacactctgtgatcaaacctcctctgggggattccccaggaagcctaagcaggtccaaaggggaggaagatgataaatcaaagaagcagttcgtatgcatcaacattttagaggatacacaggccgtgagggccgtggcctttcaccctgctggcggattatacgctgtgggatcaaactccaagaccctgagagtctgtgcttatcccgacgtgatcgacccatcagcacacgaaacaccaaaacagcctgtggtgcgtttcaagcggaacaagcatcacaagggctccatttactgtgtggcttggtctccatgcggccaattgttagcaacaggaagtaatgacaaatacgtcaaggttttacctttcaacgcagaaacatgtaatgcaacgggtcccgacctcgagttctcaatgcacgacgggactatcagagaccttgctttcatggaggggcctgaaagcggcggagccatccttatctctgctggcgcaggcgattgcaatatctacacgaccgattgtcagcgcggacaagggttgcatgcactgagcggtcacactggccacatcctagcactctatacatggtcaggatggatgatcgctagtgggagccaggataagactgtgaggttttgggacctgagagtgccatcttgcgttcgcgttgttggcactacgttccacggcacgggatctgccgttgctagtgtggctgtggacccatctggtagactcctggcaaccggccaagaagacagcagttgcatgctgtacgatatacggggaggccgtatggttcagtcctaccatcctcactcctcagacgtccgctcagtgcgattttcccctggggctcattacctgctgaccggatcctatgacatgaaaatcaaagtgacggatctacagggggacctcacgaaacaactcccaataatggtggttggagaacacaaagataaagtgatccagtgccggtggcatacccaggacctttcctttttatcatcttctgccgatcggactgttacgttatggacatacaatgggtag

SEQ ID NO: 61117 - DNA, 2784 bp, Artificial Sequence
  Description of Artificial Sequence: Synthetic coding sequence
atgaccgctgaagagaccgtgaacgtgaaagaggtcgagatcatcaagctgatcctcgacttcctcaattcgaagaaactccacatctctatgttggccctggagaaagaaagcggtgttatcaacggacttttctccgatgacatgctgttccttaggcagctgatcctggatggacagtgggacgaggttttgcaatttatccaacccttagagtgtatggaaaagttcgacaaaaagcggttcaggtatattattctcaagcagaagttcctcgaagctctgtgtgtcaataacgccatgtccgcagaggacgagcctcaacacgtccggttcctgtttctgaagttggagttcacaatgcaggaggcagtccaatgcctgcacgctctggaagaatattgtccctccaaggacgactactccaaactgtgcctcctgttgactctgccacgtctcaccaatcatgcggagttcaaagattggaaccccagtacagctcgggtgcactgttttgaagaagcctgtgtgatggtggccgaattcatcccagctgacaggaagctgtcagaggctggtttcaaagcaagtaataacagattgtttcaactagtcatgaaaggcctcttatacgagtgttgcgtcgaattctgtcagagtaaagcaacaggcgaggagatcaccgaaagtgaagttctgctgggaatcgatttgctctgcgggaacggatgcgatgatctggatttgtcattactgtcatggcttcagaacctgccttccagcgtgttcagctgtgcctttgagcagaaaatgcttaacatccacgtagataaactgcttaagccgacgaaggccgcatatgccgacctgttgactccactcatttctaagctttcaccttatccttctagccccatgagacgccctcagagcgctgatgcatacatgactcggtctctgaatccagctctcgatgggctgacctgtggcttgacctcacatgataagcggataagtgatctcggcaacaaaacctctcctatgtcacattcatttgcaaattttcactaccccggagtgcaaaatctatctcgctcactgatgctcgagaacactgagtgccactcaatatacgaggaatctcctgaacgctcggacacaccagtagatgcacagcggccaatcggaagcgagatcttggggcagtccagcgtttccgaaaaagaaccagcaaatggcgcacagaatccagggccagccaaacaagagaaaaacgaattgcgcgattcaactgagcagttccaggaatactaccgccagcggctgcggtatcaacagcatttggaacaaaaggaacaacagcgtcagatataccagcagatgctcttggaaggtggcgtgaaccaggaggacgggccagatcagcagcagaacttgaccgagcaatttctgaaccgcagtattcagaagctgggcgaactgaacattggcatggacggcctcggaaacgaggtctccgcattgaatcagcaatgcaatgggagcaaagggaatggctctaatggttcttccgtgacctcctttaccacaccaccccaagattcaagtcaaaggctgacacacgatgcgagtaatatccacacctccacgcccagaaacccagggtctaccaatcatataccatttctcgaagaaagtccgtgcggctctcagatcagttccgaacacagcgtgataaagcctcccctaggggactctcccggttctctctctcggtccaaaggtgaggaggacgataaatctaaaaaacagttcgtctgcatcaacatcttagaggatacacaggcagtgagggctgtagccttccaccctgcaggcggactctatgccgttggctccaatagcaaaacgctgagagtgtgcgcttatcccgatgtgatcgaccctagcgcccacgagacacctaagcagcccgtggtccgattcaagaggaacaaacatcacaagggctccatttactgcgtggcatggagcccatgtggccagctgctggcaaccggatccaatgataagtacgtgaaggtgctgccctttaatgctgaaacttgtaatgccaccgggccagacctcgaattttctatgcacgacgggaccattcgcgacctggcgttcatggaggggccagagtcaggaggagccatactcattagcgcaggagcaggagactgtaacatatacacaacagactgccagagaggtcaggggctgcatgcattgtcagggcatacagggcatattttagcattgtatacgtggtccggctggatgatcgcttccggttcacaagataagaccgtgcgcttttgggacctccgggtgcccagttgtgtacgagtcgtggggacaacttttcacggtactgggagtgccgtagcaagtgtagcagtggatcctagcggtaggctgttagccaccggtcaggaagattcctcgtgcatgttatacgatattcgaggcggtcgtatggtgcagtcctaccacccgcacagttccgatgtccgatcagtgaggttctcccctggcgcacattatctcttgacaggctcctacgacatgaagattaaggtcactgatctgcagggagacttaacaaagcagctgcctatcatggtcgtgggagaacataaagataaagtgattcagtgccgatggcacacacaagacctgtcctttctctctagttccgccgatagaaccgtcaccctgtggacatataatggatag

SEQ ID NO: 61118 - DNA, 321 bp, Artificial Sequence
  Description of Artificial Sequence: Synthetic coding sequence
atgaccgcagaggaaacggtgaacgtgaaggaagtggaaatcattaaattgatcctcgacttcctaaactctaaaaaactgcatataagtatgctcgctctggagaaggaatccggcgtgatcaatgggcttttttcagacgacatgctctttctgcgccagctaatcctcgacggccagtgggacgaggtactgcaatttatccaaccactggagtgcatggagaaattcgataagaagaggttcaggtacatcattctgaagcagaagtttctggaggcactatgtgttaacaatgctatgtccgcagaggatgaatag

SEQ ID NO: 61119 - DNA, 522 bp, Artificial Sequence
  Description of Artificial Sequence: Synthetic coding sequence
atgaccgctgaagagaccgtgaatgtcaaagaagtggagataattaagctgattctggacttcttaaatagtaagaaactgcacataagcatgctggccttggagaaagagtccggtgtaataaacgggctgtttagcgacgacatgctatttctccgccagctgattctggacgggcagtgggacgaggttctccagttcattcagcccctggagtgcatggaaaaatttgacaaaaaaaggttccggtacattatcctcaagcagaagttcctcgaggctctctgcgtgaacaacgccatgtcagccgaagacgagccacagcacctcgagttcacaatgcaggaggctgtgcagtgcttgcacgcacttgaggagtactgtccctctaaggacgactacagcaaattgtgtcttctgctgactctgccaaggctgaccaaccacgctgagttcaaagattggaacccctctaccgctcgagtccactgttttgaggaggcgtgcgtaatggtcgcctag

SEQ ID NO: 61120 - DNA, 2094 bp, Artificial Sequence
  Description of Artificial Sequence: Synthetic coding sequence
atggcctggcgggagaaaagcaagaaacgccttaacatgaccagttttaatattgcacagggaattcatgcctttgactaccactctcggctgaacttgatcgctaccgccggtatcaacaacaaggtgtgcctgtggaatccttatgtcgtgagtaaacctgtaggggtactttgggggcattccgcaagtgtgatagccgttcagttctttgtcgagcgtaagcagctattcagcttctccaaggacaaagttctgcgtttatgggatatccaacatcaactatccattcaaaggattgcttgttcttttccaaaatcacaagactttaggtgcctgttccacttcgacgaggctcatggccgactgtttatttctttcaacaatcagcttgccttactggcgatgaagagcgaggcttctaaaagagtgaagtcccacgagaaagccgttacttgtgtgctgtacaacagtattttaaagcaggtgatatcaagcgataccggctcaaccgtttcattttggatgattgacactggccaaaagatcaaacaatttacaggatgtcacggcaatgcagagatttcaaccatggctctggatgccaacgagacccgactgttgacaggctcgactgacggcaccgtgaaaatatgggacttcaatgggtactgtcatcacacactgaatgtgggccaggatggagctgtcgacatttcccagattttgattctaaaaaagaaaatcttggtcacgggctgggaacgggctataactgtgtttaggccccaaaactttaaccagttctttatccagccagaagagtggaagggcggaattcagcaccatgacgacatactgtgtgctgcctttctgccaccgcagacactcgttactggttcttacgacggggagattgttctgtggaataacagtaccgagaacgcccaccacgtgctgcaccccgactatcagaggctactaaaaagtaaacttgacaccaagccacaaaaacttttatctgcgggacgatcccagcccagccatccgatggccgaccactctaccacaggtgtaaggaactttgagattgatacagaagggaagaatgccgtgatgcggctgtgcttccttaaggccaggaagaataccgcagtcacaggtggagctaatttagtgagttgtggaggctccggttatgtgcggttctgggacatttacaaaaaacaactgctggccgaatttctcgcacactctggtgtaggcagcatcattatgtcaacagataaaatgaaccgctacttaaccactggagatcttgacggctggctgaagatctggaacatcgaggaatattgcctgaactcaagtaagaacaaaattacgaaggcacctactctcattagatccttccagcctcatgaagatagaatttcatcactggagatgtgtgagcctggtggacagctcctcatcatttcctcatctgccgactgcagtatctgtgtcaccggagtgtgcaacgccccagtgtggatatttgggcaggctaagcattggcacatagagaattgtttatttctgccaaaacgggatacgaatctggtggaatccgaaattcagaaagagatttctctgttttccaaagaggaatcctgcctcgacccgactgaacactccctgctgaataagaagaataaagacgacagcacgtacaacgtgcgtcctagcgaggacatcaacctggacataaaatacaaagaacggtctacttgcatgaaggaaacccagaaaccctattatggagaggtaattaaaaagagcttctccacttttcggtccctcaacattggcgctctcgaggagctgcctgaggtaaacaaacctgcgttcctgctggaccctgagaaatactttcgcaaggagcctgaggaggagagaccccaaatcttggaggccccttcactctttaagacactgaaggcagtgttcgatgagaagaatttattcccgaaggagattttgcaccacgaaagaaaggctaaacagttgtgtcaggagaagagctgtgaggtaaaaaaaaataagaagtag

SEQ ID NO: 61121 - DNA, 1989 bp, Artificial Sequence
  Description of Artificial Sequence: Synthetic coding sequence
atgacaatcaattgggcggaattactttccggttgccataagtgttgccatatcttggagcacaaactgcaccagggagactgggtgagacaggtgacatacaacgcgagcttagatgcgattattagctctaccacctctaacactaactcagtggtgatggcatggagggaaaaaagtaagaaaagactcaatatgacgtcttttaatattgcccagggcatccatgctttcgattatcactccagactcaaccttattgcgaccgcaggcatcaataataaggtctgtctttggaatccttacgtggtgagtaaacctgttggggttctgtgggggcactccgcttctgtgatcgcggtccagttttttgtcgaacgcaaacaactatttagcttcagtaaggacaaagttctgcggctgtgggatatccagcaccagttgtccattcagcggattgcatgctcatttcccaagtcacaggactttcgctgcctgtttcactttgatgaagcgcatgggaggcttttcatctcatttaataaccagctcgccttgttagccatgaaaagtgaggccagtaaaagggtgaagtcacacgaaaaagccgtgacatgtgtgttgtataacagcatcctcaagcaagtgatttcaagtgacactggaagcacagtcagtttctggatgattgacaccggccagaagatcaaacagttcaccggttgtcatggaaatgccgagattagtacgatggccctcgatgcaaatgaaactcggctcctcaccgggtcaacggatggcacagttaaaatatgggatttcaatggttattgtcatcacacacttaacgtgggccaggatggcgcagtggatatatcacagatactgattcttaagaaaaagatacttgtcaccggatgggaacgctacgattatgcctcttggaaaacaatcggtagagcaatcactgtttttcggccacagaatttcaaccagttcttcattcaacccgaggaatggaaaggcggtatccagcatcacgacgacattctttgtgctgcatttttgcctcctcaaaccctcgtcaccggctcttacgacggggaaatcgtcctctggaataacagcacagagaatgcacaccacgtgctgcatccagactaccagcggctcctgaaaagtaaactcgatactaagccacagaagctcttgagcgcgggtcgaagtcagccatcgcatcccatggctgatcattcaacgacaggggtgcggaattttgagattgacacagagggtaagaatgccgtgatgagactttgttttctaaaagctcggaaaaacaccgccgtgactggtggcgctaacctggtgtcatgtgggggaagtggatacgtgagattctgggacatttataaaaagcagctgctggcagagttcctggctcacagcggagtcgggtctatcattatgtcaacagacaaaatgaacaggtacctaaccactggcgatttggacggatggctgaaaatatggaatattgaggaagaaagctgcctggacccaaccgagcactcactgctgaacaagaagaacaaagacgactctacctacaacgtgaggccttctgaggatatcaatctggacatcaaatacaaggaaaggtcaacttgcatgaaggagacccagaaaccctactacggtgaagtgattaaaaagagcttttccactttccgcagcctaaatattggcgcactcgaggaactccctgaggttaacaagcctgcttttctccttgaccctgagaagtattttcgcaaggagcctgaggaagagagaccacaaatcctggaggccccatcattatttaagactctaaaggcagtcttcgacgaaaaaaacttgtttcctaaggagattttgcatcacgagagaaaggcaaagcaactctgccaggagaagagctgcgaggtaaagaagaacaagaaatag

SEQ ID NO: 61122 - DNA, 2949 bp, Artificial Sequence
  Description of Artificial Sequence: Synthetic coding sequence
atgaaggagcccgatgatcaggacacggatggagagaagtcagtgacaagtaagagcgatggcaagaaatccctcaggtcaagcaagtcagaatctcgttctccagtgcaggaggacaacactttcctggaggatgacaccgacgaaactttcacaaaaggggaaggctcatatttagaagaagactcggacgaggagcgcctagagggctccctttctagctttcagtacggcgatctgcagagcaccacagtgccccagcaaacacccgctcccgctgttgaggaagcagaagaggaagtcaagaaaaagattagcgaaagtttcttctatgattatatggaactggcctctatgcctttcgtgaccttagattctaacattcccctagatctgttgacactagtgcacagctttggttatgactgtaggaaaagggcgaatctacagctattggatgactccattgcgatttatatcgcagggaatcagttgattttccttaatctcaagactaaagaacaaatctacctccggagctcaagcggagagggcataggcgtcatcggcgtgcacccccacaagacatattttaccgtggccgaaaagggtagtttcccggacattattatttacgagtacccatcattacgcccatacagagtgctccgagacgggaccgagaaaggctacgcgtatgtggacttcaactattcaggcaacctcctggcaagcgtggggagcaatcctgactatacgcttaccatctggaactggaaggaggagcaacccatcttacgcacaaaagcatttagccaggaggtgttcaaggttacttttaatccagacaaagaggagcaactgaccacatctggatcaggtcatatcaaattctgggagatggcgttcacgtttacaggattgaaactccaagggagcctaggcaggttcgggaaaacaattaccactgatatagagggatatatggagctccccgacgggaaagtgctgtcagggtcagagtggggtaatatgctcttatgggaagggggtctcattaaagtggaactgtgtcgtgggacgagcaagtcctgccataacgggccaatcaatcaaattatgctgtatgaaggcgaggtaataacagttgggtccgacggttatgtgaggatctgggattttgagacgattgacacagctgacgtgattgatgaaacagggctgctggaaatcgagcctatcaatgagctccaagtagacaaaaacgtgaacctgttcagcatgattaagatgaatgagacgggcaacaacttctggttagcacaggacgctaacggtgccatttggaagttagatttgtccttctccaatatcactcaggaccccgaatgcttgttttctttccacagtggcgcaatcgaagcggtggccgtctccccccttacctatctcatggccacgacagcattagattgctccgtaagaatctacgatttcgcctccaagacacctctggcgcagatgaaatttaagcaagggggtacagcgctggtgtgggtgcccaggatggtgaattttacgggtgcacagatcatcgttggattcgaagatggggtggtgagaattttggaattatacgaccctaagggccttaccatcttcgctggtcgcaagaaaatactggatgcggacatccagcttaagcaagtgtttaaaccccacacagcttgcgtgacggctctcgcctacgagcgagacggagagatattagccaccgggtctaaggaccagacagtctttttctttgaggtggaaagagactacaagcctatcgggtacattaatacacctgggccagtatgtcaactgatgtggtcgcccatgtcacatcccgagtcaactctcttaatcatctgcgaaaatgggtacatattggaggctccacttcccacaattaagcaggaagaagacgaccacgacgtcgtgtcctatgagattaaagacatgtgcatcaaatgcttccacttttcatccgtgaaatccaagatcctgcggctaattgaaatcgagaagagagagcgccagcgagagctaaaagaaaaaattcgggaggagcgacgaaataaattggcagccgaaatgggggaagatggagagaaggaattccaggaagaggaagaagagaaagaggaagaggaagaggaagaagagccccttccagaaatcttcatcccatctactccttcccctatcctctgtggcttttacagcgaacccggtaagttttgggtgtctctgggcggatacgacagcggcttcctgtatcactgtgagtttcctccctgcgatgaatcgtcagattttaaggaacagaaggatgagcctattgacgttcgctatctggcagatacagaggacaacccaattcagaccatcacttttaatattaacaaggtgatgatgttttgcggtatgaagaatggggcaattagagtctacgtactgaaccagaatgaccccagccttacttccctcgtggattactggcactttaatatgcatgataataactatggatgtatcaaatcgatcgccaactcatttgatgatcgttttcttgtaacagctggcgctgacggcaatatcttcgtgttcaacattttttcagagtttatgctccgcaaagacatgaaggccaaagtgccttccccacgcttcggcatcgagacagagcccatcccggaggatattgaggatcccaaagcttattcaattgagaacgccaggcggaaaagggagcacgataagttgatgaaggaagttggagaaattaaggcacgtaagagggaacagattaaggcgctgagaagtgagttttgcaacctcctggaaatgaacgagaaactccccaagcatatgcagttcaagcggactgtgtcactgatctag

SEQ ID NO: 61123 - DNA, 1206 bp, Artificial Sequence
  Description of Artificial Sequence: Synthetic coding sequence
atgaaactttcagatcttcatcacgtcactctctttcaggaaatccttctcttgaagaacttcgaaaagcaggagaatatcctccaggagcgggtgaattccctggacaaggaggaacagtatatgcagtggaaaatcaacgaaacgctcaaagagatggaagagaaaaagaacgagatcactaagctgcaagagcaggagaaggcactctatgctggattccaggctgcgatcggcgagaataacaaatttgctaatttcctcatgaaagtgctcaagaagaaaatcaagcgggtgaagaagaaagaggttgaaggagacgccgacgaagacgaagaatcagaggaatcttccgaggaagagtcttcattggagagcgacgaagacgagagcgagtccgaggacgaggtgttcgatgattcgatttgccctaccaactgtgatgtggccttgttcgagttagctctgcatcttagggagaagcggctcgacatcgaagaggctctggtggaggagaagaagatcgtggacaaccttaagaaggagtacgatacccttagcaagaaggtgaagatcgtcgcaacgaacctgaacgctgcagaagaagctctggaggcctaccagcgcgagaaacagcagcgcctgaatgagctcttagtggtgatacctttgaagcttcatcagattgagtatgtggtatttggtgagattccctccgaccttagcggcactcttgttttctctaaccatgcactacggaggctgcaagagagaatccatgagctgcaggaggagaactccaaacagcagaagcttaataaggagtggagggaaaggaggaagcaactcatcagagaaaaaagagagatgacaaagacaatccataagatggaggagacagtaagacaactgatgatttctaagtttggtagagttgtgaacctggaggccctccagaccctatcagttaacactacactcgaagaacttaaaatacggaaattgcgtaaagaactggccaacgccaaggagatgaaaatgtgggaggagaaaatcgcccagatgagatgggagttaatgatgaagaccaaggagcacactcgcaagctgtaccagatgaatgacttatgcatagaaaaaaagaagctagacagcagactcaataccctgcaaaatcagcagaaccctggtaacgggctgtcctag

SEQ ID NO: 61124 - DNA, 5564 bp, Artificial Sequence
  Description of Artificial Sequence: Synthetic coding sequence
atgaaagagcctgatgaccaggatacagatggcgagaaaagcgtgacttctaaaagcgacgggaagaaaagtctcagaagcagtaaatccgagtcccggtccccagtccaagaagacaacacctttttagaggacgacaccgacgaaacttttactaaaggggaaggctcatatctggaggaggattccgacgaggagcgactcgaggggtccctatcaagcttccaatatggcgacctgcaatccactacagtgccacagcaaacccctgcaccagcggttgaggaggctgaagaagaggtcaagaagaagatcagtgaatccttcttttatgactacatggaactggcatctatgccatttgtgaccctggattcaaatatcccactggatctcttgacactagtgcattccttcggttatgattgtcgcaagcgcgcaaacctgcaactcttggatgattctattgccatctacatcgctggcaaccagctcatttttctgaatcttaaaacaaaagaacagatctatctgcgtagctcttctggcgagggtattggcgtcataggcgtgcatcctcataaaacgtattttaccgtagctgaaaagggatccttccctgatattatcatttacgagtaccctagtctccggccatatcgggtgttgagagatgggaccgaaaagggatatgcctacgtcgattttaactattcaggtaaccttctggcatccgtaggctccaatccggattatacactcacgatctggaactggaaggaggaacagcccatactccgtactaaagctttcagccaagaggttttcaaagtgacctttaacccagataaagaagaacaactgacaacgtctggatcagggcacattaaattttgggaaatggcatttacctttactggtttgaaactgcagggctcgctcggacgattcggcaagaccattaccactgacatcgagggatacatggagctccctgatggcaaggtgttgagtggttccgagtggggaaacatgttgctctgggagggaggcctcattaaggttgagctttgcagaggtacatcaaagtcttgtcacaacggcccaatcaaccagataatgctctacgagggggaggtcattactgtcggctcagacgggtatgtgcggatttgggacttcgaaaccattgatactgcagacgttatcgacgagactggccttcttgaaatcgagcccataaatgagcttcaggtcgataaaaacgtgaaccttttttcaatgataaagatgaacgagacgggcaacaacttctggctggctcaagacgccaatggcgctatctggaagctcgacttaagtttctctaacatcacacaggatcccgagtgtcttttctcctttcactccggggcaattgaggcagttgctgtatcacctctgacatatctcatggccacaaccgctcttgattgttcagtccgtatttacgattttgcctcaaaaactcctctcgcacagatgaaattcaagcagggtggaacagcactcgtttgggtgcctagaatggtgaacttcacaggcgcacaaattatcgttggcttcgaagatggggtcgtcaggatcctggagctgtacgatccaaaaggactaaccatctttgcagggcgaaagaaaatcctggacgccgacatccaattgaagcaggtgttcaagcctcacaccgcctgcgtgactgccctggcatatgaacgagatggcgaaatcctggcaacgggaagcaaggaccagaccgtcttcttctttgaggtggagcgagactacaaacctattggatatatcaacacgcccggaccagtttgccaactcatgtggagtccaatgagccaccctgaatcgactctcctcataatttgtgaaaatggctacatactggaggcccctttgcccactattaaacaggaggaggatgatcatgacgtggtgagctacgagataaaagatatgtgcatcaaatgtttccatttcagttctgtcaaatccaagatactcagacttatagaaattgaaaagcgggaacgccagcgggagttgaaagagaaaatccgtgaggagcggcgaaacaagctggccgctgagatgggcgaagatggagagaaagaattccaagaggaggaagaggagaaggaggaggaggaagaggaagaggaacctctgccagagatctttatcccatctaccccctctccaatactctgtgggttttatagtgagccaggcaagttctgggtgtctctggggggttatgatagtgggtttctctatcattgtgagttccctccatgcgacgaatctagcgactttaaagaacagaaagacgaacccattgacgtgaggtatctcgccgatacggaagataatcccatccaaaccatcaccttcaatatcaacaaggttatgatgttctgcggcatgaaaaatggagccatccgagtctacgtcttgaatcagaacgacccatcattaacgtctctggtggattactggcacttcaatatgcacgacaataactacgggtgcattaagagtatagctaatagtttcgatgaccggttccttgtgacggccggtgcggacggaaatatctttgtcttcaatatctttagcgagttcatgctgcgcaaggacatgaaagcgaaggtcccaagccctagattcgggattgaaactgagcctatacctgaggatattgaggaccccaaggcttatagcatcgagaacgcgagacgtaagagagaacacgacaaactgatgaaggaagtcggggagatcaaagccagaaaacgtgaacagataaaagctttaagatcagaattttgtaatctgctagagatgaacgagaagcttccaaagcacatgcagtttaagcgcaccgattttgatgtggattctcagataagggctgaaatgcacagaaagactgcgttcaaaattcagcaggtggagaaagagctcgcatgggagaaagagaaacatgaactgggcctgatgaagctgaaaaaccgctttcgggatcctctcgagagtgacaccattgtggtacacgctatcttatctgatcataaaatatccagctaccgactggtacaaccatctaagtacagtaagtttaagcgagcctcacagtctgagcggaaacctagtaagctggaccgcttcgaaaaggaaggacctggcagaaaagattctcaacgggacgccggaggatctgtgacaattcaggaggagtccattatcgaaaaggggaaaaagtttcggcctaagacgctgtctgagatcatcgtggaaaatcagatcgagaaaactcggaaactgatactcaaggcggagagagctcaactgaagatccaacaacggaagaaggaatgggaagaactctataagagtaagcctggggatgactacgaggaccccaaggacctgcaagccatcaaggaggcccaggtttatatgggagatttcaacctaaagaccgcacccgactataagataccagaacatatgcgaattaatgccgctaagaaggaggaagagctgggacacctggattcattagtccacggaaacaagcgtcacatgaacaaatgcatcctatctcttcgcgatctgaaagtggctgtggtggaagagatccagtgcctggtccaggaactgaaaaatattcaatcaacactgcacatctccaaacatatccccataccaaagattcctcagatccacccagaggaggtgcccgagaaaagatttcaatatgacgaagaaaccctgctgaacttcaagcaacagcaaatgaaatcaaaagacgagaaaagccccggagtcgaacagactggctctggcggacccgttggcggatttttgaagctatcgtcccggaaagacggggatttgactacccgagactctatttcgaggtcatccaaagccagcacattcagcttggacatcccaaagtgcctggagtttgaaaaggccgagcctacagacgtggaactggaaattatgaagcgtgatgagatcaagcacgtgtacatgcaacagtacttggtgaacagaattaaggagttggtcgtcactttcgacgcagagctgcgactcctccgccatcagaagctgaaactcgacacacagatgaaattgtcagatctccatcacgtgaccctgtttcaagaaatcttacttctcaagaattttgaaaaacaagagaatattctgcaggaacgggttaactcactggacaaggaagagcagtatatgcagtggaagattaacgagacattgaaggaaatggaggaaaagaaaaacgagattactaagctccaagagcaagagaaggctctgtacgcaggatttcaggcggctataggagaaaataacaaattcgccaacttcctgatgaaggtgctcaaaaaaaagataaagcgtgtgaagaaaaaagaggtagagggagacgccgacgaggacgaggaatcggaggagtcaagcgaggaggagtcatctttagaatccgatgaggacgagtccgaatcggaggatgaggtgtttgacgacagcatctgtccaacaaattgcgacgtcgctctgtttgaactcgcactacacctacgagaaaaacggctggacatcgaagaggccctggtggaggaaaaaaagatcgttgataacctgaagaaggagtacgatacattgtccaaaaaggtgaagattgtggctacaaatctcaatgcagcagaggaagccctggaggcctaccagcgtgaaaagcagcagcgcctgaacgagctcctcgtcgtaattcctctgaagttgcatcagatagagtatgtagtgtttggggagatcccttccgacctgagcgggaccctggtgttctcaaaccacgcattaaggcgactacaggagcgcattcacgaattgcaggaggagaattcaaagcaacagaagttgaacaaggagtggagggagaggcgtaagcaactcatacgggaaaagcgtgaaatgacaaaaacaatccataaaatggaagagacggttcggcaactcatgatcagtaagttcgggcgtgtggtcaatctggaagcgctccaaacactgagcgtgaacacgaccctcgaggagctgaagattcgcaaacttcgaaaggagctggccaatgctaaggagatgaagatgtgggaggagaagatcgctcagatgaggtgggagctgatgatgaagacaaaagagcatacccggaagctctatcagatgaatgacctctgtatcgaaaagaagaagctcgattctcggctgaatacacttcagaatcagcaggggaatgccttccaggggcctcgcgaagccgatgtggttgctcgggaagaagtgacagagctgatacagctccaagcagagaggatatcggccttgaaagaagagatcgccctgttgcgcagaaaggggtccctgatattgcctccgattcagtcaccccgtgagaaggaaatacagccagcagaccttta

SEQ ID NO: 61125 - DNA, 255 bp, Artificial Sequence
  Description of Artificial Sequence: Synthetic coding sequence
atgaaggagcccgacgaccaggacacagatggagagaaaagcgtgacgtcaaaaagcgacggcaaaaagtccctaaggagtagcaaatcagaatcccgaagtcccgttcaggaggataacaccttcctcgaagatgatactgatgaaactttcaccaagggggagggctcttatctggaggaagactcggacgaagagcgcctggagggctctctgtctagctttcagtacggagatctgcagagtactacatag

SEQ ID NO: 61126 - DNA, 1077 bp, Artificial Sequence
  Description of Artificial Sequence: Synthetic coding sequence
atggccgtaaagtggaccggtggccactcctctcctgtgctgtgcctgaacgctagtaaggagggtctgcttgcctcaggtgcagagggcggagatctaacagcctggggcgaggatggaacccccctcgggcatacaagattccagggagccgacgacgtgactagcgtcctgttttccccttcttgtcctaccaagttatacgcttcacacggagagacaatttcagtgctggacgtcagatcactgaaggattccctcgaccacttccacgtgaatgaggaggaaataaactgtctctccctaaaccagaccgaaaacttgctcgctagcgctgacgatagcggagccattaagatcctagatctcgaaaacaaaaaggttatccggagcctgaagagacactcaaacatctgttccagcgtcgcctttaggccccagcgcccacagtcactagtttcctgcggtctagatatgcaggtgatgctctggtcactgcagaaggccagacctctgtggatcacaaatctgcaggaggacgagaccgaagagatggagggaccccaatcccctgggcagcttctcaatccagcactggctcatagcatatcagtggcttcttgcggaaatattttttcctgtggcgctgaggacggtaaggtgcgcatattcagggtcatgggcgtgaagtgtgagcaggagctgggatttaaggggcatacatcaggcgtgtcacaggtctgctttctgcccgagagctatctgctgttgactggcggaaacgatggcaagatcacactgtgggacgccaattccgaggtggaaaagaaacaaaagagcccaaccaagagaacacacaggaagaagcctaagcgcggaacatgtacaaaacagggtggcaatacaaacgcctctgtaaccgatgaggaggagcatgggaatatcctgcctaaacttaatatagagcatggggagaaggtcaactggttgctcggcaccaagattaagggacaccagaacattctcgttgcggatcagacttcctgcatctcagtatacccccttaatgaattttag

SEQ ID NO: 61127 - DNA, 465 bp, Artificial Sequence
  Description of Artificial Sequence: Synthetic coding sequence
atggctgttaagtggacagggggacacagcagtcccgttctatgtttgaatgcttccaaggagggcctgctggcctctggggcagagggtggggatctaaccgcatggggagaggacggtacccctctgggtcacacgcgattccagggcgcagatgacgtaacgagtgttttgttttcaccatcctgcccaaccaagctgtacgcttctcacggagagactatctcggttctagacgttcggtccctgaaggatagcttggatcactttcacgttaacgaagaggagatcaactgcttaagtctcaatcagaccgaaaacctgcttgcgtcagccgacgactcaggtgccatcaaaatccttgaccttgagaataagaaagttattcgaagcctcaagaggcattcaaatatttgctctagcgttgccttcagaccgcaaagacctcagagcctggtcagctag

SEQ ID NO: 61128 - DNA, 483 bp, Artificial Sequence
  Description of Artificial Sequence: Synthetic coding sequence
atggctgtgaagtggacgggtggacattcaagtcctgtgctttgtctaaatgccagcaaggaagggctccttgcatcaggcgctgaggggggagatttgactgcctggggcgaggacgggacaccactcgggcacacaaggttccaaggagcagatgatgtgacaagtgtgctattttcgccctcctgccctacgaagctttatgcgagtcacggggagactatcagtgtgttggatgttaggagtctcaaggactctcttgaccatttccatgtgaatgaagaagagattaactgcctgtcactgaaccagacagagaatctcctcgcgagcgcggatgactcaggagccattaagatactggatctggagaataaaaaggtgatccgaagtctaaaaaggcacagtaacatatgcagcagtgtggcgttcagaccccagagaccgcagtctctcgtgtcttgcggactcgatatgcaatag

SEQ ID NO: 61129 - DNA, 1005 bp, Artificial Sequence
  Description of Artificial Sequence: Synthetic coding sequence
atgttccgctgggagaggagcatcccgctccgaggttccgcagcagccctatgcaataacctcagcgtgctgcagctgccagccaggaaccttacctatttcggcgtcgtgcacggaccttccgcccagttgctgagcgctgcaccagaaggggtgccactggctcagcgacagctccacgcaaaagagggggctggagtttctcctccgctgattacacaagttcactggtgcgtactcccgttcagggtgttactcgtgttaacatcccacagagggatacagatgtacgagtccaacggctatacaatggtgtattggcacgcccttgattctggtgatgcttcccccgttcaggccgtgtttgccagaggaatagcagcaagcggccactttatctgtgttggcacctggtccggccgagtccttgtgttcgacatcccggctaaggggccaaatattgtcctcagcgaggaattggctgggcatcaaatgcccattacagatatcgcaaccgagccagcccaagggcaggactgcgtggcagacatggtaaccgctgatgacagtggactcctgtgtgtttggagaagtggaccagagttcaccctgctgacccggataccaggattcggggtgccgtgtccttcagtgcaactctggcaggggattattgctgccggatatggaaatgggcaggttcacctctacgaggcaacaacgggaaacctgcatgtgcagatcaacgcccatgcgcgtgctatatgcgctctggatctggcttcagaagtgggcaaactgctctccgccggagaagatacgttcgttcatatttggaagctgtctagaaatccagaaagcggttacatcgaagtggagcactgccacggcgagtgcgtagcagatacacaattatgcggagctagattttgcgattcatctggcaacagtttcgctgtgactggttatgacctggctgagatccgacggttcagtagcgtgtag

SEQ ID NO: 61130 - DNA, 2925 bp, Artificial Sequence
  Description of Artificial Sequence: Synthetic coding sequence
atggccgctagatggtcttccgagaatgttgtagtcgaattccgcgactcccaggccacggccatgagtgtcgactgcctgggtcagcacgcagtgctgagtggacggcgatttctgtacattgtaaatctagatgccccatttgaaggtcatcgaaaaattagcagacagagcaagtgggatatcggagctgtccaatggaatccacacgactccttcgcgcattactttgccgctagtagtaatcagcgggtcgatttgtacaaatggaaagatgggtccggtgaggtaggaaccacacttcagggccacacaagggtcattagtgacttggattgggcagtgtttgagcccgatcttcttgtcacatcaagtgtcgatacatatatatacatttgggatattaaggacacgagaaaacctaccgtcgccctcagcgccgtcgccggtgccagccaggttaaatggaataagaaaaatgccaattgcctagctactagccatgacggggatgttcgcatttgggacaagcggaagccttcaactgccgtggagtacctggccgctcacctctctaagatacacggattggactggcatcctgattcagaacatatactggccacttctagccaggacaactctgtcaagttctgggactacagacagcctcggaagtatttgaacatccttccttgccaggtacctgtctggaaggctcgctatacgcctttctcaaacggcctggtgacagttatggtcccacagttgcgtagagaaaattcgctgcttctatggaacgtgttcgatctgaacacccctgtacacacatttgtcggtcacgatgacgtcgtcttagagtttcagtggcgcaaacagaaggaggggagtaaggattaccaacttgtgacatggagcagggatcagacactgcggatgtggagggttgattcgcaaatgcagaggctttgcgccaatgatattcttgacggagttgatgagttcatcgaatccatcagcctgctcccggagcctgagaaaactcttcacacagaggacacagaccatcagcatacggctagccacggcgaagaggaagctcttaaagaggaccctccacgcaatctgctggaggagcggaaatccgaccagcttggtctgccacagaccctgcagcaggagttttctctgatcaacgtgcagatccggaatgtcaatgtggaaatggatgctgccgatcgtagctgcacggtgtcggtacactgttccaaccaccgcgtgaaaatgctggtgaagtttcccgctcaatatcctaacaatgctgcaccaagcttccagttcatcaatcctacgacaattacaagtactatgaaggccaaactgctcaaaattctgaaagacacagctctgcagaaggtcaaaagaggccagagctgcctggagccctgcctcaggcagttagtgtcgtgccttgagtcattcgtgaaccaagaagatagtgcatccagcaaccccttcgctcttcctaactccgtcacaccacctctgcctacttttgctagggtgacaactgcttatggtagttaccaagatgcaaatatcccatttccacggacttctggtgcgagattttgcggcgctgggtacctggtctacttcacccggccaatgactatgcaccgtgccgttagccctactgagcccacgccccgttcccttagtgccctgagcgcctatcatacgggattaatcgctcccatgaaaataaggaccgaggcccctggtaatctgcggctgtattccggctcccccactagatcagaaaaagagcaggtaagtatcagttctttttactataaggagcggaagtccaggaggtggaaaagcaagagggaagggagcgactcagggaacagacagattaaagctgctggaaaggtgatcatccaggacattgcgtgcctgctgcccgttcacaagtctctgggggagctttacattctaaatgtgaacgacatccaagagacctgccaaaagaatgccgcttccgcacttctggtgggccgtaaagacctggtgcaggtgtggtctctcgccaccgtcgctacggacctgtgcttagggccaaaatctgaccctgatctcgagactccctgggccaggcaccctttcggacgccagctccttgagtccttgctggctcactactgccggctgcgtgacgttcagacactggcgatgctatgctctgttttcgaagcccaaagccgccctcagggactgccaaatccattcgggccatttccgaaccggtcctcaaatctggtcgtctctcattcacgatacccgagctttacctcttcaggcagctgcagcagtatgagtgaccccggactcaacacaggtgggtggaacatagccggtcgcgaagccgagcatcttagctcaccctggggcgagagtagccctgaggagctcaggtttggctcattaacttactctgaccccagagagcgggagcgtgaccagcatgacaagaataagcggttactggaccctgctaacacgcagcagtttgatgacttcaagaaatgctatggcgaaatcctgtatcgttggggactgagggagaagagggccgaagtgctcaagttcgtgtcctgcccaccagacccccacaagggcattgaattcggcgtgtattgctctcattgcagatcagaggtgcgaggaacccagtgtgccatctgcaagggcttcacttttcagtgtgccatctgccacgtcgccgtcagaggatccagcaacttttgtctgacttgtgggcatggtggacataccagccacatgatggagtggtttagaacacaagaggtgtgccctaccggttgtggttgccactgcctgctcgaatccacattttag

SEQ ID NO: 61131 - DNA, 1377 bp, Artificial Sequence
  Description of Artificial Sequence: Synthetic coding sequence
atgtcagtagattgcttgggacagcatgcagtcctgtcagggcgacgctttctgtacattgttaatctcgatgctccttttgaaggccaccgcaaaataagtcgccaatctaaatgggatatcggagcagtgcaatggaatccccatgactctttcgctcactacttcgcagcgtcttccaaccagagagtggacctgtataaatggaaggacgggagcggagaagttggcaccacgctccagggccatacacgtgtgatctccgatttagactgggcagtttttgagcccgacctgctggtgacttcttccgtggacacatacatttacatctgggacatcaaagacaccagaaagcctacagtcgctctgagtgccgtcgccggagccagccaagtcaaatggaataaaaaaaatgcaaattgcctggctacctcacatgatggagatgtgaggatctgggataaacggaagccatcaacagcagttgaatacctcgccgcacacctgtctaagatacacggcctcgattggcatccggattctgaacatattctggctacctccagccaggataatagcgtaaaattctgggattaccgacagccgaggaaatacctcaacatcctgccctgccaagtccctgtatggaaagctcgctatacaccattcagcaatggactcgtcaccgtgatggtgcctcaactacgtagagagaactcactgctgctgtggaacgtgttcgacttaaatactcctgtgcataccttcgtgggacatgacgacgtggtgctcgaatttcaatggcgaaaacaaaaggaggggagtaaggattatcagctggtcacctggtcccgcgatcagaccctcagaatgtggcgtgtcgacagccagatgcagaggctgtgtgccaacgatattctcgacggcgtcgatgagttcattgaatccatttccttactgcctgaacccgaaaagaccctccacacagaggataccgatcaccaacacaccgctagccatggcgaagaggaggccctgaaggaggacccacctaggaaccttctggaagaaaggaagtccgatcagctgggtcttccgcaaaccctccagcaagagttctctcttattaatgtacagatcaggaatgttaacgttgagatggatgcagccgaccggagctgcacggtaagcgtacactgctcgaaccatagagtcaagatgctggtgaaattccccgctcaatatcctaataacgcagctccaagcttccagtttataaacccgacaactattacctctacgatgaaggctaaactcttgaaggtcggggtctgggtaccaaagttcagcttgttattttgcattattgtgtag

SEQ ID NO: 61132 - DNA, 993 bp, Artificial Sequence
  Description of Artificial Sequence: Synthetic coding sequence
atggctacgaaagagagtagagatgcaaaagcacagctggccctcagctccagcgccaatcagtcaaaggaagtgcccgagaacccaaattatgccctgaagtgcaccttagtgggacacactgaggccgtctcctccgtgaagttttcccccaacggagaatggctagcctcctctagtgccgacaggcttataataatttggggagcctatgatggtaaatatgaaaaaaccctatatggtcacaatttagaaatctcagatgttgcctggagttctgactcctctcgattggtaagtgcgtccgacgataaaactttaaaactgtgggacgtgcgtagtgggaagtgcttgaagacacttaagggacatagtaattacgtcttctgctgtaacttcaatccaccttctaacctgataatctctgggtcatttgacgagacagtgaagatatgggaggtgaaaacaggtaagtgtcttaagactctctcagcccattctgaccccgtgagtgcggtccacttcaactgtagcggctcattaatcgtcagcggaagctacgacggactatgtcggatatgggacgctgcaagtggccaatgcctgaaaacccttgtcgatgatgacaaccccccagtgagctttgtgaaattcagcccaaatggaaagtacatactcactgcgaccctggacaacacccttaaactgtgggactactcacgtggcaggtgccttaaaacttacaccggccacaagaacgagaaatactgcatatttgccaacttttctgtgacgggtggcaagtggattgtgtcgggaagtgaggataatttggtctatatctggaaccttcagacgaaggaaatcgtccagaagcttcagggtcatacagacgtcgttattagcgcagcttgccacccgactgaaaatctgatagccagtgccgctttggagaatgacaaaactatcaagttgtggatgtcaaatcactag

SEQ ID NO: 61133 - DNA, 3201 bp, Artificial Sequence
  Description of Artificial Sequence: Synthetic coding sequence
atggaacctggtaagagaaggaccaaagatgatacctggaaggcagatgacctgagaaagcacctgtgggcaattcaatctgggggaagtaaggaagagcggaaacaccgggagaagaaattgcgcaaagagtccgaaatggatcttccagagcataaggagccacgctgccgagatccagaccaggacgcgaggtccagggacagagtggccgaagtccatactgctaaagaaagtccccgtggagagagggaccgggatcgccagagggagcgtaggcgcgatgccaaagaccgcgagaaagaaaagctcaaagaaaagcatcgcgaagctgaaaaatctcactcccgcggtaaggaccgggagaaggagaaagatagacgggctcgtaaggaggaacttcgacagacagtggctcaccacaacctcctgggtcaggaaacgcgggataggcagctcttggagagagccgagcgcaagggcaggtccgtgagtaaggtcaggagcgaggagaaggacgaggactccgagcgaggggatgaggacagggagcgcagatacagagaacgaaaactacagtacggcgatagtaaggacaatcctttgaaatattggctgtataaggaggagggggaacggaggcatcgtaagcctagagagccagacagggacaacaagcatcgcgaaaagagtagtaccagggagaagagggaaaaatacagcaaagaaaaaagtaatagctttagcgataaaggtgaggagcgtcacaaagaaaaaaggcacaaggagggattccatttcgacgacgagagacaccagagcaatgtggatcgaaaagagaagtcggcaaaggatgagccccgaaaacgcgaatcacagaacggcgaacaccgcaacaggggagcatcctcaaagagggatggtacaagttctcagcacgcagaaaacttggtgcgcaatcatggaaaagacaaggatagccggagaaaacacgggcacgaggagggctcctctgtttggtggaagcttgaccagagacccggaggcgaggagaccgttgagatcgagaaggaagaaactgatctggaaaacgccagagctgacgcctatacggcgagctgtgaagacgacttcgaggattatgaggatgatttcgaagtgtgtgatggggacgacgacgagagcagcaacgaacctgagtctagggaaaaactggaagaacttcctctggcacagaagaaagagatccaagagatacagagggccataaatgccgagaatgaacgcatcggagagctgagtctcaaactctttcagaaacggggacggaccgagttcgagaaggagccacgcacagacactaattcttctcctagccgcgcaagcgtctgcggcatttttgtggacttcgcgtccgctagccatcggcagaagtcccggactcaagctttgaagcagaagatgagaagcaccaagctgttgagacttatcgatctagatttctcttttaccttctcactcctcgaccttcccccagtcaacgaatacgatatgtatatccggaatttcggcaagaaaaacaccaagcaagcatatgtccagtgcaatgaagacaatgtcgaacgcgatatacagacagaagagatagagacaagggaggtgtggactcaacatcctggtgagtcaaccgttgtaagcggaggctccgaacaacgcgacacctccgacgccgttgtgatgcccaagatcgacacacctaggttgtgctcttttctcagggccgcatgtcaagtgatggccgtcctactagaggaagacagattagccgctgagcccagctggaacttgcgcgctcaagacagggcactttacttttcagacagctcaagtcaactgaacacgtcccttccatttcttcagaatcgtaaagtcagcagcctgcacacttctagggtccaacgtcagatggtggtttcggtgcatgatctcccagagaagagcttcgtaccactgttggacagcaagtacgtcctctgcgtgtgggatatatggcagccctcaggcccacagaaagttctaatctgtgaatcccaggtgacatgctgctgcttgagcccactcaaagcatttcttctcttcgcgggaaccgctcacgggtcagtggtggtgtgggacttgcgtgaggacagccgacttcattacagtgtgactctgtccgacggtttctggactttcagaacagccacattctccacagacggcattctcaccagcgtcaatcacaggagtcccctgcaagccgtggaaccaataagcactagcgttcacaaaaagcagtcgttcgtgctatcgcctttttctacccaggaggagatgtcaggcctgtccttccacattgcttcccttgacgagagcggtgtgctgaacgtatgggtggtagtagagctacccaaagccgatatagctggctcgattagcgacttgggccttatgccgggagggcgtgtaaaactcgtgcattctgcgctcattcagctaggggactctctcagccataagggaaacgagttctggggcactacacaaacgctgaatgttaagttcctgcctagcgatcccaaccattttataatcgggacagacatggggcttatctcacatggaactaggcaggacctgagagtcgcccctaaactgtttaagccccagcaacacgggatccgcccagttaaggtaaatgtaattgacttttcccccttcggagagcctattttcctggccggatgctcagacggctccattagactgcatcaactgagttccgcatttcccctcctgcaatgggacagctctactgactcacacgctgtaaccgggctgcaatggtccccaaccagacctgcagtcttcttggttcaggatgatactagcaatatctacatctgggaccttttgcaaagcgatctgggtcccgtggctaagcagcaggtcagcccaaataggctagtagctatggcagcagttggtgaaccagaaaaagccggaggtagtttcctggctcttgtgttagccagggctagcggaagcatcgatattcagcacttgaagcgacgttgggccgcacctgaagttgatgaatgtaatcgattaagactgctcttgcaggaggccctgtggcccgaagggaaacttcataaatag

SEQ ID NO: 61134 - DNA, 918 bp, Artificial Sequence
  Description of Artificial Sequence: Synthetic coding sequence
atgaccaaccagtacggaattctgttcaaacaagaacaggcccatgacgatgcaatttggagcgtggcttggggtaccaacaaaaaggaaaacagcgaaacagtggtaactggatccctagacgatctggtgaaggtgtggaaatggcgggatgaaaggctagacctgcagtggtccttggagggccatcagctgggggtggtgtcagtagacatttctcacacccttcctattgctgctagcagctcactggatgcacatatccggctgtgggatcttgagaatggtaaacaaattaagagtatcgatgctggaccagtcgacgcttggaccctggcctttagcccggatagtcagtacttagccaccgggacacacgtggggaaagtgaatatctttggcgttgaaagcggcaagaaggagtattcactagacacccgcggtaagtttatattaagcattgcctactcacccgacggaaaatacctggcaagtggagccattgatggtataataaacattttcgacattgccactggcaaacttcttcatactctggaaggacacgccatgccaatcaggtccctaacgttctctcctgactcccaactgcttgtcacggccagtgacgatggatatatcaagatttatgatgtccagcatgcgaacctggcagggacattgtcaggtcacgcctcctgggtcctcaacgtggcattctgccccgatgatacacacttcgtctccagctcatccgacaagtcagtgaaggtgtgggacgttggtaccagaacttgtgtccacacattctttgaccatcaggaccaggtctggggcgtgaagtacaacggaaatggctcaaaaattgtcagcgtgggagatgatcaggagatccacatatatgactgccccatctag

SEQ ID NO: 61135 - DNA, 918 bp, Artificial Sequence
  Description of Artificial Sequence: Synthetic coding sequence
atgactaaccaatacgggatcctgtttaagcaggagcaggcccacgatgatgctatatggagcgtggcatgggggactaacaaaaaagaaaacagtgagaccgtagtcaccggctcccttgatgatttagttaaggtatggaagtggcgcgacgagcgccttgatttgcagtggtccttggaggggcaccagttgggggtggtatcggttgacattagccacacgctgccgatagcagccagctcaagcctggatgcccatattcggctgtgggacctagagaatggtaaacagattaaatctattgatgccggtcctgtggacgcatggaccctcgcattttcacccgactctcaatatctggccaccggcacacacgtggggaaagtgaatatttttggggtggagtctggcaaaaaagaatactctctagatactaggggaaagttcattctgtctattgcgtattctcctgacggcaaatatctggcctccggcgctatcgatgggatcattaacatatttgacattgcgaccgggaagctgctccatacattggaaggacatgctatgccaattcgcagcttgactttcagccctgactcgcaactgctggtgactgctagcgatgacggatacatcaaaatctatgacgttcagcatgccaatcttgcaggcactttgtctgggcacgctagctgggttttgaatgtggcgttctgccctgatgacacccactttgtcagctcttcgtctgataaaagcgttaaggtgtgggacgtcggaaccaggacctgtgtccacacattctttgaccaccaagatcaggtgtggggcgtgaaatacaatggaaacggatctaaaattgtatctgtgggcgacgatcaagaaatccacatctacgattgtccaatatag

SEQ ID NO: 61136 - DNA, 885 bp, Artificial Sequence
  Description of Artificial Sequence: Synthetic coding sequence
atgactaaccagtacggtatcctgttcaaacaagagcaggcccacgacgatgctatatggtcagtcgcatggggaaccaacaagaaggaaaattctgaaactgtggtgaccggctcactcgacgacttagtgaaggtctggaaatggagggacgagcgcttggacttacagtggagtctggagggccatcagcttggtgtggtgtcagtagacataagccatacgctgccgatagctgcctcatccagtctcgacgctcacatacgcctctgggacctggaaaacggaaagcagattaagtcaatcgacgccggtcctgtcgacgcttggaccctagccttctccccagatagtcaatatcttgcaacgggcacacatgtaggtaaggtaaatatttttggagtggagtccggtaaaaaggagtactccctcgacacgcggggaaaatttatattgagcattgcatattcaccagatggcaaatatctagccagcggggctattgatggaatcataaatatcttcgatattgccaccggtaagctcttgcatacattggaagggcacgccatgcctatccggtcccttaccttttctcctgattcccagctcctggtcaccgcctcggatgatggttacataaagatctatgacgtgcaacatgctaatctagctggaacactgagtgggcacgcctcctgggtgctgaatgtcgcgttttgccccgacgacacgcacttcgtcagtagttcttccgataagtctgtgaaagtgtgggacgtcggaacccggacctgtgtgcataccttctttgaccaccaagaccaggtatggggtgtgaagtataatggaaatgggagtaagatcgtctctgtaggcgactag

SEQ ID NO: 61137 - DNA, 2676 bp, Artificial Sequence
  Description of Artificial Sequence: Synthetic coding sequence
atggcgccaaagcagaagaagaagacctccagaggaaagaaacgtctgaagcctgtgcttgctgcctctgaagatatggaaccggtgaacatggagtccatgggccatcccgaaatttacccgctggtgctcacgactaaaacccaggaaatttttaattgcagaatagatgaagatgtgactgacgaacaaccctacaaactgatcaacaaggaagacattttcgaggatctccgcaatcgagcagctgtgagcgactttcatcccgtcaaaaagatcgtccaggaatacccagggaatgaactattgctggtgtatgataaagacttcaaatacgggctgaatttttatctaatcgcaacagaggagggcaaggagaactatctcaacccccctgaggtgccagaagagcaggaggaatacaaggagcacatacctgaagacgtttacatctacaagcccccagtgtcgaagccatgggtgagcctgggcagcgaaaaggagattgaggaggagtcagtgacagaaagcacaaagcaaattacgtacatgattagtagaaagcgtagcgaatttggcgctccgatcaaattctctgatcagaatgctagtagtgtcaaagatgcctatattgagtgtacagcatacccagacaaaaattttaccctgaaacagctggaaaaggatgtcggtatgcaggtgatcccccagataaaagatatttctacccaaactaaatggacttatccgaagaacgccacaactcagtattacccacgtgagttctccgaggaggagaaggagacccttaagcagtcgaaaccattagtcgactttttaaacaatgcctctattagcgttgaaatagccctccagcaaaatgaaattatgaacacttttatagacgactggaagtatctcgccgaggaggagggaacgtttggagacaaaacggatacacacttgaaggagtatcaatccttcacagatctccactctccaaccgaaaagatgattacatgtgtctcttggcatccgacaatatatggcctgattgctgtttcagtggcggtgcggttgtccttcgaggaccgggtgcacttttctggcaagctgctgcttcaacccagcctcattttattttggagcttttccgacccaattcatccacaactgatgttggaatcacccgatgacatattttgctttaaattttgtcctagtgatccaaacattatcgcaggcggatgcatcaatggccaaatcgtgatgtgggacatcaccgcgcacgccgatcggattgagaacattaaggctggtggttcccggagcaagcgggctacactgaaaccaatgtttctgctcgagcccgaaagcaacaaagaggccatgtacattcggcactgcgcggtatcctcaatcgagaatgggcataagaaggtgatcacagatattcattggctgagcgatactttcgaaatcaaccggatgggttccgtttttgagaataggagcgggatttgttgtcaactggtgacctgctccgcagactgcaccatctgtttttgggatattcgaccacagaagcctctgaccccacagacaaccgagaagaaaaaggaggaatctatcgagataccctttgatgtgcccagcacatttcttcacctggatttgtcttggaaacctctcactaaggttaggctgagtaagggcgaaactagccttgatcattgtccaacaaagatttctcttaacgaagatcacctcctgtgtaagacgcaggacaagatgctggcccagtctaaaacagagaaggctgaggagatgaatccataccataacttggaaagcggaatggcgaatctcctcaagcctattgatgacttttgcacaaaattctttgtgggaactgaggagggcgaggttatctacaccgattggaagatggagaaggatccggagaccgggcgtctgatgtccaagaagcctgtcagccatcacaccatccacgatggcactgtgcatacaatacagagatctccattctataacgatattatcttaactgtggggggatggaacgttgcgatctggaaagaaggcgtgatgactgggccacttctccagagctgctgtgcccctaagagatacacatcaggacattggtctctgactcgtcccggtgtattttacataggaagggaagacggctatattgatatttgggatctgctggagaagactcatgaaccagctcaatcacagaatatctgtataactatgatcacctacattaagccctggatcttcagttcgaagcaacagtttattgccacagcggattactacggcacactacacatcctggagattccctggacactctcccgaccatccactaatgagatggcgagcgtaaatcactatttcgagcgtgaagtaaagcacctggagtacgtggagcagcgcaagaagatcagagagcaagaaaagaaagaaatggaactggaaatggctaagaagaaggttaagacttaccagaagagcaaggagcagatgcaggccgaactgaaaatggattatgagtcatacctcgagctcgagaaaaccgtgctaatcaacttgggccttataaaggtgaccgaaaagggctcatatatggaggtgatgtag

SEQ ID NO: 61138 - DNA, 2559 bp, Artificial Sequence
  Description of Artificial Sequence: Synthetic coding sequence
atggcacctaaacagaaaaagaagacatccagaggtaagaagagattaaaaccagtgctggctgccagcgaggatatggaacctgtcaacatggaaagtatgggccaccctgagatttatcctctggtgttgacgactaaaacccaggagatcttcaactgcaggatcgacgaagacgtcaccgatgaacagccgtacaagctgatcaacaaggaggacattttcgaagacctccggaatcgggctgccgtgtccgatttccatccggtgaagaaaatagtgcaggagtatccaggtaatgaacttctcctggtatacgataaggactttaagtacgggttaaacttttacctgatcgctacagaagagggtaaggagaattaccttaacccgccagaggtgccagaagagcaggaagagtataaagaacacatccccgaggatgtctacatttacaagccccctgtatcaaaaccatgggtttcgctcgggtccgagaaggaaatcgaagaagagtccgtcaccgagagtactaagcaaatcacatacatgatatcccggaaacgctctgaatttggggcacctataaagttttccgatcagaacgcatcatccgtgaaggatgcctacatagagtgcacagcgtatcccgataagaatttcaccctcaaacaactggagaaggatgtaggtatgcaggtgattccgcagatcaaggatatcagcacacagacaaaatgcgtggaaatcgcactacagcaaaacgaaattatgaatacctttattgacgattggaagtacctggccgaagaggaaggaaccttcggggacaaaactgacacccacttaaaggaatatcagagctttacagacctgcactcacccaccgaaaagatgattacatgtgtctcatggcatccaactatctacggattgattgctgtgtctgtcgcagtgcgactgtcattcgaggaccgtgtacacttttctgggaagctgctactgcagccgtcactaatcctgttttggtctttctccgaccccatccacccacaacttatgctcgaaagtccagatgacattttctgcttcaaattctgcccaagtgatcccaatattatcgccggtggctgtatcaatggtcagatcgtgatgtgggatattaccgctcacgccgataggatcgaaaatatcaaagcaggaggctccagatcgaagcgagctactttaaaaccaatgttcctgctcgagcctgaatccaataaggaagccatgtatataaggcattgcgccgtgtcatccatcgagaatgggcataagaaagtcatcacggacattcactggctgagtgatacatttgaaatcaatcggatgggaagcgtttttgaaaaccgctctggaatttgctgtcagctggtaacatgttctgcggactgcacaatatgtttttgggatattcggcctcagaaacccttgacaccacagacgactgagaagaaaaaggaagaaagcatcgagatccccttcgatgttccttcgacatttttacatctggacctctcctggaagccccttaccaaggtcaggctgagtaagggcgagacaagcctcgaccactgtcccactaaaatttctctgaatgaggaccacttgttatgcaagactcaggataagatgctggcccagtcaaaaacggaaaaagccgaagagatgaacccctaccacaacctggagtctggtatggctaacctgctgaagcccatcgacgacttttgtaccaagttctttgtgggcaccgaggagggcgaggttatatatacagattggaaaatggagaaggaccctgagaccggacggctgatgagcaagaagccagtaagtcaccacactatccacgacggaaccgtgcatacgatccagcgaagccctttctataatgatataatcctgacggtcgggggatggaacgtcgctatctggaaggagggtgtcatgaccggtccattgcttcagtcttgctgcgcaccaaaaagatatacaagtgggcactggagcctgacacggccaggggttttctacatcggaagggaagatggatatatcgatatctgggacttgctggagaagacacacgaaccagcccaaagccagaacatttgtataaccatgataacatacatcaaaccgtggatcttctccagcaagcaacagttcatcgccaccgcagactactatggcacccttcatatcctggagatcccatggaccctctcccgaccttccaccaacgagatggcatcagtgaaccactatttcgagagggaggtcaaacacctggagtatgtcgagcagcgcaaaaagatccgtgaacaggagaagaaagagatggaactcgaaatggcaaagaaaaaggtcaagacctatcaaaaatccaaggagcagatgcaggcagagttaaagatggactacgagagctacttagaactggaaaaaactgtgctcatcaacttgggactgatcaaggtgactgaaaaaggaagctacatggaggtgatgtag

SEQ ID NO: 61139 - DNA, 2559 bp, Artificial Sequence
  Description of Artificial Sequence: Synthetic coding sequence
atggctccaaagcagaaaaaaaagacttcacgaggcaaaaaacgcctaaagcccgttctggcagcctctgaggacatggagccggttaatatggagagcatgggtcaccctgagatctaccctctagttctgacaactaaaacccaagaaatctttaattgtagaatcgatgaagacgtcacagacgaacagccatacaagttgattaacaaagaagatatctttgaggacttgagaaatcgcgctgccgtcagtgattttcaccccgtcaagaagatcgttcaagagtaccccggaaacgaattgcttctcgtctacgataaggatttcaaatacggtcttaacttctatcttatcgccacagaagaagggaaagagaattatctaaatcctccggaagtccctgaggaacaggaagaatacaaagagcacatccctgaagacgtgtacatctacaaaccccctgtctctaagccctgggtgagtctggggagcgaaaaagagattgaggaagagtctgtaaccgagtccactaagcaaatcacttatatgatttccagaaaaagaagcgaattcggtgcccctattaaattcagcgatcagaacgcatcaagtgttaaagatgcgtatatagagtgcaccgcttaccctgataaaaattttacactcaagcagctcgaaaaagatgtgggcatgcaggtgatcccacaaattaaagacattagcactcagaccaaatgtgtcgagattgccctgcagcagaacgaaattatgaatactttcatagacgattggaagtatctggctgaggaagaggggactttcggcgacaagaccgacactcatctaaaggaatatcagtcgttcaccgacctgcactcccctactgagaagatgattacctgcgtcagctggcatcctacaatctatggcctgatcgccgtttctgttgctgttcggttatcatttgaggatcgggtacattttagtggtaaactcttgcttcagcctagtctaatcctgttttggtctttttcagaccccattcacccccagcttatgctcgaaagtcctgacgatatattttgtttcaaattttgtccctccgatcccaatatcattgcaggaggttgcattaacggtcagatcgttatgtgggacatcacagcacacgcagaccggattgagaatataaaggcaggcggaagccgatctaagcgtgcaaccttaaaaccaatgttcctgcttgagcccgaaagcaataaggaagctatgtacatccgccactgcgctgtgtcctccatcgagaatgggcataagaaagtgattaccgatatccattggctcagtgatacctttgagattaataggatgggatccgttttcgaaaacagatccggaatttgctgccaactggtgacttgcagtgccgattgcaccatttgcttttgggatatcagaccccagaaacccttaacaccacagaccacagaaaagaaaaaagaagaatccatcgaaattccattcgatgttccatctaccttcctacacctcgatctgtcctggaagccactcaccaaggttagactgtcgaaaggggagacaagcctggatcactgtcccaccaaaatctccctgaacgaagaccatctgctttgtaagactcaggacaagatgctggctcagagcaaaactgaaaaggcagaggagatgaatccttatcacaacttggagtcgggaatggcaaacctgctgaagccaatcgacgatttctgcacaaaattctttgtgggcacagaggaaggggaggtcatatatactgactggaaaatggagaaggatcctgagacagggagacttatgagtaagaagccagtgtcgcaccacaccattcacgacggaacagtgcatactatacagagaagtcctttctataatgacatcatcttaacagtgggtggctggaatgttgccatatggaaggaaggggtgatgacaggcccacttctacagtcttgttgtgcccctaaaagatatacttctggacattggagcttaactagacccggagtattttacatcggtcgtgaggatggttacattgacatctgggacctactggaaaagacacacgagcccgcacagtctcagaacatttgtattaccatgatcacctacataaagccctggattttctctagtaagcagcagttcatcgccacagccgactattacggtacactgcacattctggaaatcccatggactctttcccggccttccaccaatgaaatggcgagcgtaaatcattactttgagagagaggtaaagcacttagagtatgtagagcagcgcaaaaaaatccgggaacaggagaagaaggagatggaactagagatggctaagaagaaggtaaagacataccagaaatccaaagaacagatgcaagcagagctcaaaatggattatgagtcttaccttgagttggagaagactgtactgattaatctcgggcttatcaaggtcacggaaaaagggtcctatatggaggtcatgtag

SEQ ID NO: 61140 - DNA, 3246 bp, Artificial Sequence
  Description of Artificial Sequence: Synthetic coding sequence
atggatattagaaaagaaaagcgtctcaatatggcacttcagatgagtaacttcaaaaaagctctgaaccgctttgagaagttggttgagcaaaccgccgctcagaaacgcgacgagcgggcaggcctttttatacataaggaagatgccatcggatacgacaaattctacgcatcagtccagaaactgttcggacctgacgtgaagaaccaggatgtgaaacggttttacagaaagctctgcaataacactgatgcctcagccgactggtgtgaaatcttcggttacttctcatctgaagaagatccaatagcaagccagctggacgaggaaaatctggtgtttttcgtgtcacgaaagagacgtatcctaatttctggatcacgtaggcgtgatgtgatcaagtcgatcgtgaagatcccccatctagatcttctgattacggcgacgcagaagggactgatcactgtgtttaataatcaggatacttcttggatcacgggatgcgattacttgcttcagctgaaacgtatagttgccacgaccgaacgaaccatcatagtctgggattacaaagctcagggaagtagccaggaaaattatttcgttattaaaccaatggatcattgcctgctgtgcgtgtgcgtcgtccctctgccagaccatctttgtagggatgacattttgctgggcgacgatggcggttttgttaatcggttcaccgtgaatagcgatgacttcgggattaaacaggccaagagtaaaaggaagctgcagaatcaggttctggattccaagaatttcaagagcgtgaagaggaagctgcacaatgattgggtcatgaagattaggtacattagtgcgctgaactgtttcggttcctgttcactggacagtaaccactctctagtcctcgagagcttgaagcggctggaggacaatctccccgtgcgcgaatttagcatgccgaggggggctaataccttttgctactgtgtcaaggctaatgtcatcgtgaccggcggagatgacaaagtgatcagactgtggcacccaaatatcagcaccaagccagtggggaaactggtcggacacatgttttccatagccgagattgtgaccaatgagaaagatcagcatgtggtgtccctgagtagcgccaaggtgttccgcgtctgggacattcagaccttaagtttactccaggttttccacgactcacagggaggcccaggcgatatgcagatttactcaatgatctatgatgcaaaccacggtatgttgattaccggaagttccgtgatggatatgtacccgttgacccgtatgatccaagatacaaaacaggtgccccatactcacgaaagggaaattaatgtgatgttgtacaataagtactttcatcaggtgctgaccatttgttcagagtctattattagggtttgggagctggagaccgggctgcaggtctaccagatcctcgagccgcatggatttaacaccgaggttacgagcgccgcagtggacgagagcggattcctgtttgcgactggggcttataacggtactgttaggatttgggacttcgggtctggccaggaaatgaaggtcctacccgagggtaaagactggaaagaggacgaacattgcctacgcagattgatttttctaaaggcacaagaaaagcaccagcaactcgtgctggcactggagcgaaatggaactattaaaatgattcaggggaaggaggatgatatctacctgatggtgatttgggaactccccgacgtagtgcccttcctgcaggacggcaagcacgctgtccacttgaggatgtctacacgggaccgaaacatggctattccttttcctgatgtggaacttatcgtggagaggaatttttcccagcctaccgacaaccctactatggatctgctcagggtaaactgtatagacttgctgcaagtggaggggtataatctcattgcagctgggacccttaatggcgtcatcattctctggaactttgtcacaagtacagttaagaaagtgtacagacccgaggattgttttactgtcaacccagatctccaccccaaacactttaaaattaatgacatcctgtttctgttccgcactcctgaatgtgcccgacgctcttcacaggatagcatatgtagctctagccagtgcgagtccagtaagggtccacagtcatccaaaggcagcaagcaatccatccacgattctgaagtaaagggtgaacagaccgacgtcatggttggaaaacaacagcccatggacaaaaaacatccaggaatcgcaaaccttcctgaagcccagcctcctattctcgtgacggcccacgaggatgggcacctccgactctggacgctggaaggcagacttctgaaagatatgctcccattcacgaaacatagcgctatttcattaacctctctgtacaccgacagctgcacacggatcttactggccggtaatgtagaaggtcatgtcatcttgtgcaatattagcagctttttagatccaccacacgacgagaagaaatttaagcaactgctctcttggcgggcacattccctcgaaattattcaggttatctacgtggaggaaaagcaggtggtcttgaccgcctccatcgatgggagtgtacgcctgtggcacgctctcaatggtcactattgtgggtacttcgggcagcgaagactgttcgaactttcacagacccgagattttatcctgccctgcgacgtgactgagtaccccatagaaataaaagaggaaagtaaattcaccgaaaaacagaagtatgaatatcccctcatcttcgacagagagaaatggcggaaaatgtcctccgtgtcattactgttcaaaagaacgcccccaaaagcattcgaggtggagcaagattttaagttttttaagtcactgtcatcccccaaaattaggaggtatccgctggaaggtttcgttacagagaaccgggaagccggaatcgtgtttggaagtttacccatctattcaatcagcagccccactagtctcaggttcttgcccctcatcggggtggaggctcaaaaggacagctctgatggcatcaccggcaagaaaaagggtggacacgtgcaaagggagaaagctccaagacgcaggagtctaaagaaaaatcttgtccctcaaattaacctggcttcctcattttttcccgctatcccaaaatag

SEQ ID NO: 61141 - DNA, 2745 bp, Artificial Sequence
  Description of Artificial Sequence: Synthetic coding sequence
atggatatacgcaaggagaaacggctaaacatggctctgcagatgagtaacttcaagaaggctctgaacagattcgagaagctcgtggaacaaacagccgctcaaaagagagacgaacgcgcaggcctgttcatacataaagaggatgccatcggttatgacaaattttatgcttcagtccagaagctcttcggacccgacgtcaagaaccaagatgttaaacggttctacagaaagctgtgtaacaacaccgatgcatcagcagactggtgtgaaatattcggctacttcagctctgaggaagacccaatagcatcgcagcttgacgaagagaatctggtcttcttcgtgtctaggaagcgcagaatattgatctctggttccaggcggagggacgtcatcaagagtattgtgaaaatccctcacctggatctgctcatcacagcgacacagaagggtctgattactgtttttaataatcaggacaccagttggattacggggtgcgattacctgttgcagctcaaacggattgtcgctaccaccgagagaactattatcgtgtgggactataaggctcaaggatccagccaggagaactatttcgtcatcaagccaatggatcactgcttgctgtgcgtttgcgtggtgccactgcccgatcatttatgccgcgatgacattttactgggggatgacgggggatttgtgaaccgctttaccgtaaattctgacgactttggaatcaaacaggctaagtctaagcgcaagcttcaaaatcaagtgctggattctaagaactttaaatccgtcaaacggaagttgcataatgactgggtcatgaaaatccgctatataagcgcactgaattgcttcggttcttgctcccttgattccaaccattccctggtgctggagagcttaaaaagacttgaggacaatctccccgtaagggagttctccatgcctagaggcgctaataccttttgctactgcgttaaggcaaatgttatcgtcaccggtggcgatgacaaagtgattaggttgtggcatccgaacatttctacaaaacccgtggggaagctcgtgggccatatgttcagtattgccgaaatagtcaccaatgaaaaggaccagcatgtggttagcctttcctccgccaaagtgtttagagtgtgggacattcagacgctatcactgctccaggtgttccacgattcacaagggggaccgggagacatgcagatttactcgatgatctatgacgccaaccacggtatgctgattactggtagttctgtgatggatatgtaccccctaacccggatgattcaggataccaagcaggtgccgcacactcatgaacgcgaaatcaacgtgatgctgtacaataagtatttccatcaggtcctgacaatatgctccgaatcaattattcgggtgtgggaattagaaaccgggttacaagtataccagatcctcgaacctcatggattcaacacagaagtgacatctgctgcagtggatgaatcaggctttctctttgcaactggcgcatataacgggactgtcagaatctgggactttggatctgggcaggagatgaaagtgctccctgaggggaaagactggaaagaggatgagcattgcctgagacgactgatcttcctgaaagcccaggagaagcaccagcagttggtgcttgcactggaacgcaacgggaccatcaaaatgatacagggaaaagaggatgacatttatctcatggttatttgggaacttccagacgttgttcccttcctacaggatgggaaacacgccgttcacctgcggatgagtactcgagaccgaaacatggccattccctttccagacgtcgagttgatcgttgagcgcaatttcagccagcccacggataatcccaccatggacctgctccgggttaattgcattgacctcctgcaagtggaaggctataacctgatcgcggcaggtacactgaatgaagggcacgtgatcctgtgcaacattagcagtttccttgatcccccacacgacgagaaaaagttcaaacagctgctctcttggagggcacatagtctggaaattatccaagttatctacgtggaggaaaaacaggttgtccttactgcgagcatcgatggcagcgtaaggctatggcacgctttaaacggtcattactgtggctactttggacagaggagactattcgaactcagtcagacacgcgacttcattcttccctgcgatgtaacagagtatcctattgaaataaaagaggagtctaaattcactgagaagcaaaaatacgagtaccctcttatctttgatcgtgaaaagtggcgcaaaatgtccagcgtgtccctgctgtttaagaggacgcctccaaaagctttcgaagtcgagcaggattttaaattctttaagtccctgtcctctccaaagatcaggcgctatcctctcgagggtttcgtgactgagaatagggaggcgggaattgtgttcggctccctccctatatattcaatctcaagcccaacatcgctgaggttccttcccctgatcggcgtcgaagctcaaaaggatagctccgatggcatcactgggaaaaaaaaaggaggccatgtacagagggaaaaagcacctcgtcggaggagccttaagaagaacctggtcccacagatcaatctggcttcaagcttttttcccgctatccccaagtag

SEQ ID NO: 61142 - DNA, 3450 bp, Artificial Sequence
  Description of Artificial Sequence: Synthetic coding sequence
atgtctgacgccgctgaggccccaagggaggcaactggcgagaatggagagacagagatgaaagaggaggaggaacctaatccaaactataaggaggtcgaggacccccagcaggagagcaaggatgatacaattgcctggcgggaaagtcaagaggaagagcggaagactggtgaggaggagggagaggaggagggcaaagaggataagaagattgtaatggaagaaacggaggaaaaggcaggagaggtacaagaaaaggaggccagcggtattcaagaagaaacaactgtcgaaccccaggaggtaactgcttcaatgatcaggttagagacacagatcaccgacagtcagagcatcacctcaggcatatttcctaagacccagagaggctcgaagagcaagctttctctgcagctcgaggatgcagagaccgacgagctcttaagagatctgtccacacagatcgagttcttggatttggaccaaattagtccagaagagcagcagatatcctcacctgaacgccaaccaagtggcgagctcgaggagaagactgataggatgccacaggacgagttgggccaggagagacgcgatctcgaacctgagaacagggaagaagggcaggagcgacgtgtcagcgacatccagagtaaagccggtattagcagagagtcacttgtctcttccactaccgaggatattctatttcaaaaggataaatccacgccagtatatcccctcacaatgacttggagtttcggctggaatagctcacttccagtttactacattcgagaggaacgccagcgcgttcttctctacgtctgcgcccatacagcaatcatttataatgttttccgcaacaaccagtaccacttgcagggtcacgcaaatatcatctcctgtctatgcgtgtccgaagaccgccgatggatcgcaacggctgataagggtccagattgtttggtaattatctgggatagcttcaccgggatccctgtccacacaattttcgactcctgtccagaggggaacggaattatggcaatggcaatgactcacgacgccaaatacctcgccacaatctccgatgccgaagtgcagaaagtctgtatttggaaatggaccctggcagtggagacaccagcctgcaccttggaacttcctacagaatatggagtgcagaattacgtgacattcaatccaacaaataataaagaacttgtgagtaacagtaagactcgagctatatactacgcctggtacgaggaacgtgatacactcgcgcattctgctccactgctgacagagaagacgtttaacaaattagtgggtaaattcagtcaatccattttccatctgaatctgacccaaatccttagcgcaacaatggaaggaaaattggtggtgtgggacatacataggccgccttcctctgcctcaaccttcttaggattcccatatattaaaccttgtaaattggtgcacctgcaaaaggaaggaattacagtgctcacaacaatcgactcttatattgtcacaggcgatattaaggggaatatcaagttttatgatcataccctgagcatcgtcaactggtattcccacctaaaactgggtgctataagaacactctcattcagcaaaactcccgcaacgccacccactgagaaaagcaactatcccccagattgtactttgaaaggtgacttgtttgtcttacggaattttattataggcacatctgacgctgcagtgtaccacctgactaccgacggcacgaaactagagaaattattcgtcgagccaaaggacgccatttgcgccataagttgtcacccctaccaacccctgattgccatcgggtccatctgcgggatgattaaggtgtggaactatgaaaataagcaatacctgttttcacgcgtctttgagaaagggttgggggtgcagagtctgacctacaatcccgagggcgcactccttggcgctggtttcacagaaggaaccgtatacattttagacgctatgagtcttgaaaatgagagccctgaacccttcaaatattctaggacctcagtgacgcacataagtttttcgcacgactcccagtatatggcaaccgccgatcgcagctttacagtggcggtgtacatgttggtggtgcggaatgggcaacgggtctgggaataccttgccagattgcggagccatcgaaaatccattaggagcttattgtttggagtttacttggactccaacgagcccagacttctcagtctgggaactgaccgtcttctaatagaatatgacctactgcgatcatacaaggaccatttggaagtgctggatattcatcatacagaccagggatgctaccctacatgcatggtgtggtacccgcctctaacacgtgaactgtttttgttgatatgtaacagcggatacaaggttaagctcttcaatgccaccactaagatgtgccgcaagaccctactggggcctgcatacggctctccaattgaacaaacgcaggtgctgcccgtgcgcagcatggccgaactgcagaaaagatatctcgttttcatcaatcgggataaggtagggcttcagattcttccggttgacgggaaccctcataagacatctgcaattgtgtgccaccctaatggcgttgcagggatggctgtaagctacgatggatgctacgccttcaccgccggaggtcacgacagaagtgtggtgcaatggaaaatcaccctctcagtgctggaggccgctgtctccctaggcggtgaggacttaacccctttctatggcctactgtcaggcggtagggaaggaaagttctacagagagttggaagattacttctattactctcaattgcgctcccaggggatcgacaccatggaaacacgcaaggtgagcgagcacatttgcttaagcgagctccctttcgtgatgcgcgcaatcgggttttacccttctgaagagaagatagacgacatcttcaacgagattaagttcggcgagtacgtggacaccgggaagcttattgacaaaattaatctgcccgacttcctgaaagtctatctcaaccacaagccgccatttggtaacaccatgtcaggaatccataaatcgtttgaggttcttggttacaccaacagtaaaggtaaaaaagccatcagacgggaagacttcctgaggctcctggtaacaaagggcgagcacatgaccgaagaggaaatgctggactgcttcgctagccttttcggtctgaatccggagggttggaaatctgaacccgctacttgttccgtaaagggcagtgagatctgtctggaggaggagctcccagacgagatcaccgccgagatctttgctacagaaatattaggtctgaccatttccgaggactccgggcaagatgggcagtag

SEQ ID NO: 61143 - DNA, 2826 bp, Artificial Sequence
  Description of Artificial Sequence: Synthetic coding sequence
atgtccgatgcggcagaagcacctcgtgaggccactggcgaaaacggagaaacagagatgaaagaagaggaagagcctaacccaaactacaaggaggtcgaggacccacagcaggaatcaaaagacgataccattgcctggagggaatcacaggaggaggaacgaaaaacgggcgaagaagagggcgaagaagaaggcaaagaggataagaagatcgtgatggaggaaaccgaggaaaaggcaggcgaagtgcaggagaaggaagcctccggcatacaagaggagacaacagtggagccacaggaagttaccgcaagcatgattaggttggagacccagatcaccgacagccagagtatcacctccggcatctttcccaagacccagaggggaagcaaaagcaagctgtccctgcaactcgaggatgccgagaccgatgagctactgagggatctgtctacccagatcgagttcttggacttggaccagatcagccctgaagagcagcagattagttctcccgagaggcaaccctcaggagagctcgaggagaaaaccgacagaatgccccaggacgaactcgggcaggaaagaagagacctcgagccagagaaccgggaggaagggcaagagcgacgcgtttcagatatacagtccaaggccggtatcagtcgggagagccttgtctcttccactacagaagacatactttttcagaaggacaagtccacccccgtctatccattgaccatgacctggtcattcggatggaattcatccttgccggtttactacattagggaggaaagacagcgcgtactcctctatgtgtgtgctcatacagctataatttacaatgtattccgcaacaatcaataccatctgcaaggtcatgccaatattatttcttgtttatgcgtgtccgaggatcgtcgttggattgcaaccgcagacaagggacccgattgtcttgtaatcatatgggacagtttcactgggatcccagtccatacgatttttgactcatgtccagagggtaacggaattatggcgatggcgatgacacatgacgctaagtacctggccactatttcagacgcggaagtgcaaaaggtttgtatttggaaatggaccttagcagtggaaacaccggcttgtactctcgaacttcccactgagtacggagtgcaaaactatgtaacgtttaatcccacaaataataaggaactcgtgtcaaactccaaaacacgggcaatttactatgcttggtacgaggaacgggatacccttgcgcactctgctccactgcttactgaaaaaacatttaataaactggtcggcaaatttagtcagtcgatctttcatctcaacctgacccagatcctctccgcaacaatggagggtaagttggtggtctgggatatccaccgcccacctagctccgcttcaaccttcttaggtttcccctatatcaagccttgtaagctggtgcacctgcagaaagagggcattaccgtgttgactacaattgattcttacattgttactggagacatcaagggcaacatcaaattctacgatcacacactgagcatcgtcaactggtattcgcatttgaaacttggcgctattaggacactatctttctccaaaacacctgcaacgccacccacagagaagtcgaactacccccctgactgcacacttaaaggagatctcttcgttctgcgcaacttcattatcgggacttctgacgccgctgtataccacctcactaccgatgggactaaactggaaaaactgttcgtcgaaccaaaagacgcaatttgcgcaatcagctgtcacccttaccagcctctaattgccataggctctatctgcggtatgataaaagtctggaactacgagaacaaacagtacctgttttctcgggtgttcgagaagggactcggagtgcagtcactgacttacaatccggagggggcactcctgggcgctgggtttacagaaggcacagtctatattctggacgctatgtcactcgagaacgagtcacccgagccttttaagtattccagaacatctgtcactcacatttcctttagtcatgatagccaatatatggcgacagctgaccgttccttcacggtcgctgtatacatgctggttgtccgtaacggtcaaagagtctgggaataccttgccagattacggtcacatagaaagtctattaggtccctgctgttcggtgtctatctcgattctaatgaacctagactgttaagcctcggcacagatcggctgctgatcgagtacgatctactgcgaagttataaagatcaccttgaggttttggatatccaccataccgaccagggctgttacccaacatgtatggtgtggtacccgcctctgacaagggaactgttcttacttatttgtaactctggatacaaagtgaagctgtttaatgccactaccaagatgtgtaggaagactctgctgggcccagcctacgggagtcctattgaacaaacacaagtgcttcccgtcagatccatggcagaactccagaagcgatacctcgtgtttattaaccgggataaggtaggactgcagattctgcctgtggacggaaatccacataagacatccgccattgtgtgtcatccaaacggcgtagccggaatggccgtctcgtatgacgggtgctacgcatttactgccggaggacatgatcggagcgtcgtgcagtggaagatcaccctgagccaccccggatcccaagcccctatcttgtccccaagcgacacctcccgcagttag

SEQ ID NO: 61144 - DNA, 1248 bp, Artificial Sequence
  Description of Artificial Sequence: Synthetic coding sequence
atgaagctcaagagtctcttgctgcggtattaccctcccggaattatgttagaatacgagaagcacggggagctgaagacaaaaagcatcgatttactggacctcggacctagcacggatgtttcagctctagtggaagaaatccagaaggcagagcctttacttactgctagccggaccgagcaagtgaagttgctgattcagagattgcaagaaaaactgggtcagaattctaaccatacattctacctttttaaagtccttaaggctcacattttgccactgaccaatgttgctctaaacaaatctgggtcctgttttataacagggagctacgatcgtacttgtaagctgtgggataccgctagtggcgaggaactgaacacactggagggccaccgcaacgtggtttatgctattgctttcaacaacccgtatggtgataagatagctaccggcagctttgacaaaacctgcaagctgtggtccgtagagactggtaagtgttatcacacattccggggacatacggccgagattgtgtgcctgagctttaatcctcaaagcacacttgtggcaacaggctccatggatacaaccgctaaactgtgggatattcagaacggcgaggaagtctacactctgaggggccactcagcggaaattatcagcctctctttcaataccagcggtgaccgaatcatcacgggctcgtttgaccatacagtcgtggtctgggacgccgacaccggccgtaaagttaacatactgataggccattgcgctgaaattagctctgcatcctttaactgggactgcagcttgattctgacagggtccatggataaaacttgcaaactgtgggatgccactaacgggaaatgtgtggccacactgaccggccacgatgatgaaatcctggactcctgcttcgactataccggcaaactcatcgccaccgcatcggcagacggaacagctcggattttcagcgctgccacaagaaagtgtatagctaaactagagggccatgagggagaaatctccaagatctcctttaacccccaaggcaaccaccttctaacaggttccagcgataagacagccaggatctgggatgctcaaacaggccagtgcctacaggtcttagagggacatacagatgagatctttagttgtgctttcaattataaagggaatattgttatcaccggctctaaggataacacatgccgcatctggcggtag

SEQ ID NO: 61145 - DNA, 1203 bp, Artificial Sequence
  Description of Artificial Sequence: Synthetic coding sequence
atgcttgaatatgagaagcacggagagcttaaaaccaaatctatcgatctcctggatctgggaccctccactgacgttagtgccctcgttgaagagatccaaaaagcagaacccctgctgaccgcgagcaggaccgaacaagtaaagctgctgatccaacggctccaggagaaacttggacagaacagtaaccacaccttctacctgtttaaagtcctcaaggcacatatccttccgctgacgaacgtggctctcaataaatcgggctcctgtttcattacagggagctatgatcgcacgtgcaaactgtgggacacggcaagtggagaggaactgaacactctcgagggtcacaggaacgttgtgtatgctatcgcttttaacaacccctatggagacaagattgcaacaggaagttttgataaaacttgcaagttgtggtccgtcgaaaccggaaaatgctatcacacctttcgcggtcatactgccgaaattgtgtgcctgtcctttaatccgcaatctaccttggtcgcaaccggtagtatggacactactgcaaagctttgggatattcagaatggcgaagaggtttatactctgaggggtcattccgctgagattatcagcctgagttttaacaccagcggtgatcggatcatcacgggatcctttgatcacacagttgtggtgtgggatgctgacacgggacgcaaagtgaacatcctgattgggcactgcgcagagatcagctccgcttccttcaattgggactgtagtttgattttgacggggtcaatggataaaacctgtaagctgtgggacgctacaaatggaaaatgtgtagccacactgacaggacacgatgacgaaattctggacagttgtttcgattacaccggaaaattgatagctactgcttccgcagatggaacagcaagaattttttctgccgcaacacgaaaatgcattgctaaactggaagggcacgagggcgagatctcgaagatcagctttaaccctcagggcaatcacctgctgaccggcagttcagataagacagctcgtatttgggacgcccagaccggacagtgcttacaggtacttgaggggcacactgatgaaatcttttcgtgcgccttcaactacaagggtaatatcgtaattacaggaagcaaggacaacacatgccgcatctggcgctag

SEQ ID NO: 61146 - DNA, 1965 bp, Artificial Sequence
  Description of Artificial Sequence: Synthetic coding sequence
atggagcgatccggtccctcagaagtcaccggatctgatgcttccggccctgacccacagttggccgttactatgggcttcacagggtttggtaagaaagcaagaaccttcgacctagaggcaatgtttgaacagacgcggcgtactgctgtggaaagaagtcgaaagaccctagaagccagggagaaggaagaagaaatgaatcgggagaaagaattgcgcaggcagaatgaggacatagagcccactagctcaagatcaaacgttgtgagagattgttccaaaagttctagcagggacacctccagctcagagagcgaacaatcttccgactcctctgatgatgagttaataggcccaccccttccgcctaagatggttgggaagccggtcaacttcatggaggaggatatccttggcccactgccccctccacttaacgaagaggaagaggaagccgaggaggaggaagaagaagaggaggaggaggaaaatcctgtccacaagatccccgactcgcatgagatcaccctgaaacatggtaccaaaactgtttccgcgctaggcctggatccaagtggggctcgtctcgtgactggcggatatgactacgatgttaaattttgggattttgccggtatggacgcctcttttaaggcgtttcgctcactccaaccgtgcgaatgccaccagatcaaaagcctgcagtactctaacaccggagacatgatcctagtcgtcagcgggtccagccaggccaaagtgattgaccgcgatggcttcgaagttatggagtgcattaagggggaccagtacatagttgacatggccaacactaagggacataccgcgatgctgcatactggcagctggcaccctaaaatcaagggcgagtttatgacgtgttctaatgacgccacggtaaggacctgggaggtggaaaaccccaaaaaacaaaagagcgtgttcaagcctagaacaatgcagggtaaaaaggtgatccctaccacctgtacatactctcgggatggcaacctgatcgccgcagcttgccagaatggctccattcagatttgggaccgaaacctgacagtgcatcctaagtttcactacaaacaggcccacgatagtggaaccgatactagctgtgtgacattttcctacgatgggaacgttctcgccagcagaggaggagacgattctctaaagttatgggacattagacagttcaataagcccctattctctgcgagtggtctgccaacaatgttccccatgactgactgttgcttctcgcctgacgacaagctcattgtgactggcacgagtattcaaaggggctgcggttcaggaaagctcgttttcttcgaacgccgtacctttcagcgagtatacgagattgatatcacagacgcaagcgttgttaggtgtctgtggcatcccaaactcaatcagatcatggtgggaactgggaacggccttgccaaagtctactacgacccgaacaaatcccaaaggggcgcaaagttatgcgtggtcaagacccaaaggaaggctaagcaggcagagactctgactcaagactacattattacccctcacgccctcccaatgtttcgagagccgagacagcgatctactcggaagcagctggaaaaagaccgcctcgacccattgaaaagccataaaccagagccgcctgtggcagggcctgggaggggcggacgtgtcggtactcacggaggaaccctgtcaagctacatcgtgaaaaacattgctctagataagaccgacgattccaaccccagggaagcaattttgcggcacgcaaaagctgctgaggattcaccatactgggttagcccggcatatagtaagacccagcctaagaccatgttcgcacaggtcgaatccgacgatgaggaggcaaaaaatgagccagagtggaagaaacggaaaatatag

SEQ ID NO: 61147 - DNA, 1137 bp, Artificial Sequence
  Description of Artificial Sequence: Synthetic coding sequence
atggatcccggagacgactggttggtggagagcctgcgcctgtatcaagacttctacgctttcgatctttctggcgcaacgcgggtactggagtggattgacgacaaaggcgtctttgttgcaggatacgaaagcctcaagaagaatgagattttgcatcttaagctccctttgaggttgagcgttaaggagaacaagggactcttccccgaaagggactttaaagtacgccacggcggattcagtgaccgatctatctttgacctgaagcacgttcctcacacccgtttactggtgacatcagggttgccaggttgctacctgcaggtgtggcaggtcgcggaggattctgatgtgattaaagctgtctctactatagccgtgcatgaaaaagaagaaagtctgtggccgagagtcgctgtgttctcaacgcttgcacccggagtgctccatggcgctcggcttcgctccctgcaggtggtggatctcgaatccaggaaaactacttacaccagcgacgtatccgactccgaagagctgagctctcttcaagtgttggatgcagatacttttgccttttgttgtgcttcggggagactgggactggtcgatacaagacagaaatgggccccactagagaatcgatcacctggacctggcagtggcggtgaaagatggtgtgccgaagtggggtcctggggacagggcccagggcctagcattgcttccttaggatctgatggccgtctttgtctgctggatcccagagacctctgccacccagtttcttcagttcaatgcccagtcagcgttccttccccagatcccgaactcctgagagtcacctgggccccaggtctgaagaattgcttagccatatctggtttcgacgggacagtccaagtgtacgatgccacatcatgggatggtacgcgaagccaagacgggacacgcagccaggtggagcctttattcacacaccgagggcatatctttctagatggcaatggaatggatcccgcacccttagtgaccacacacacttggcacccatgccggccaaggacactgttatcagccaccaatgatgcctccttacatgtttgggattgggtggacctatgcgctccaaggtag

SEQ ID NO: 61148 - DNA, 1881 bp, Artificial Sequence
  Description of Artificial Sequence: Synthetic coding sequence
atgtctcgctctggcgcagcagccgagaaggccgacagtcgccagcggccacagatgaaggtgaatgaatacaaggagaatcagaatattgcgtatgtctccttaagacctgcgcagaccacagtgctgataaagacagctaaggtgtatctggctccctttagtttaagcaactaccagctggaccagctaatgtgcccaaagagtctttcagagaaaaacagcaacaatgaagtggcgtgtaaaaagactaaaataaaaaagacatgcagaagaattattccccctaaaatgaaaaacactagctctaaggccgaatctactctccaaaactcgagcagtgcagtgcataccgagtctaacaagctgcaaccaaagagaacggccgatgctatgaacctcagtgtcgatgtggaaagtagccaagacggtgactcagacgaggacaccacaccgtccctcgacttctctgggctgagcccttacgagcgcaagcgacttaaaaacataagcgaaaatgcggactttttcgcatccctccagctcagtgagagcgccgctagactccgcgagatgatcgagaaacggcaaccgcctaaatctaagagaaagaaaccaaaaagggaaaatggtatcggttgtagaagatctatgcggctgctcaaggtggatccaagcggtgtcagtttacctgcagctccaactcctccaacattggtggccgatgagactccattactgcctcctggccctctagagatgacttcagaaaatcaggaggataataatgaaaggttcaaaggatttctgcatacatgggctggaatgtcaaagcctagcagtaagaatacagaaaaaggcctgtcctcaatcaagtcctacaaagccaacctaaacggtatggtgatctcagaggacaccgtctacaaagttaccacggggcctatttttagcatggctctgcacccttctgagaccaggacgctcgtggctgtcggcgcaaagtttggccaggtgggcttgtgcgacctgacccagcaaccaaaagaggacggcgtctatgtgtttcacccacatagtcagcctgtgtcgtgtctgtactttagcccagccaatcctgcgcacatactctccttgtcttacgacgggaccctgcgatgcggcgacttctctcgagctatcttcgaggaagtgtaccggaacgagcggagctctttttcaagttttgacttcctggccgaggatgctagcacgctgatcgtgggacactgggacgggaacatgtcactcgtggacaggaggacaccaggcacttcttacgagaagttgacaagctcttccatgggaaaaatcagaacagtgcatgttcatccagtccaccgacaatacttcataacagctggactacgagacactcacatctacgacgcgcgacggctcaattcccggaggtcacagccactcatctctcttacagagcataccaaatctatcgcaagtgcatatttctcacctctgactggaaacagagtcgtgaccacctgcgcagactgcaaccttcgaatttttgattcatcttgtataagcagtaagatcccactcctcacgactatccgacataatacatttaccggaagatggctgaccagattccaggctatgtgggacccaaagcaggaggactgtgtgattgttggctcaatggcacaccccagacgggtcgagatatttcatgagaccggaaagcgagtgcattcgtttggcggtgaatacctggtgtccgtttgttccatcaatgccatgcacccgacccgctacattctggctgggggaaactcctccgggaaaatacacgtgttcatgaacgagaaatcgtgctag

SEQ ID NO: 61149 - DNA, 1689 bp, Artificial Sequence
  Description of Artificial Sequence: Synthetic coding sequence
atgtgcccaaagagtctgtctgagaaaaattctaacaatgaagtggcatgcaagaagactaagatcaagaaaacttgtcggagaatcataccgccaaaaatgaagaacaccagcagcaaggcagagtctaccctgcagaacagtagtagtgcggtgcacaccgagtctaataaattgcagccaaagagaacagctgacgcaatgaacttgagtgtagacgtagaaagctcacaggatggtgactcagatgaagacaccaccccctcgctggatttctccggactgtcaccgtatgaacgcaagcgcttaaaaaatatctcggagaatgctgatttctttgcctcactccagctgtccgagtcagcagccagactccgagaaatgatcgagaagagacaaccacccaagagtaagcgcaagaaaccaaagcgtgaaaatggaatcggctgccgtcgttccatgcgcttgcttaaggtggatccaagcggtgtttctctgccggctgcacctacaccccctacgctggtggcagatgagactcctctgctcccaccaggcccacttgagatgacaagcgaaaatcaggaggataacaacgagagattcaaggggttcctgcatacatgggctggaatgtcaaagcctagctccaagaacactgagaagggcttatctagtattaagtcctataaggccaatcttaacggcatggttattagcgaggatacagtctacaaggttactaccggaccaatttttagcatggcgctgcacccatccgaaacccggaccttggtggcggttggggcaaagtttgggcaagttggcttgtgtgacctgacccagcagcccaaagaggacggagtttacgtgtttcatccccacagccagcccgtgagctgcctatattttagtcccgctaaccccgctcatatcctctcattgagctatgatgggaccctccgatgcggtgattttagccgggcaatttttgaagaagtgtaccggaatgaaagaagcagcttcagttccttcgacttcctggccgaggatgcctccacactcattgtagggcactgggatggaaacatgtctcttgtggaccgccgtactcctggcacatcatacgagaagctaacctccagctccatgggcaagatccgcaccgtacacgtgcatcctgttcatcgccagtatttcatcacggccggtctgagagacacccatatatacgatgccaggcgacttaattcaagaaggagtcagccgctgatctcattgactgaacataccaaaagcatcgcaagtgcttactttagccctcttaccggcaaccgcgtggttacaacctgtgcggattgtaatttgagaattttcgacagtagctgcatctcctctaaaatccctctactgaccaccatacgacacaatacttttactggaagatggttaacgcgcttccaggctatgtgggatccaaagcaagaagactgcgtgatcgtcgggtccatggcccatcctagacgggttgagatattccacgagaccgggaagagggtgcacagtttcggaggggagtatctggtgtccgtgtgtagcattaacgccatgcatcctactagatacattctggctgggggaaactcttcgggaaagattcacgtcttcatgaatgagaagtcttgttag

SEQ ID NO: 61150 - DNA, 1638 bp, Artificial Sequence
  Description of Artificial Sequence: Synthetic coding sequence
atgacaccagggaagcatagtggagcctctgccagagcagccaacgggggtgcgtggggctatcgtgactttcgcggaggacagaagaaagggtggtgtaccactcctcagctcgtggccacaatgcctgtgtctcctgcaggatcccataagcagcagaattttggactgaacaacgccactcagcctaaaaaaagcattagttttttcgctaccatgaaggcgacaagtgtcaagggctacactggggctaaccagtctcggatggctgtgagcaagactgtcctgatacccccagaactgaagactgtggaaaagcccaaccctaacatcaaaacgacacaggtcttcgatattaatggtactgacgttacccctcggccactctatcatccagaccccctcaccggtaccgcgaagccttcaaaattactgacctctcaggagggcagccttggaagcgagtttattagctcttatagtctgtatcaaaacacaatcaatccttccacccttggtcaattcacacgcagcgtcctcggatcttctactgtgagcaagagttccgtcagcgcttcagaatccatcgccgaggaccttgaggagccctcctacaagagagagagactcaccagctttaccgatctccaagtgattagagcagccccagaaaagatcgtaactaaagaggatttggaaaaaaatatcgaaatcatcctgacagaaacagagacccttaggttttttgatctgccaactgtaatggtgtctgtggaatcagaggaagcagagaaagtgacgcagcgtaataaaaactatgaagtgctctgtagaaacaggttggggaatgacctctacgtggaaaggatgatgcagacattcaacggcgctcctaaaaacaaggatgttcagtgtgacaagattattatggaagacaagggaattatgtctaccgcgtgggatctgtacgactcatacaatgctatggagttggtcagtcttagcgttaagcagtccgtagttgagtcctcctcgaaggcaaacgtgcttccaaaagaccaagatcagcgcctgcccggatcaacaacagagaagaactcagagaccagtagtctgatggatatcgagaatgtgattctggcaaagatccatgaggatgaagaggatcattccgatgccatactgaagtccgataagtttcaccaggatctcttctttatggaacgcgtgcttatggaaaacatttttcagcccaagcttgccgcatatcggcagctgccagtgctgaaagagccggaacctgaggagcccgaggacgtcttagaaagtgctaagcatgaagaagtggaggaggagtctaagaaagaagaggaggaggaaattcatgccgaagagtcaacaattcccgcaaatttggaacggttatggtcattttcgtgtgacctcacgaagggattaaatgtctcctccttagcttggaacaagacaaacccagatctgcttgcggtaggctacggacattttgggtttaaggaacagaaacggggtttggcatgttgctggtccattaaaaatccgatggtgactcagacgagaatacgcagcatttttatctggctgctaacaaagttctcgtag

SEQ ID NO: 61151 - DNA, 2547 bp, Artificial Sequence
  Description of Artificial Sequence: Synthetic coding sequence
atgactccaggcaaacacagtggagcctctgctcgcgctgccaatgggggagcatggggataccgtgattttcgcggtggccagaagaaaggttggtgcaccactccccagctcgtggcgacaatgcctgtaagccctgctggaagccacaagcagcaaaacttcggccttaataatgccacacaacccaagaagtccatatctttctttgctactatgaaagccaccagtgtgaaaggttatacaggcgctaatcagtcgaggatggctgtcagcaagaccgtgcttattcctcctgagctcaaaaccgtcgaaaagccaaatccgaatatcaaaaccacccaggtctttgacatcaatgggactgatgtgacaccacgcccactctaccaccctgatccactgactggaaccgctaagcctagtaaactactgacctctcaggaaggaagcctcggttctgaatttatcagctcttattctctgtatcagaataccatcaatccatccactctagggcagtttacccggtctgtgttaggatcttcgactgtcagcaaatccagcgtcagcgctagcgagtccattgccgaagatttagaagagccatcatataaaagggagcggctcacaagcttcaccgatctccaggtcattcgcgctgctccggagaagatcgtgacaaaagaggatctggagaagaatatcgagataattctaaccgagaccgagaccctgcggttcttcgatttgcccacagtcatggtatctgtggagtccgaagaagcagaaaaagtaacccagcggaataaaaactatgaagtactctgtcgcaatcgattggggaatgatttatatgttgagcgcatgatgcagacatttaatggcgctcctaagaacaaagacgtacagtgcgataagattattatggaggataaggggatcatgtccaccgcctgggatttgtacgactcttataacgcaatggagcttgtttcgctgtctgtaaagcagtctgtggtggagtcgagctctaaggcaaacgttctccctaaagatcaggaccaaaggctgcctggtagtaccacggaaaaaaattccgaaacttccagtctgatggatatcgagaatgttattctggccaagattcatgaagatgaggaagatcacagtgatgcgatcttgaagtcagacaagttccatcaagatctcttctttatggagagagtgctgatggagaatatcttccaacctaaactcgccgcatatagacagttaccagttctcaaggagccggagccagaagaaccagaggacgtgctggaatcagctaagcacgaggaagtcgaggaagagtctaagaaggaagaggaagaagagatccacgccgaagaatccactatcccagctaatctcgaacggttgtggtctttctcatgtgatctgacgaaaggattaaatgtcagttcacttgcatggaacaaaaccaatccagacctgctggccgtggggtatggccatttcgggtttaaggagcaaaagcggggacttgcttgctgctggagcattaaaaatccgatgtggcctgaaaggatctatcaatctccctacggcgtgactgccgttgatttttctataggagctcctaatctcttggcagtcgggtatcataatggaacaattgccatctacaacgtgcgatccaactcgaatgtgcccgtgctggatagcagcgaatccccacagaagcatctagggcctgtctggcaactgcagtggatcgagcaggaccgaggaaccactggggatggaaaacgtgagatcctggtgtccatttccgctgacggacgaatttccaagtgggtaattcgtaagggcctggactgttatgacctgatgagactcaagcggacaaccgcggcttccaataagaaggggggtgagaaagaaaaaaaagatgaggccctgatttcacgtcaagccccaggtatgtgttttgcctttcaccctaaggacactaatatatacctcgccggaaccgaggaagggcacattcataagtgctcttgcagctataacgagcagtacctggacacatacaggggacacaaggggccagtttataaagtgacctggaatcccttttgtcatgatgtgttccttagttgtagcgctgactggggtgtgattatctggcagcaggagaacgtgaagccctctttgtctttctaccctgccacttctgtggtctatgacgtcgcctggtcacctaagagcagctacatcttcgccgctgcaaacgaaaaccgggtggaaatatgggacttgcacatctctactctggaccctctgatcgtgaataccgcaaacccaggaatcaaattcactaccattctgtttgccaaacagactgactgcctgcttgtgggcgatagcgatggtcaggtttcagtgtatgaactgaggaacatgcccaccgttctggagaccggccgaggagatatcatggacacccttctcggctccaagtctaaccaaagtgcttag

SEQ ID NO: 61152 - DNA, 1686 bp, Artificial Sequence
  Description of Artificial Sequence: Synthetic coding sequence
atggtgagtgtggagtcggaagaggctgagaaagtgacccagcgaaacaagaattacgaggtgctgtgtagaaaccgactaggcaacgatctctatgtcgagcgaatgatgcagactttcaacggcgcacctaagaataaagacgtacagtgcgacaagatcattatggaggataagggcattatgtccaccgcttgggacctatacgattcatacaacgccatggaattagtgtctcttagcgtcaaacagtcggtggttgaaagctctagcaaggcaaacgttttacccaaggatcaggaccagcggttgcccggatcgacgacagaaaaaaacagcgagacctcctctctgatggacatcgaaaacgttatactggcaaagattcacgaagatgaagaagatcatagcgatgcaatcctcaagtccgacaagtttcatcaggatctcttctttatggagagggtcctgatggagaacattttccagcccaaactggcggcatataggcagctacccgtcctgaaggaacccgagcccgaagagcccgaggatgtgttagagagtgctaaacacgaggaggtcgaggaggagagcaaaaaggaggaggaagaggagattcacgctgaagaaagtaccattcccgcaaatctcgagaggctgtggtctttcagctgcgaccttaccaagggtctcaacgtaagctccctggcttggaacaaaacgaaccccgatctgctcgcagttggctatggccattttgggttcaaagaacagaaacgaggcctcgcatgctgctggtcgatcaagaaccccatgtggccagagcgaatatatcagagcccctacggcgtaaccgctgtcgacttcagcataggagcgcctaacctgctggcggtgggttatcacaatggcacaatagcaatctataacgtccggagcaacagtaacgtccccgttttggacagtagcgaatccccacagaaacatctcggtcctgtatggcagctacagtggatcgaacaagatagaggcaccaccggggatggcaaaagagaaattcttgtgtctatttctgccgacgggaggatcagcaagtgggtcatccggaaagggcttgactgctacgatctgatgcgactgaagcgaacaaccgcagcctctaataagaagggcggagagaaagagaaaaaagatgaggctcttatcagcaggcaggcaccagggatgtgttttgcattccacccaaagggccctgtatacaaagtcacttggaatccgttctgccacgatgtgttcctcagttgctccgccgactggggcgtcattatttggcagcaggaaaacgtgaagcctagcctgagtttttatcccgctacctccgtggtgtacgatgttgcctggagccccaagtcaagttatatttttgcagcggctaacgaaaacagagtcgaaatctgggatctgcacatctccacgctggaccctttaatcgtgaatacagccaacccaggcattaagtttacgactatactgttcgccaagcaaacggactgcctccttgtgggcgattctgatggccaggtgtcagtgtatgagctgaggaatatgcctaccgttctggagacaggaaggggcgacatcatggacacattgcttggaagcaaatccaatcaaagtgcctag

SEQ ID NO: 61153 - DNA, 2673 bp, Artificial Sequence
  Description of Artificial Sequence: Synthetic coding sequence
atggatggggagccgccagcatcgagcgggcttggcttgccagattatacatccggtgtttctttccacgatcaggccgatctgccggagaccgaggatttccaggccggactctacgtaacggaatcaccacagcctcaagaagcagaggccgtgtccctggggcgtctctccgataagtcaagcacatccgaaacctctctgggggaggagagggcacccgacgaaggtggagcccctgtggataaaagttcactgcgatctggcgactcatctcaggacctgaaacagagtgaagggtctgaagaagaggaggaagaggaggactcctgtgtagttttggaggaggaggaaggcgagcaggaggaggtcacaggcgcaagtgagctaacattgagcgatactgtgctaagcatggagacagtcgtagcaggagggagcggtggggacggagaggaggaagaagaggctctccccgaacagtccgagggaaaagaacagaagattcttctggatacagcttgcaagatggttcggtggttaagcgcgaaattaggaccaaccgtcgcatccagacacgtggccaggaatctgctgcgccttctcacttcgtgttatgtgggacccacacggcagcagttcaccgtctccagcggggaatccccacctctctcagcgggtaacatataccagaagaggccagtcctcggcgatatcgtcagcggccctgttctgtcctgccttctccacatcgctcgtctgtacggggaaccggtgctgacgtaccagtacctgccttatatctcctacttggtcgcccctggctctgcgagcggaccctctagattgaattcgaggaaagaggccggtcttctggctgctgtgacattaacacagaagattatcgtatatttgtctgataccacactcatggacattctgccacggatcagccatgaagttctgctgccagtactaagtttcctgacgtcactggttactggctttccgtcaggagctcaggccaggacaattttgtgcgttaaaacaataagtctcatagctcttatctgcctgagaatcggacaggagatggtgcagcagcacctgtccgagcccgtggcaaccttctttcaggtgttctcccagttgcacgaactccgacagcaagacttgaaactggaccctgctggaagaggggaggggcagctcccacaggtagtgttctctgatgggcaacagcgacctgtggatccggcactccttgatgagctgcagaaggtgttcacactggaaatggcctacacgatttacgtgcccttttcatgtttgctcggggatatcatcaggaagatcattccgaaccacgaactggtcggcgagctcgcagcactgtacctggagtcgatctctcccagttcccgcaatccagcgagcgttgaacctaccatgccagggaccggtccggaatgggacccccatgggggaggatgtcctcaggatgacggccactccggcacttttgggagtgtgctcgtcggaaacagaatacagatacctaacgattccaggccagaaaaccctggtcccctggggcctatatctggggtcggcggaggaggcctagggagcggttcagatgataacgccctgaagcaggagctgcctagaagcgttcacggcctgagcgggaattggcttgcttattggcagtacgagatcggtgtgtcccagcaggacgcacacttccatttccaccagattagactgcagtcatttccagggcacagcggggctgtgaaatgcgtcgcacctctgagcagtgaggatttctttctcagcggttcgaaagatcgcaccgtcagattgtggccgctgtacaactacggagacgggaccagcgagacagcacccaggctcgtctacactcagcacagaaagtcagtcttcttcgtcgggcagctcgaggctcctcaacacgttgttagctgtgacggggctgtgcacgtctgggatcccttcactggcaaaacgttacgcactgttgagccattagattctcgggtgccactgacggcggtggcagtaatgcccgctcctcacacctcaatcacaatggcaagctcagactctacccttcgctttgttgattgccgcaagcccggactgcagcatgagtttcggttgggtggcggtcttaatccaggacttgtgcgggctctcgctataagtccatccggacggagtgtggtcgccggattttcctctggcttcatggtactgctcgacacaagaactggcctggtgttgcggggatggccagcccacgaaggggatatactgcagatcaaggctgtcgaaggcagtgtgttagtgtcgtccagctccgaccacagcctcaccgtttggaaagagctggagcagaagccgacccatcactataaaagcgccagcgaccctatccatacttttgatttgtatgggagtgaggttgtcacaggcaccgtcagcaacaaaataggggtgtgctcactgttggaacccccaagccaggctactacaaagctgtcaagtgagaacttccgcggaacgctcaccagtctggcattattgcctactaagagacaccttctccttggttccgataacggagtgatccgcctgctggcatag

SEQ ID NO: 61154 - DNA, 2079 bp, Artificial Sequence
  Description of Artificial Sequence: Synthetic coding sequence
atggatggtgagccgcctgcttccagcggcctcgggttaccagactatacctcaggcgtgtcttttcacgaccaggctgacctcccagaaaccgaagactttcaagcaggactgtatgttaccgaatccccgcaaccccaggaggcagaagcagtcagtctgggtcggctgtccgacaaatcctccacgtaccagtatcttccttacatcagctatctggtagctcccggatctgcatctggacctagccgactgaatagccgcaaggaggccggactgctagccgcagtaacattgactcagaagataatcgtgtatctctctgacactactctgatggatatactacctcggattagccatgaggtcttgctgccagtattaagcttcctgacctccctggtgactggttttccctccggggcacaagcacgtaccattctatgtgtcaagactatctcactgatagccctcatttgcttgcgaataggccaagagatggtgcagcagcacctttcagaacccgtcgctacattctttcaggtgttcagccaactccacgagcttcggcagcaggatcttaagctggatcccgcaggcaggggggagggacagctgcctcaagtagttttcagcgatggccaacaacgtcctgtggatcccgcacttttggatgagctgcagaaggtctttaccctggaaatggcttatactatttatgtccccttttcgtgcttactaggggacatcattcgaaaaatcataccgaaccacgagctcgtgggtgaactggctgcgctctatctcgaaagcatatctccgtcatctcgaaatcctgcgagtgttgaacctaccatgcctggaaccgggccagagtgggaccctcacgggggaggctgtccacaggatgatggtcatagcggcacgtttgggtccgtcctcgtggggaatcggatacaaatccccaacgactctcgcccagagaaccctggaccgctcggtcccatatcaggcgtgggcggaggagggctggggtccggctcagatgacaacgcgctcaagcaggaactcccccgttccgtgcatggattgagtgggaattggctggcatattggcagtatgagataggcgtttctcagcaggatgctcattttcattttcaccagatcagattacagtcctttcccggtcacagtggcgctgtaaaatgcgtggctcctctctcttctgaggacttcttcctgtctggcagtaaagatcggactgtgcgattatggcctttgtacaattacggtgacgggacttccgagaccgccccacggctggtgtatacccagcacagaaagtctgttttctttgtcggacagctagaggcgccacagcacgtggtctcttgcgatggcgctgtacacgtttgggaccccttcaccggaaaaacactgcgcacagtggagcccctggattcaagagtgcccctcacagctgtggcagtgatgcccgctcctcatacatccatcacaatggcttcaagcgactccactctgaggttcgtagattgccgaaaaccgggactgcagcatgagtttcgcctcgggggagggctaaatcccggtctggtgcgagcactggccatcagcccgtcagggagaagcgtggtggccggttttagcagtggcttcatggtgctgctcgacacccggactgggcttgttttgaggggatggccagcgcacgaaggagacattttgcagattaaggccgtggagggctcggttttggtcagcagctcctctgatcattccctgacggtttggaaggagctggagcagaagcccacccatcattataaatccgcttcagaccccatccacaccttcgacctctacggtagtgaggtcgtgaccggtactgtctcaaataagattggcgtgtgtagcctgttagaacctccgagtcaggccacaacaaaattgtccagcgaaaattttagaggaacactgacctcgctcgcccttcttcccaccaagcggcatttactactgggttccgacaatggcgttatccgcttgttagcctag

SEQ ID NO: 61155 - DNA, 2217 bp, Artificial Sequence
  Description of Artificial Sequence: Synthetic coding sequence
atgctcgtaagagtagtcttaagcctgaccccatcatttcccgaaccatcagccctctacaccgcttgtaagatggtcaggtggctgagcgccaagctgggcccaacagttgcctcccgccacgttgcacggaacctgctgcggctactgacaagctgttacgtgggccctacaagacagcaattcaccgtaagtagcggagagtccccacccttatctgcaggcaacatatatcagaagcgacctgttctgggcgacatcgtgtccggccctgtcctgtcctgcctactgcacattgctcgcctttatggtgagcccgtattgacgtaccagtatcttccgtacatctcttatttggttgccccaggcagcgcatcgggccctagccgactgaatagtaggaaggaagcaggactattggcagctgttactctgacacagaagattatcgtatacttgtccgacacaactctgatggacattctcccgcgaatttcccacgaggtactcctgccggttctgagtttcttgacgagtcttgtgactggattcccaagtggggcacaagcccgaacgatactgtgtgtgaagacgattagcttgatcgctctgatatgtcttaggatcgggcaggagatggtgcagcagcacctgagcgagccagtggcgacattcttccaagttttctcccagctccatgaactgaggcagcaggacctgaaactcgacccagctgggcgtggggaaggacagttgccacaggtggtgttctctgacggtcaacaacggcctgtggatcccgctcttctggatgagttacaaaaggtatttacgctcgagatggcttacacaatttacgtgcccttctcctgcctgcttggggatatcattaggaaaataatcccaaatcacgagctagtcggtgagttggccgctctgtacctggaatccattagtccaagcagcagaaatcccgcatcagtcgagcctaccatgcccggtactgggcctgaatgggatccacatggaggagggtgtcctcaggatgacggtcatagcggaacttttggatccgtattggttggaaaccggattcagatccctaacgactcacggccagagaaccctggaccactggggccaatttcaggggttggtggaggtggactgggttccggctccgatgataacgcacttaagcaggagcttcctcgctctgtccacgggctcagcggcaactggctcgcctattggcaatacgagatcggagtctcccaacaggatgctcactttcacttccaccaaattcgcttgcagtccttcccagggcactcaggggcagtcaagtgtgtggcacctctgtcctccgaagatttttttcttagcggaagcaaggatcggactgttagactctggcctctgtacaactacggagacggaacttcggagacagcgccacgactggtgtacacacagcatagaaaatctgtcttttttgttgggcagctagaagctccacagcacgtggtcagctgcgatggagctgttcatgtctgggacccttttaccgggaaaacgctcaggactgtcgagcctcttgactcgagggtaccactgaccgctgtggctgtgatgccagccccacacacttcgattaccatggcttcctctgatagcactctcagatttgtcgactgtagaaagccgggtctgcagcatgaattcagactggggggtgggctcaaccccggtttggtccgtgcccttgcaatcagcccctccggaagaagtgtcgtcgccggattcagctccggatttatggtgttgctggacactcgtactggactggttctccggggttggccggcacacgagggtgatattctgcaaatcaaggccgtggaaggttctgtgttggtgtcaagttcttcagaccacagccttacagtgtggaaagaactcgagcagaaacctacccaccattacaaaagcgcgagcgatccaatccacacttttgatctgtatggaagtgaggtggtaactggcaccgtgtccaataaaattggtgtatgctcacttctggaacccccttcccaagcaacgaccaaattgtcctctgaaaattttagaggcacactgaccagcctagccctcttacctacaaagaggcacctgctgctggggtctgacaacggggtaataaggctccttgcatag

SEQ ID NO: 61156 - DNA, 1719 bp, Artificial Sequence
  Description of Artificial Sequence: Synthetic coding sequence
atgggtagcctaagcagtcccacatccacctgtcccacctccgccacgtggtttccttccggcgctcaggcccgtacaatactctgtgtcaagactatctcactgattgccctgatatgtctccgcatcggccaagaaatggtgcagcagcatctgagcgagcctgtggccacattttttcaggtgttcagccagctgcatgaattgcggcagcaggatcttaagttagatcccgctggacgcggtgagggtcagttaccacaagtggttttcagcgatggacagcagcgaccggtggatcccgcactcctggacgaattacagaaggtgttcactctcgagatggcctatacaatctatgtccctttctcctgccttctgggcgacatcatacgaaaaataatccccaaccatgaattagtcggagaactggctgccttatatctggagagtatcagcccctcttcccggaaccctgcctctgttgagcctactatgcccggtacaggacctgagtgggatccacacggtggtggctgtccacaggacgacggccatagcggcacttttggctctgtccttgtggggaaccgcattcagatccccaatgacagccggcctgaaaatccgggtcccctgggcccaatcagcggagtagggggagggggactaggttctggttccgatgacaatgccctcaagcaggagctgcccaggtccgtgcatggtctctccggtaattggctagcatattggcaatatgaaattggagtgtctcagcaggacgctcactttcattttcaccagattagactgcagtcatttccgggacatagtggcgcagttaagtgtgtggccccactgagctcagaggatttttttctttcgggaagtaaagaccggacagtgcgactttggccactgtataattatggcgacggtacaagcgagactgcaccccgattagtatatactcagcatcgcaaatcggtatttttcgtgggacaactggaagcaccacaacacgtagtctcatgtgatggggctgtgcatgtgtgggatccatttaccggaaaaacactgagaaccgtagaacctctggacagcagagtgcctttaaccgccgtcgccgtgatgcctgcaccacatacatccatcactatggcctctagcgacagtacactgagattcgttgactgccggaaaccagggctccaacacgagtttcgcctaggcggaggactgaacccaggactcgttagggccctcgctataagtccctctggcaggtctgtggttgcaggattttcttctggctttatggtgctcttggacacccggacagggctggtgctgagaggttggccagcacacgagggagatattctgcaaatcaaagccgttgagggcagcgtgctggtaagttcttcttcggaccactccctcacagtgtggaaagagttagaacagaagcccacccaccattacaagagtgctagtgaccctatacatacattcgacctgtatggtagtgaagtagtcaccgggacagtttctaataaaataggcgtttgctctttattagagcctcctagccaggcaacaaccaagttgtcttctgagaacttccgaggaacgctgacaagcctggccctgcttcctaccaagcgacacctgctgctcgggagtgacaacggggttatccgtcttctggcctag

SEQ ID NO: 61157 - DNA, 5825 bp, Artificial Sequence
  Description of Artificial Sequence: Synthetic coding sequence
atggcacagggaagtggcggtagagagggcgctctgcgaactcctgccggaggttggcattcacctccctcgccagatatgcaggaactcctcaggagcgtcgagagagacctgagtattgatccacggcagttagctccagccccaggaggaactcacgtggtcgccctagtgccggctagatggctcgcttctctgcgtgatcggaggctgcctctcggaccctgccctcgtgccgaaggtctcggggaggcagaagtccggacgctgctgcaaagatctgtccaacgtctacctgcaggctggactcgcgttgaagtgcacggcttgcggaagcgtcgtttatcatatcccttgggtggcggactaccctttgaggatggctcttgtggaccagaaaccctgacacgatttatgcaagaagtggccgctcagaattacaggaatctttggcggcatgcttatcacacatacggccagccttacagccacagcccagcccctagtgctgttcccgcactggacagtgtgcggcaagccctgcagcgagtctatgggtgttcttttcttcctgtcggggaaacaacccagtgtccatcgtacgcacgcgagggcccttgcccacctagagggagccccgcttgtccgtcgctgctccgagcagaagctctgctagaaagtccagagatgctgtacgtcgtacacccatacgttcagttcagcctgcatgacgttgtcacatttagtcccgctaagcttaccaactcccaggctaaggtacttttcatcctgttccgggtgctgagggctatggacgcttgtcaccgacaggggttagcatgtggggcactcagcctgtaccatatagcggtggatgaaaaactctgcagtgaattgcggctggatctcagtgcgtacgagcgacctgaggaggacgagaatgaggaggcccctgtggccagagatgaggctgggatcgtgtcgcaggaagaacagggcggacaaccaggccagcccactggacaagaagagctcaggtcccttgtgctagactgggtgcacgggcgaatctccaatttccattacctgatgcaacttaatcgcctggctggccgaagacagggtgaccccaattatcatcccgttctgccgtgggtcgtagatttcacaaccccccatggtaggttcagggaccttcggaaaagcaagttccgtctgaataagggcgacaagcagcttgatttcacatatgagatgacaaggcaggcctttgtagcaggaggcgcaggtggtggcgaaccaccccacgtaccacaccatatatcagacgtgctctctgatattacttactacgtctacaaagcacgacgaacccctcgcagcgtactctgcgggcacgtccgcgctcagtgggagccacatgaatatccggctagcatggaaagaatgcagaactggaccccggatgaatgcatcccggagttctatacggatccgagtatctttagatccatccacccggacatgcctgacttggacgtaccggcttggtgttcctcgagtcaggagtttgttgctgctcaccgggctttgttggaatcccgagaggtaagccgtgacctgcatcactggatagatcttacctttgggtataagctgcagggaaaagaagctgtgaaggaaaagaacgtgtgcctgcacttggttgatgctcacacacatcttgcgagttatggcgttgttcaattgtttgaccagccccacccgcagaggctggcaggtgcgccagctttagctccggaaccccctctcattcccaagttgcttgtccagacaatacaggagaccacaggaagggaggatttcaccgaaaatccaggacaactgcctaacggcgtgggcagacccgtgcttgaggccaccccttgtgaagcttcctggacaagggaccgcccagtggcaggagaggatgatcttgaacaggctacagaggccctggactctatcagccttgctggcaaagccggagatcagttgggatcaagctcacaagcttctccaggcttgctcagcttttcagtcgcatctgcctccagaccaggtagaagaaataaggctgcgggtgctgacccgggtgaaggagaggaaggtcgtatcctgctgcctgaaggatttaaccccatgcaggccctggaagaactggagaagaccggtaacttcttagctaaaggccttgggggtctgctggaggtgccagagcagccccgagtgcagccagcagtacctctgcaatgcctgctccacagggacatgcaggccttgggcgtgctgttggcagaaatggtcttcgcaacacgggtgcggactctgcagccagacgcgccattgtgggtgcgtttccaggcggtccggggactgtgcacgcgccaccctaaggaggttcccgtgtccctacagccagtgttggacaccctgttacaaatgtccgggccagaggtacctatgggggcagaaaggggcaaattggatcagctcttcgaatacaggcctgtaagtcagggtttgccacccccatgccctagtcagctgctttcgccatttagttcagtcgtgcctttccctccatacttccccgcactccacagattcatcctgctgtatcaggcgcgaagagtggaagacgaggcccaagggcgagaactggtgttcgccctgtggcagcagctcggcgctgtgttgaaggacattaccccggagggcctcgaaattctgctcccctttgtgctttccctaatgtcagaagagcacacggccgtctacaccgcctggtacctctttgagcctgtagcgaaagcactgggccctaaaaatgcaaataagtacctgctaaagccactgatcggcgcatatgagagcccttgtcagctgcacggcagattttacttgtataccgactgcttcgtcgcccagctgatggtgagactcggactccaggcctttctgacccacctgctgccacacgtcctgcaggtcttagcaggcgcagaagcctcacaagaagaaagcaaggatctggctggggctgcggaagaggaggagtcagggttgccaggggcaggcccaggcagttgcgccttcggggaggagatccctatggacggcgagcctccggcaagtagtggcctagggctgcccgattacacatcgggcgtgtcgtttcacgaccaggcagatctgcctgaaactgaggattttcaagccggtctgtacgtgacagagtcaccacagcctcaggaggcagaggccgtctcactgggtcgcctcagcgacaaaagctccacatcagaaacttccttgggcgaagaacgagcgcctgatgaggggggagctccagtagacaagagctcattgaggagcggggatagctcccaggacctcaagcaaagtgaagggtccgaggaggaagaggaagaggaggactcctgtgtcgtgctggaagaggaggaaggggagcaggaggaggtgacaggggcttccgagctgactctgagcgataccgtcctttctatggaaacagtagttgctgggggatcaggaggggatggcgaggaggaagaggaagctctgccagagcaaagcgaaggaaaggagcagaagattctgctggatacagcttgtaaaatggtgagatggttatctgccaagctgggacctacagtggcgagtcggcacgtagccagaaacttgctgaggctcctcacgtcttgttatgtagggccaacacgccagcagttcacggtctcaagtggcgagtcacccccactgagcgccggtaacatttatcagaaacgaccagtgttaggagacattgtgtcaggccctgtgctgtcatgcctgttgcatatcgccagattgtatggagagccagtgctcacctatcagtatctgccatatatttcttacctcgtggctcctggcagcgcttctgggccaagcaggttgaactcccgcaaggaagcaggcttgctggccgcagtgaccctgacccagaagatcattgtgtacctttcagacacgaccttaatggatatacttccaaggatctcacatgaagtattactgcctgtgttgtcttttttaacgtccctcgtgacgggcttccctagcggggcacaggctagaacgatcctatgcgtcaaaactatcagcctaattgctctaatctgcctgaggatcggacaagagatggtgcaacagcacctgtcagagcctgtcgctacgttctttcaggtgttctcccagcttcacgaactcaggcagcaggatctaaagctggacccagctggacgaggggaagggcaactgccgcaggtggtttttagcgatggtcaacagaggcccgtcgatcccgctttgctggacgagctgcaaaaggtgtttacactggagatggcctacaccatctacgttccattcagctgcttgctgggagatataatccgaaaaatcattcctaaccacgaactggtcggcgagctggccgcactttacctagagtcaatatccccaagttctaggaacccggcttctgtggaacccaccatgccaggcacaggccctgaatgggacccccatggcggtgggtgccctcaagatgatggccactcggggactttcgggagcgtactggtgggcaacaggattcaaattcctaacgactccaggcctgaaaatcctggtccactcggacctatctctggcgtcggcggtggaggcttgggtagtgggagtgacgacaacgccttaaagcaggaactgccaaggtctgtgcacggcctatctggaaactggttggcttactggcagtacgagatcggagtgagtcaacaggacgcgcactttcacttccaccagattaggctgcagagctttcctggtcattccggcgcagtgaaatgcgtggctcccctctcgagtgaagattttttcctgtctggtagtaaggataggactgtccggctctggcccctgtacaactacggggacggcaccagtgaaaccgcgcctcgtctggtctatacacaacaccggaaatctgtgttttttgtaggccaactcgaggctccgcagcacgtagtgagttgcgacggtgctgtccatgtatgggatccatttacgggcaagacactccgaaccgtggagcccttggatagccgggttcccctaacagctgtagctgttatgccagcaccccatacctcaatcacaatggcgtcgtctgactcgacactccggttcgtcgattgtcgcaagcctggactccagcacgagtttcgcctaggaggcggtctcaaccccggactggtgcgcgcactagccatttcccctagcggcagaagtgtcgtggccggattctcgtccggcttcatggttcttttggacactcggacaggactggtccttcgcggatggccagcccacgagggtgacatcctgcagatcaaggccgttgaagggtctgtgctagtgtccagttccagtgaccacagtctcactgtatggaaggagctcgagcagaaacccacgcatcactacaagtccgcctcagatcctatccatacgtttgatctgtacggctctgaagtggtgacaggtacggtgtctaacaaaattggggtgtgtagcctcctcgagccgccttcccaggctacgacgaagcttagctccgaaaacttcaggggcacgctgacatctttagccctactgccgactaaacgccatctactcctgggaagcgacaatggcgtgatccggctgctcgcata

SEQ ID NO: 61158 - DNA, 2145 bp, Artificial Sequence
  Description of Artificial Sequence: Synthetic coding sequence
atggtgcgctggctttctgctaagctgggccctaccgtggccagcagacatgtggcgaggaacctgctgcgcctactcacatcttgctatgtaggcccaacaaggcagcagtttactgtttctagcggggagtcccccccactgagtgccggtaatatttaccagaagaggccagtacttggggacattgtgtccggacccgttctttcctgcctcctgcacatagcccgattgtatggcgagcctgtccttacctaccagtatctgccctatattagctacttagtggccccagggagtgcaagcggcccttcgcggctgaattcgagaaaagaggctggattgttggctgctgtgaccctgacgcagaagatcattgtctatctctccgacacgacactgatggacattctgcccagaatatctcacgaagtgttactccccgtgttgtcattcctgacctctctcgtcaccggcttcccttctggcgcacaggcacgtactatcctttgcgtgaaaacaatatcactcatcgcactcatttgccttcgtattggacaggaaatggttcagcagcatctaagtgaacctgtagccacattcttccaggtcttctcccagctacatgagctgcgtcagcaagacctcaaacttgacccagctggccgaggggaaggacagctgccacaggttgttttttcagatggccagcagagaccggtcgaccctgccctgctcgacgaactgcagaaggtattcactcttgagatggcctacacaatttatgtacctttctcctgcctcctgggggatatcatcagaaaaatcattccaaatcatgaacttgtgggagaattagccgcactctacttggagtcaatttcaccctccagccggaaccccgcatcagtggaacccacaatgccgggtaccgggccagagtgggatccacatggcggaggctgccctcaagatgatgggcacagcgggacgttcggctctgtgctcgtggggaatagaatccagatccctaacgacagccgtcccgagaaccccggacccctggggcctatttccggcgtcggtggcggaggtctcgggagtgggagcgacgacaatgccttgaagcaggaactgcccaggagcgtccacggcctctccggtaattggttggcttattggcagtatgagattggcgtctcgcagcaggatgcacacttccacttccatcagatcagattacaaagttttcctggccactccggggctgtaaaatgcgtcgcccctctctcctcagaggacttctttctttctggttccaaagaccgcaccgtgcggctgtggcccctgtacaattatggcgatggtacaagcgaaactgctccaagactggtgtacacacagcatcgcaagtccgtcttctttgtcggacagttggaggccccacaacacgtggtgtcttgtgacggtgcagtgcatgtgtgggatccctttacaggcaaaacactgagaacagttgaacctctggactctagagtaccgctgaccgctgttgcagtcatgccagcgccacatacatctatcactatggccagcagcgattcaaccctgagatttgtggattgtcgcaagcccggactccaacatgaatttcgacttggaggtggtctcaatcctggactcgtgagggccctggcaatttcaccaagtgggcgatctgtcgttgcgggttttagttcaggtttcatggttctgttggacaccagaacagggctagtgctgcggggatggcctgctcacgagggtgatatcctccagatcaaggcagtggagggtagcgtgttagtaagttcatccagcgatcactctttgactgtgtggaaagaactggagcagaaacctacacatcattacaaatctgcaagtgatccaatccatacctttgatctgtatggcagcgaggtggttacaggaacagtgtcaaataagatcggggtgtgtagcctgttggagcccccatcccaggccaccacaaaactttcaagtgagaacttccgaggcaccctcaccagtctcgcattactccccactaagaggcacctgctgctgggcagcgacaacggcgtgatccgactgctagcctag

SEQ ID NO: 61159 - DNA, 834 bp, Artificial Sequence
  Description of Artificial Sequence: Synthetic coding sequence
atgtctcgagagttcagaggacaccggaactgcgttctgacactggcttactccgctccatgggatctgcccagtacgccatgtgccgaggaagccgcagcagggggactcctggtgacagggtctactgatggcaccgcaaaggtatggcaagtggcctcgggatgctgtcaccagacattgaggggtcatactggtgcggtgttgtgtttggtgctagacactcccggacacacagcctttacaggttcaacggacgccaccatcagagcttgggacatcctgagtggcgagcagcttagagtgttccgtgaacaccggggatctgtgatttgtctggagtgtagtagagccgctggaacattagcaccgggaccctccacaaggtcgctcgagtcatgtggcggttgtagcggcgctacccactcttcttcgaccgcttcacgatgtacagccagatgctcaacgccccctcgcaccaccgccccatgtgccagcggtacctgcgctggaagtgaggtgccccgtggcccactgcggccatgtgccgcttcgaggggctcgtccgctacccgttgggcagctccgcctaggccttgttctaggcccgacccggctggaccactgcaaacacccgctcagactccctctggcagccagtcggcacctccttgttacccacggtggtggaggccaatggctggagaaggaagaggggctagaaagcctggccgagaagaatccccatctcaggcctcgggcttctccctcgtggctcgcaggcgctgggagagagaatgtagtccctggggtcctccaccttttcccttttag

SEQ ID NO: 61160 - DNA, 1131 bp, Artificial Sequence
  Description of Artificial Sequence: Synthetic coding sequence
atgggcggaggagggtccgccctgcgagtgtgtgctgatcatagaggagggatcaattggttatccctgagtcccgatggccagagactccttacgggctcggaggatggaactgccaggttgtggtcaactgccgatggccagtgttgcgccctcctgcaggggcacgaatcctatgtcactttctgccagctcgaggatgaggctgccttcacatgtagcgcagattgcacaatccgcagatgggatgtactcactggccagtgtttgcaggtgtaccggggacatacctcgatcgtcaaccggatcctggtcgcaaataaccagttatttagtagttcctacgacagaactgctcgcgtctggagcgtggataaaggacagatgagccgagaatttagaggccatcgaaactgtgtgctgaccctcgcttactcggctccctgggaccttccctctacaccatgcgctgaagaagcagcagctggagggttgctcgttactggctccactgacggcaccgccaaggtgtggcaggtagccagcgggtgttgtcatcagaccttacggggacacacgggagccgtcctgtgcctcgtgctggatactcctggacataccgcttttacagggtccacagacgccacaattcgagcctgggacatcctgtcaggcgaacaactgagagtgttcagagaacaccgaggcagtgttatctgcctcgaactggtcaatcggctcgtctattcaggcagcgccgaccgcacggttaaatgttggctcgcggacacaggcgaatgcgtccggacattcacggctcatagaaggaatgtatccgcactaaagtatcacgctggaacactgttcacgggctcaggtgacgcgtgcgcgagagcattcgacgcacaatctggggagctacggcgtgtattccggggtcatacgttcatcatcaattgcattcaggtgcatggtcaggtgctatataccgccagccacgatggcgctctgcgcctgtgggacgtccggggactgcggggagcacctaggccccctcctccaatgcggagcctcagccgattgtttagcaacaaggttggctgcgccgctgcccctctgcagcctgcttag

SEQ ID NO: 61161 - DNA, 8622 bp, Artificial Sequence
  Description of Artificial Sequence: Synthetic coding sequence
atgagctctccacggctgatccccctgtggaaggacttgaaattgttgcttaacgacaccatcaacaagagtaaacagccaagcgaagatcctaaaaactgtttaatcgtgttgagtgatcgctcacaggcagtggcatggatgaaatctaaaactgaagatatggttgagaagaggactttctcgatgaccgagcgcctccccccaatccaatccatggtgcatgctggcagcttccacatcctcgtggtgtactgtggcgacctgattctccgcttgtttggggatcacttcagagcgtttaagcccttgggcaaggttccttgccgctttaatatctcatgcctttgttatgacccagaaatgaagatgctcctgtcaggtatcctgggcgctgtggtgacatgggtgattgagctgggtggcacagggctgcagatcgcccacatggtgtcgatgcccggtgatgagctagtgcaggacatcgtgctgaatggtccttcggggtcgctgcttgctctttgcgaaaccgtggtgcgagtgctaatgcatcagggcaaggggcagctcggggaagtgaaaaggtttacttccacatcttcaggctcctccattacctgttgttttacatgttttgaccaaggtttcctttacgccggaaatcaggcaggcgaaattcaggtgtggtctctgcagcagggccatccgctccattcgttccaagcccaccagagcggcgtaatatgcatccggtcccggccagaggcacataccctgttaacagccggatctgatagtctaattaaggaatggaatctaacaagcgggtccttgctgagaagactcgaactcggcgaagagctctaccgtctacagttcatcgacagcattaccttcttttgtcagacggctcacagcttctccctccatcggctgccctgcttttacagcctcttcaacgtttgtgggtctgcccctcagcaactcaggcgcgtatgttgcggaaacaattggtttagaatactgtgtaccactgaggacggcctgcttaggttcgtgtcgcctgtcacaggcgacttactggtgatcacctggccattcagcattctggaccaggctgtggactgggcttacgaccccggtaaagaagagttgttcgtagccactggttcaagcgaggtgctcgttttcgacacaacccgttgtccatgtcctgctaagtacctgctggggacgtctcctaactcccaggactttgtccagtgcctggcttacggccatttcaatctgggcagaggccttgaaggcctgatcttctcgggtcaccaatcaggagtgataagggtcttatcccaacactcctgcgccaggttagagaagtttatgcatttcggcgcagtgctggccctttcaaccttgtccggcggtatttttggcggtcaggggaacagtctattgtgtagctatggaatggacgattacgtgcacctttcagaagcagtactggatggagttaaagtgcagctgagaccgctggctagcatcctcagttcctgtcatttgactcacctgatactactgccaaagtcggtgggcgctatcacagagacaaattgcctccggttatggaagtttcacgacttcctaagtagcggcagccagaacggactgaaattcattgaaacgctgccccttcacctttgtgcaatcacatcattcgatgtgtgcctgagcctctctttgtttgtgaccgggagcgccgacgggtctgttcgtatttgggactttcacgggaggcttatcggcatacttgattccagtttacattttggacctgtctgctttgcaaacgatcgcggagacttgttggtcacattcaatcagtctctgtaccttgttagttgcttgaaacttctacccccagccctcttaacgcggttgagcttcatgtctatcagtgacgaagttctagaggtccctaagccttttattccttcattcttttttagttttgagaccatgttcgtgcctaagtacatctacccagggcaggcacagcagaagctagttggacttgagaaactggtgaataacagggctatcgcgtttgatcactctgttccacatgtgatagaagaggatgaagagggttctcccgtactcttgagatcctcaatgcactactcactacaggacatggaggactggatgcaagtttcaaagcgataccagtgccattatgtgcttccaccgcagctccaattaacctcctgggacggcctcaacccttatcaaatcttgcgctattatttcggccatggacgggaatggctttttgctcccgactgctacatacctaactccgtgattcgggctagattgtggcccgagggcactcctatctacctacaatgtaacctgcacgctccacagcgagagctggagtgggacaggtcccaggagttctttttttggcactcgcgcgtccgcgcaattagcaacacagagtacccaaagaacaaagaggaggacgagcacttcctcgaaatgcggttgagtaaggacgtgacttacagtgtgttgacggacggagccaaccgatcctggcttggcaggaaaatgagcgaaataaccataaattcgatgatcgagactatgttgaacattatggtccatgccagcctcctgaagtatcagtgctgcgtgggtgctctcggacagatcttcgcatcctatcaggtttcaccggcactacgcagcgagaccgccagaagactgctaaacgataccacaaacagtaaccctttgatccgggagcttgcatgggaggggctgaaaagacttgggatgatcacacacctgtttgctatgccactggcacaggggcttatggataaggatgaaagggtacgaatcaaaactctgtctctgatggcagaaattggcattcacagtagaaccagtctcctgcagttgacccagaaacaggagacctttagggaaatgcaacaacaaatgattggagaggagcctcttgaccaccttctgggtatgcgagctaccgatttgcagatcctgtcaactcaggtggagcagaggttgaatgagaatctgacactcagtcacagggacgagaagccagccttcagtttggatgtctcaatgccttctgagctgaagagcagcctcaagccacccacagtgtccgaggagtccgaagttgccatcaagccatctaagggccaacggcgaggtcaagctggcgttaagaaacattcccagaaatggctgcggggactgaagaagaccaaagaaagggactccaagcagatgagcactgaacctgggttactggaagatgaaagcggcacggaagcagcaccaatcgagatggaggaagcctctgtgtacagccaatggtcatcaagtacttcagtaattaaattgagtaaggatgtggattcccaggagaaggatataagcaaagatcacatagcactcaccttaaagcggcttcagaagatacgcgacaagcgggacaaaaaagcaacggctcaaaagctcaagaagaaacataaaaaaaaaggtaaggaagctaaagtcattaatgaggagactacaccccctgtcatggaacaacctgttacaaagaaggtgaaaatccagggccgaggggcatctggtatcagcgggaggcgctcaaccgccggagatgggagctcttggagggatgacctgtgcagacttatggcactgcggatcagtggttcacagaccaagatgtcagagaacctgaatgcagagctggtcaccttcgcccaggagatgctcgtggataggcatcccagttgggagcttttccaggaaatttgtcctctgctcaaaaaagaaagcaaagttctactggaagatttagactgggatgtcgtcccacctgagaagaaacccatcttcattcaggagggagccattagagaggacatgattcagggcgttactcaggaggtcatacgtcataaagaagtaatgccacgtgaggaagagcaggcccagaagaaggctagggacatgctgggccttgaggagacacaggtcatactaaaaaaaggaaagaaggtgatattcctcgagcccggaaacgtaactatggggaaggaaatcagcaagaaggaagagaagaaaacctttcagaaaagccccaagcagggccgaaaggcggtccagaaggagcgaaaggttggaaagattaagcgtgaaatgaccaaagaggagagggatatgagtgaggaagtcgaggagatggccacactggaggaaaaagtcgtcaaacaggagggcaagcttgtgatgattgaaaggactccatcgtggcaggactggaaaaaggcctgggatgagtggaaacaagtgcacggagagacccgcaaatcatggaaagcctggaaggaggaatgggaaaagagactgcttcaagaggaggagaaactccaccaggccggagagaaattatccccagaggaagagatgttgcaggaagacaaaaagttgaagtgggaagagtggaaacaggtctgggagaatatgctgtcctccaaaagcaaggaacagcaatataaggatgaggaggaggtaaccctcgaggaagaggtcagcagggaaggcgaagaaaaggaacagcaggtcactgaagaacaacggcacattcaagaggagcataagtgggcaaggattcaccgcaagagggcccgagctgaaaagaagagggcccaagaggagaggaaactggctcaggaagaggagaaactcgctcaggaggaacgccagttggctcaagaggagcgcaagctcgcccaggcttatgttaagattacccaggatgacagggaaatggcccaagcagaaggtaagttcgctcagaaagaggagaccttggctcagcgtggggagaagttatcgcaggaggctgaaaagctggctcaaaagcgaaagaaactggctaaaaagtgggagaaggttgccagagaggaagagaagctggccaagaaaggaggaaagctcgccgaggtaaaaaacattcttgcccagaaggtggaggaactcccccagagggagcagaatttggattggcaggagaaggagctcgctcaggaactcgaggaacttgaatgggatatggaagaactatcttggaaagaggaagaactgaaccaggaggaaggtaaacttgtcgaagagaaaaagaaactcgcggaagaggaagaggccctggcatggcagcgtgagaagctgtcagaagaagaaaccaagttggcacaggaagaggaattgctcattcaagaaaaggagaaactggcgcagcacaaggagaagatgcctgaggaagaggagcgcttaggccgaaagcgcgagcagctgatagagaaaaagatgaagctcgcgcagaagcgtgaaaggtggatcaatagcatggaagagctgacaaaaaacaaaatgatcctgtatcaaaagaaaaacttagcccaggaaaagaaaaatctggctcaagaaaaggaaaagctcgcacagcgcaaggaaaatctgctttataataaggagcgactcacacacagcaagaaacagctagtccaggtgaaaaacaagctgggcatgttcaacaaaatccttgcacaggttgaggaaaagctgacccaggagaaggagacagttattaagaaaaaggagaagcttgctgaaaccgagaagaaactggtgcaggtggaagacagcctcgcaaaaaaacaagaaaagcttgcccaggaaaagatgaagctggccctcgaaaaagccatggttcaaggtaaaaaaaggctgagaggcgaactagacattgctaaagaggagaaggctctgaacctcgagatgaagaggcttgccgaggagaaaatgcgcttagttgaagggaaagagactttgtcaaagggcgagacaccagaaacctcaaggcagcggaaaatgacccaagtggaacaggagctatttgagagaaaactgagcctggaggagaagatcttgctccacgaggatagaattctggcaatggaagagagcgagattgcaaaagggaaattggaattcacccgaggtcagagaatctttgtgcaggggcagcggaagcttgctaaggcctccagaaaactgatcaagaaacgcgaaagcttaagcaaagagcccgcaaaactcaacaaaattctgaaagcactgcagaagttaaccagagacgaacgaaagctgactcaagaggagatcaaaatgaccaagatgaaaagggccctattcgtgaaggaacgcaggctgagcattgagcagagcaagttggacatcaaggaatgggattttagtgagaaaagatccgaacttaccaaggatgaaaaaaagctggctcggaagcaaagaaagctggctaataaaatgaggcggatgatcaataaggaagagaaaatgacagaggaggaaagcaaactggccagaaagcactccgaagtcatattggacgatgaggaggaaggcggtattgaagaagaagaggtgatccctttcctgaaacggaggtggcgcaagaggaaggaggcaaaacggggtgataaacccaaggagaagtttagtagccaggtagacgaggtcgagtcagaggagcatttttctgaagaaatggaaagtttgctggacgaactggagaagcaggagagcttgtcatctgaggaggaagaagagcgggaggaagaggaggaaagggaggaggaagaggttcgcgaggaagaggaggagaggaaggaggaagaggaaggcgaagagaagcaggtcgagaaagaagaggaggaaaagaagaagaaaaagaaggagaaaaaaaaggaggaagtacaggagaaagaggaggtttttgaagaaaaggaagagattatgtcagaggaggagacagagtctttgagcgacgaagaggaagaggaggaatcttgctcactcgaagaggaggttgacagggagaaagagatcctgaagaaggagaaacaattcaagttgcaggaacaaagacggaaaagtctcagaggtagggagcgcgtcctgagcatcctacgcggagtcccgcatggaaagggcagagccattcgccttggagtgctgaagtcaccactgaagaagctcatgtcaactgcattggagatgaaagaaaagactccggtgcccgtccccgagaaacaaatttcctgggaggataagaaggctacagtggtggaaattcccaggaagttcctaggcaccatggacaaggaacgggaagttatggggaaatatgagccgattccgccacatgtgctgggcaccgtactcgaatcccaagcacaggacctgaagactccattcatgagccatatacttaggaggacagttgaggctgaagagcttcagcacaagcccctgggagcctggtggaagtggttccttcagcatcctcctcttatgggtcagactgaggtgcagttgcccctgtcacagataccggcaaaagagcagcacgccgatgtctccttgtctgacgtggaatggatcaggcatgtgctagaacgtatggaggccggagagcagttatctagagatggcttccaccggctgtgccaactactcaaggacctcgcctccaaggggaatctggagtggttgcatcttgcaaagcatgaagcaattgtttaccgtcataggcaggctctcgaatctcaagatacacgtatctccagtagacagtctatgagtcccaaatatctcaaagtgatccctccaatcaaggccaaggagaaagagagctggcctaaacccctggcagtgccgacacaaaaatcacctttggccacaaagcgaatccctgatccgagagcaaaaaactggcacctcctcggggagccatatcgctccgaacgtgcacaacagatcagcatagctcacaaagagatggagatgcagtatttttacccggctaccagagacatctttccgtccgcccacgcctcagttgaaaagcagaccctggcactcatgtttcagaaagatttctgggatttcaaagacaaacgtaggtttcctaagttaccaaaactggaaaagaagacccaacctattagcaaaaaaaaggaggaactgccactctgggagacgttcgtcgccctctaccatgtgttgcggatgctgcagcagagatatcccaaagatagcacagcctggatggaacagttctaccagttgatggacctgtaccaacttaaatcacctcggatccagaagttattgcaggagctactgatgagagaagaaccgcaaccgcaagagattatctacgaagaagccctgaaggctacagaactcgtacctggggagcgactgttctgttgtctcttttgcggcagtagtcataccccacgcagtccacaggagttccagggagcggtcccactgccttggcaaaactgcgtacggactattctccctgttggcatcgcacggtatggtattttggagctggcgtggaagagtctgcccgaggccgacttacatctcacaaaagcacttacccacacagtggcccctactctgtag

SEQ ID NO: 61162 - DNA, 8738 bp, Artificial Sequence
  Description of Artificial Sequence: Synthetic coding sequence
atgtccagtccacgtcttattcctttatggaaggacttgaaactgctgctcaatgataccatcaacaaatctaaacagcctagcgaggatcctaaaaattgcttaatcgtgctctctgaccgttctcaggtgctcttcaaagagtccaggtatcctcagaatatgccttgcgtatgttactattttagtgacgcacacttttttgctagcttgtcctgggttacaagcaacaccaaagaaatccaagccgtcgcatggatgaagagcaagaccgaggacatggtcgaaaaaaggacattctcgatgacagagagacttccaccaattcaatccatggtgcacgcaggctcattccacatcttagttgtgtactgtggtgacctgatcctccgactgttcggcgaccactttagagcttttaagcccctggggaaagtgccttgccgcttcaatataagctgtttgtgctatgacccagagatgaagatgttattaagtggaatcctaggtgccgtggtgacgtgggtgattgaactcgggggaacgggtctacagattgctcacatggtgtcaatgcctggagacgaactggttcaagatatcgtgctcaacggcccatcaggcagcctgcttgcgctgtgtgagaccgtcgtccgcgtgctgatgcaccaggggaaagggcaactgggtgaagtgaaacggttcaccagtaccagcagtggaagctccatcacctgctgttttacatgtttcgatcagggattcctgtacgccggtaatcaagccggagagattcaggtctggagcctgcagcagggacatcccctgcatagctttcaagcacaccaatctggcgtaatctgtattcgatctcggccagaggcccacacactgcttacagcaggttccgatagtttgatcaaagaatggaacctgacaagtgggtcactcctgaggcgcttggaactcggagaggagctctatagacttcagttcatcgactccataactttcttctgccaaaccgctcacagcttttctctccatcgcctcccatgtttctactcactttttaacgtttgcggctctgctccgcagcagctccgcagagtgtgttgtggcaataattggtttaggatcctctgcactacggaagatggcttgctgcgttttgtgagcccagtgactggcgatttgctcgtcatcacttggccctttagtatcctcgaccaggcagttgattgggcttatgatccaggcaaggaggaactgtttgtggccaccggttcgtcagaggtgctggttttcgataccacaaggtgcccatgtcctgccaaatacctgcttggcaccagccccaactcccaggacttcgtgcagtgtttggcctacggccatttcaacctcgggaggggactggagggattgatctttagcggccaccagagcggtgtcattcgggtgctctctcaacattcgtgtgctagactcgaaaaatttatgcacttcggtgcagttctggcactgtcaacactttctggtgggatcttcggcggtcagggaaattccttgctgtgcagctacgggatggatgactacgttcacttgtcagaagctgtgctggacggagtcaaggtccagctcagacccctcgcatctatcctgtcaagctgccacctgactcacttaattctgctcccgaagagcgtgggggctatcaccgagaccaactgtctcaggctctggaaattccatgactttttatcatcaggttctcaaaacgggctgaagttcatagagactctgccactccatctgtgcgccatcacttccttcgatgtgtgtctgtctctgtcactcttcgtcactgggtctgccgacggttctgtgcgcatctgggatttccacgggaggttgatcggaatccttgattcaagcttgcacttcggcccagtctgctttgcaaacgatcgaggggatttactggtgacctttaatcaaagcttgtacctcgtgagttgtcttaaattactgcctccggctctcctcacacgattatcctttatgtccatttccgatgaagtgctcgaggttcctaaaccttttatcccctccttcttctttagcttcgaaacaatgttcgtgccaaagtatatatatccaggccaagcccaacagaagctggttggtctcgagaagctcgttaataatagggcaatcgccttcgaccactcagtcccccatgttattgaagaggacgaagagggctcacccgtgttactgcgctcctccatgcattattccctgcaggacatggaagattggatgcaggtgtctaagagataccagtgtcactacgtccttcccccacagctgcagctcacgtcgtgggatggtctgaatccgtatcagatcctgcgctattattttggccacggcagggagtggctcttcgcccctgattgctatattcccaattctgtcattagagccagattatggcctgaaggtacccccatctacttacagtgtaacctccatgctcctcagcgggagttggagtgggaccggtcccaggaattctttttctggcattctcgtgtccgcgcaatctctaataccgagtaccctaagaacaaggaagaggatgaacatttcctcgaaatgcggctctccaaggatgtgacctattccgtgctgactgatggcgcaaatcggtcttggcttggtcgcaagatgagcgaaatcactataaactccatgatcgagactatgctgaatattatggtgcacgccagcctgctgaaatatcagtgctgtgtgggtgccctggggcaaatcttcgcaagctaccaggtgtcccccgcactacgttccgagacggcccgtcggctgctcaacgatactacaaattccaatccactgatacgagagttggcctgggagggcctgaaacggctgggcatgatcacccacctctttgctatgcctctcgcccagggccttatggataaggacgaaagggtgcgtatcaaaactctctctctgatggccgagattgggatacacagccgcacctctcttctccagttgactcagaaacaggaaaccttcagagagatgcagcagcaaatgatcggggaagagcctctggatcatttactcggcatgagggctacagatctccagattctatccacccaggtggagcagaggctgaacgagaatcttactctgagccatcgagacgaaaagccggctttctcattagacgtgtccatgccgtcagagctgaagtcctccttaaagccgccaaccgtatccgaagagtctgaggtggctattaaaccctcaaagggccagagaaggggtcaggccggagtcaaaaagcacagtcaaaagtggcttcgagggctaaaaaagaccaaggaaagagactctaagcagatgtccaccgagccagggttattggaagacgagtccgggaccgaggccgcacccatagagatggaggaggcctctgtgtactctcaatggtcgtcctccacatctgtcatcaaactcagcaaggacgttgatagccaggaaaaagacataagtaaggatcacatagccctgaccctcaagcgcctgcaaaaaattagagataagcgggataagaaggcaaccgctcaaaagttgaagaaaaagcacaagaagaaaggcaaggaagctaaggtaattaatgaagagacaacgccacccgtgatggagcagcctgtcacaaagaaggtcaagatccaaggcaggggcgcttctgggatttccggcaggcggtcaaccgccggagatgggtcttcatggcgggacgacctgtgtcgactaatggccctgcggatttcaggctcacagacaaagatgagcgaaaacctgaatgcagaactggtcaccttcgcccaggagatgctcgtggacaggcatccttcttgggaactgtttcaggagatatgcccactcctgaagaaagaatccaaagtgctcctggaggatctagactgggacgtggtgccaccagagaagaagcctatattcattcaggaaggagctattagagaggacatgattcagggcgtcacccaggaagtgatcaggcataaggaggtgatgccacgggaagaggagcaagcccaaaagaaggctcgagacatgctaggccttgaggagacccaggtgatactgaaaaagggcaagaaagtcatatttcttgagcctggaaatgttacaatgggtaaggagattagcaaaaaggaggaaaagaagacgtttcagaagtcccccaagcagggacggaaggcagtccaaaaggaacgcaaagtgggcaagataaaaagggaaatgacaaaggaagagcgggacatgagtgaagaggtggaggaaatggctactcttgaggagaaggtagtcaagcaggaggggaagctagtgatgatcgagcgaacccccagctggcaagattggaaaaaggcgtgggacgagtggaaacaggtgcacggagaaacgcgcaagagctggaaagcatggaaagaagaatgggagaagcgtcttctgcaggaggaagaaaagctgcaccaggcaggcgaaaaactctccccagaggaggaaatgctgcaggaagataaaaagctgaaatgggaggagtggaagcaggtgtgggagaatatgctgtcctctaagagcaaagaacagcagtacaaggacgaggaggaagtaaccctggaggaggaggtctctagagagggggaagaaaaggaacaacaggtcactgaagaacaacggcacattcaggaggaacataaatgggctcggatccacaggaagcgagcacgggctgagaagaaacgggctcaggaggagcgaaaactcgctcaggaggaggagaagctggcacaggaggagcgtcagctggcccaggaagagcgcaaactggcgcaggcttatgtgaagataacacaggatgatagggagatggcccaggccgaagggaaattcgcacagaaagaagagaccctggctcaacggggtgagaagctgtcacaggaggccgagaaattagcccagaaacggaaaaaactcgccaagaagtgggagaaagtggccagagaggaggagaaattggccaagaagggaggcaagctagcagaggtaaaaaacattcttgcccagaaggtggaggaactaccccaacgggagcagaaccttgattggcaggagaaagaactggcccaggagttggaagagcttgagtgggatatggaagaactctcttggaaggaagaggaactaaaccaggaagaaggtaagctggtagaggagaaaaaaaaattggcagaagaggaagaggctcttgcctggcagagagagaagctttccgaagaggaaactaaactcgcacaggaagaggagcttctgatccaggaaaaggagaagttggctcaacacaaggaaaaaatgccagaagaagaagagaggctaggacggaaaagggagcagcttatcgaaaaaaagatgaaacttgcccagaagagggagagatggattaactcgatggaggaactgaccaaaaataagatgattctctaccagaagaaaaacctggctcaggaaaaaaagaacctggcccaggaaaaagagaaactggcccagcgcaaggaaaatctgttgtacaataaggaaagacttacccatagtaaaaagcaattggtccaagtgaaaaacaagttgggcatgtttaataagattttggctcaggtcgaggagaaactgacgcaagaaaaagaaaccgttattaaaaaaaaagagaaactggccgagacagaaaaaaaattagtgcaggtggaggatagcctggccaaaaagcaggagaagttggcgcaggagaagatgaagcttgctctcgaaaaagccatggtgcagggaaagaaaagactaaggggcgaactagatatagccaaggaggagaaagcattgaatctggagatgaaaagactcgctgaagaaaagatgcgactggtcgaagggaaagagactctgagtaagggcgagactccagaaacctcccgccagaggaagatgactcaggtggaacaggagctgtttgagcgtaagctcagcctggaagagaagatccttctacacgaagaccggatccttgccatggaggagagcgaaattgctaagggaaaacttgagtttaccaggggccagagaattttcgtgcagggccaacgcaagctagctaaagcttccagaaaattgattaagaaacgtgagagcctttctaaagaacccgcaaaactgaacaaaatactgaaggcacttcaaaagctaactagggatgagcggaaactcacacaggaggagatcaaaatgaccaagatgaaacgagccctcttcgtgaaggagagaagactgtcaatcgaacaatctaaactagacatcaaggaatgggacttctccgaaaaaaggtcagagctcactaaagacgagaagaagctcgcacggaagcagaggaagcttgcaaacaagatgaggcggatgattaataaagaagagaaaatgacggaagaggaatctaagctcgctcgaaagcactctgaagttatactggacgatgaggaagaggggggtattgaggaggaggaggtgattccatttctgaagcggcgatggagaaagcgtaaggaggcaaagcggggtgacaaacctaaagagaaattctcttctcaagtggacgaagttgaatcagaggagcatttcagtgaggaaatggaatctctgctagatgaactggagaagcaggagagtctctcttcagaagaggaggaagaaagagaggaggaggaggagcgtgaggaggaagaggtgagggaagaggaagaggagaggaaggaagaagaggagggcgaggagaagcaggtagaaaaagaggaagaggagaagaaaaaaaaaaaaaaagagaaaaaaaaggaggaagtccaggaaaaggaagaagtttttgaagagaaagaggagatcatgtccgaagaagagactgagagtctttccgatgaggaagaagaagaggaatcttgttccctcgaggaggaggtcgatcgtgagaaagaaatcttaaaaaaggagaaacagttcaaactgcaggaacaacggagaaaaagcctcaggggcagggagcgggtgctgagcatcctgcggggagtgcctcatgggaaggggagagcgattagactgggtgtgctgaagtcccctctcaaaaagctcatgtctaccgcccttgaaatgaaagaaaagaccccagttcccgtgccagagaagcaaatcagctgggaagacaaaaaagccactgttgttgagattccgagaaagttcctgggcaccatggataaagagagagaagtgatgggcaagtacgagcccatccccccacacgtcctaggtacagtgttagaatcacaagcgcaggatctcaagactccctttatgagccatatcctccgcagaactgtcgaagccgaagagcttcagcacaaaccactgggagcctggtggaagtggttcttacagcatccccctctgatgggacagactgaagtacaactgcccttgtctcagattcccgcaaaagagcagcacgctgatgtgtcgctctccgatgtcgaatggattagacacgtcctcgaacggatggaggccggtgaacagttgtccagggatggcttccataggctgtgtcagctgctgaaagatttagccagtaaagggaatctggaatggttgcatctggccaaacacgaggccattgtataccgacacaggcaggctttagaatctcaggatacaaggatctcttcacggcagagtatgagccccaagtacctgaaggtgatccctcctatcaaagccaaggagaaggaaagctggccgaaacccctggccgtgcctacacagaaatctccactggccacaaagaggatccctgacccccgagccaagaattggcatttgcttggtgagccgtacaggagtgaacgtgcgcagcaaattagcattgcccataaagaaatggaaatgcagtacttttatcctgctacccgagacatttttccaagtgcccacgccagtgtggaaaagcaaactctggctctgatgttccagaaagacttttgggattttaaggacaagaggcggttcccgaaactgcccaagctggaaaagaagactcagcctattagtaaaaaaaaagaagaattgcctttgtgggagactttcgtagccctctaccacgtcttaaggatgctgcagcagaggtacccgaaagactccacagcatggatggaacagttttatcagctcatggacctctaccagttgaagagtcccaggatccagaagttactacaggaattgctcatgcgagaggagccccagccccaggaaatcatttatgaagaagctttgaaagccaccgagcttgtgccaggggagcgcctgttttgttgcctgttctgtggctcctctcacactcccaggtcacctcaggaatttcagggagccgtccctctaccctggcagaactgtgtcaggactatactccccgttggaattgcgaggtacgggatcttggagcttgcctggaagtcattgccggaggccgacttgcaccttacaaaagctttgactcatacagttgccccaactctgta

SEQ ID NO: 61163 - DNA, 1419 bp, Artificial Sequence
  Description of Artificial Sequence: Synthetic coding sequence
atggcaagtcctccccgttgcagcccgactgcccatgaccgggagtgtaagttgccccctccttccgccccagcgtcggaatattgtcctggcaagctcagttggggaactatggccagagccttgggtcggttcaaactgagcattccccatacccacctgctggccactttagacccgttggcgctggaccgagagcctcctccccacctgctgcctgagaagcaccaagtccccgaaaagctaatctggggcgaccaggatcccctaagcaagatccccttcaaaattttatctggtcacgagcatgctgtctcaacctgccacttttgtgtcgacgatacaaaactgctgtcaggctcatatgattgtactgtgaagctgtgggacccagtcgatggctccgtggttcgcgattttgagcatcgcccaaaagcacctgtggtcgaatgcagtattacaggagactccagccgtgtcatcgctgcatcctacgataagaccgtgcgggcatgggaccttgagactggaaaacttctctggaaggtgaggtatgacaccttcattgtgtcatgcaagttttctcctgatggcaaatacgtggtcagcggcttcgatgtcgatcacggcatctgcattatggacgccgagaacatcacaactgtgtcagtcataaaggatcatcatacgcgctctatcacgtcctgctgctttgatccagacagtcaaagggtggcttcggtatctctcgatcggtgtataaaaatttgggacgtcacgagccaggccacattactgacgattaccaaggctcatagcaatgcgataagtaattgttgcttcaccttcagtggtcactttctttgcacttccagctgggataaaaaccttaaaatttggaacgtgcacactggtgaattccggaattgcggtgcatgtgtcaccctgatgcagggccacgagggttcagtctcgtcgtgccacttcgcaagggactcatcctttctcattagcggtggattcgaccgtactgtggccatatgggacgtagctgagggatatcggaaactcagcctgaagggccataacgactgggtgatggacgtggcaataagtaacaacaagaagtggatattgtcagctagcaaagatagaactatgaggctgtggaatattgaggaaatagacgagatcccattggtgataaagtacaaaaaagccgtcggcttaaaactgaaacagtgcgagcggtgcgacagacctttcagcattttcaaaagtgataccagcagcgaaatgttcactcaatgcgtcttttgtagaatcgatacacgcggtctgccagccgatactagttctagttcatccagcagtgaacgagaaaactcacctccccctcgcggatcaaaggacgattag

SEQ ID NO: 61164 - DNA, 1281 bp, Artificial Sequence
  Description of Artificial Sequence: Synthetic coding sequence
atggccagcccaccgaggtgctctcccacagcccatgatcgagaatgtaaactgcctccacctagtgcgccagccagcgaatattgccccggaaaactcagttggggtactatggccagggctttggggagatttaagctaagcattccccacacacacctgctggccaccttggatccattagccctagatagggagccacctccgcacctattgccagaaaagcaccaggtgcccgagaagctaatctggggcgatcaagacccgttgagtaaaattcccttcaaaatccttagcggccacgagcacgctgtgtccacctgccacttctgcgttgatgacacaaagctgctgtcaggaagctatgactgcaccgtgaagctgtgggatcctgtggatggatcagtggtccgagacttcgaacaccgcccaaaggccccagtggtggaatgctctatcactggcgattcatcacgcgtgattgcagcctcctacgacaagaccgtaagagcctgggacctggaaacaggtaagctgctttggaaagtgcggtacgacacattcattgtcagttgcaagttcagccctgacggcaagtacgttgtctccggattcgatgtggatcatggcatttgcatcatggacgccgaaaacattactacagtgtctgttattaaagatcaccacaccaggtccataacttcttgctgtttcgaccctgatagtcaacgtgtggcatccgtatccctcgacagatgtattaaaatctgggacgtgacctcacaagcaaccctgttgaccatcaccaaagcgcacagtaatgccatctccaattgctgttttacatttagtgggcatttcctgtgcacctcctcttgggacaagaacctgaagatttggaacgtacatactggcgaatttcgcaattgcggagcatgcgtgacactaatgcaaggacacgagggttcagtcagcagctgccacttcgcccgagattcttctttcctcatctccgggggatttgaccggacagtggcaatctgggacgttgcagaagggtatcggaaactttccctgaagggccacaatgattgggtgatggacgtggcaatcagcaacaataagaagtggattctaagcgccagtaaggaccgcaccatgagactgtggaacatcgaagagatcgacgagatcccactggttatcaaatacaaaaaggctgttggtctcaagctgaagcaagagaaaaaggaggcatatcttaaacttaagcagggctag

SEQ ID NO: 61165 - DNA, 1164 bp, Artificial Sequence
  Description of Artificial Sequence: Synthetic coding sequence
atggagaagattgaggagcaattcgcaaacctgcatatagtcaaatgtagtctaggcactaaggagcccacgtacctgttgggtatcgatactagtaaaaccgtgcaggcgggtaaagagaacctggtggctgtcctgtgttcaaatgggagtattaggatctacgataaggaacgcctgaatgtgctccgagagttctccggttacccaggattgttgaatggcgtccgatttgccaattcgtgtgactccgtgtactctgcatgcaccgatgggaccgtgaaatgctgggatgccagagtggcccgtgagaagccagtgcagttgtttaaggggtatcctagcaatatctttatcagttttgacattaattgcaatgatcacatcatttgcgctggcaccgagaaagttgacgatgatgccctgctggtattttgggatgctagaatgaactctcagaatcttagtacaactaaggattctctcggtgcttattcagagacgcattctgatgacgttacccaggtgagattccacccatcaaatcccaatatggtagtaagcggatcatcagacggtcttgtcaacgtgttcgacatcaatattgataatgaggaagatgctctggtgaccacctgtaacagcatttcttcagtgtcttgtattggctggagtgggaagggatataagcagatctactgtatgacccatgacgaaggtttctattggtgggatctgaatcaccttgatacagatgagcccgtaacgcgcctaaacatccaggatgtgagagaagtggtgaacatgaaggaagatgcactagactacctgatcggaggcctgtaccatgaaaagacagacacactgcatgtcatcggcggaacgaacaagggcagaatacaccttatgaactgctcaatgagcgggctgactcacgtcacaagcttacaaggtggacacgccgctaccgtaaggagtttttgttggaatgtgcaggatgactctctgctcactgggggagaagacgcacaattgttgctgtggaagcctggagctatagagaagacattcaccaaaaaagagtctatgaagatcgcaagttctgtgcaccagagggtgagagtgcatagcaacgatagctataagcgtcgaaagaaacaatag

SEQ ID NO: 61166 - DNA, 1164 bp, Artificial Sequence
  Description of Artificial Sequence: Synthetic coding sequence
atggagaaaatcgaagagcagtttgccaatctccacatagtcaaatgctcacttggcaccaaagaacccacatatctcctcggaattgacacaagcaagactgtgcaggccggaaaggaaaacttggtcgcggtgctttgttccaatggaagcattcgtatctatgacaaagagcgcttgaacgtcctaagggagttcagcggctaccccggtctgttaaacggggtaaggtttgcgaatagctgcgatagcgtgtactcagcttgcaccgacggcactgtgaagtgctgggacgcacgggtggctcgcgaaaaaccagtacagctgtttaagggctatccctcaaacatttttatcagttttgatatcaactgtaatgaccacatcatatgtgcaggcacggaaaaagtggatgatgatgcattgttggttttctgggatgctaggatgaattcgcaaaacctttcgaccactaaggacagtctgggagcctattcggagacccacagtgacgacgtcacacaggtgaggtttcatccaagtaacccgaatatggtagtgtcaggaagtagcgacggactggtgaacgtctttgacataaacatcgacaacgaggaggacgccctcgttaccacctgtaatagcatcagctctgtgtcttgtattgggtggagcggtaaaggctacaagcaaatctactgcatgactcatgatgaaggtttctattggtgggatttgaatcacctagacacggacgagcctgtcacaaggctcaacatccaggacgtgcgcgaagtcgtgaatatgaaggaggatgctcttgactacctgattgggggattgtatcacgaaaagaccgacacgctccatgtgatagggggtacgaataagggtcgaatacaccttatgaattgtagtatgagtgggttgactcacgtgacgtctcttcaggggggtcatgcggcaactgtcaggtcattttgttggaacgtccaggatgattctctgctgacaggcggagaagacgctcagctgcttctttggaagcccggagctatcgagaagacctttaccaagaaagagtcaatgaagattgcatcctcagtccaccagagggttcgagtgcactctaacgattcttacaaacgccgaaagaaacaatag

SEQ ID NO: 61167 - DNA, 900 bp, Artificial Sequence
  Description of Artificial Sequence: Synthetic coding sequence
atgctgtggtttgggcagccaggcccaggcggatggaaccggaagtgtctccggccattcaccctgcctaggggacaacatccccaacctagctacggattcccccaagtgaacgaagtagtgttctcacctggggaatcccattgtgcaacctgctccgaagacggcagcgtgcgtgtgtgggctctggccagcatggagctcgtgattcagtttcaagtgttgaaccaaagctgcctatgtcttgcatggagccccccttgctgtggcagaccagaacaacagcgactcgcagcaggctacggggacggttcccttcgcattttctctgtgagcaggacagcgatggagctcaaaatgcacccgcatcctgttgccctgactaccgtagcgttttcgaccgacggccaaacagtactctctggagataaagacggcctcgttgctgtttcccacccctgcacgggcacaacgtttagggtactctccgatcatcaaggagcgccaatcagtacaatttgcgtgacttgcaaagagacacagggccacctccccccttctcttgccgctttctgcccttgggacggagccctgcttatgtatgttggacccggtgtgtacaaagaggtgattatatacaacttgtgccagaaacaggtggtggagaaaattccactacctttttttgcaatgtcactgtccctgagtccaggaacgcacctattggctgtcggatttgccgagtgtatgttgcggctggtagattgcgccatgggaaccgcccaggacttcgctggacacgataatgcagtccatttgtgccgctttactcccagtgccagattgctgttcacagccgcacgtaacgagattctcgtgtgggaggtgccgggactgtag

SEQ ID NO: 61168 - DNA, 5247 bp, Artificial Sequence
  Description of Artificial Sequence: Synthetic coding sequence
atggcacgcgcttggcaacatccctttctgaacgtgttccgtcacttccgcgttgatgagtggaagcggtcagcgaagcagggtgacgttgcagtggtgaccgataagaccctcaaaggtgcggtgtacagaatacggggatcggtgtctgccgcaaactacattcagctccctaagtcctctacgcagtcccttggccttacaggtcgctacctctacgtccttttccgtccactgcctagtaagcatttcgttatacacctcgatgtttcctctaaggataatcaggttatcagagtgtcctttagcaacctgttcaaagagttcaaaagcacggccacttggttgcagttcccactggttctggaggctcgaactcctcagcgagacctggttggactggccccatctggcgcacgttggacttgcctgcaattggatcttcaagacgtactgttggtgtatctcaaccggtgttacgggcacctcaagtccattaggctctgtgcgtccttactggtgaggaatctatataccagcgatctgtgcttcgagcctgccattagcggcgctcagtgggctaagctgcccgtcacaccaatgcctcgggaaatggcatttcccgttccgaaaggcgaatcttggcacgacaggtatattcacgtacggttcccatccgagagcctgaaggttcctagtaagcccatagagaagtcctgttcaccgcctgaggccgttttgcttggccctggaccacaacctcttccttgtccagttgcttcttccaaaccagtgcggtttagcgtaagccccgtcgtccaaactccatcacctactgcatccggccgagcagccctggccccacgtccttttccggaggtctccctttcccaagagcgtagtgatgccagtaacgctgatggtcctgggttccatagcctcgaaccgtgggcacagctggaggcctccgatattcacacggcagccgctggcactcacgtgcttacccatgagtccgcagaagtacctgtggctcgtaccggctcctgtgagggcttcctccctgatccggttttacgccttaaaggcgtgataggatttggtggtcacggaacacgccaagctctctggactccggacggggctgctgtggtgtatccatgtcacgctgtgattgtcgtgctgctggtcgatacaggcgaacagcggttcttccttggtcacacggacaaggtgtcagccctggccctggacggttcatcctctttactggcctccgcgcaggcacgagcaccgtccgttatgcgtctctgggactttcagaccggtagatgtttgtgtctgtttaggtcaccgatgcatgtggtatgttctctcagcttttcagatagcggtgctctcctttgcggcgtgggcaaggaccaccacggcaggaccatggtggtggcctgggggaccgggcaggtcgggctaggaggagaggtggtggtgctcgcaaaggcccacacggatttcgatgttcaggcctttcgtgtcaccttctttgatgaaaccagaatggcgtcttgtggacagggaagtgttcgactctggcgtttgcgtggaggagtgcttcggtcctgtcctgttgatttgggtgaacaccatgccctgcagtttacagatctcgcgtttaagcaggccagggacgggtgtcccgagccttcagcggcaatgttgtttgtgtgcagtaggtccgggcacatcttagagatcgattgccagcggatggtagttagacacgccaggcgtctgctgccaactcggacgcctggaggaccccacccacagaagcagacctttagttcggggcctgggatcgcgatctcttccctgagtgtttctccggcaatgtgcgctgtggggagtgaggacgggttcctacggctgtggccactggacttttcttccgttttgctggaagcagaacatgaaggccctgtgtcatccgtatgcgtgtctcccgacgggctaagggtgctgtccgcgacctcttccggtcatttgggtttcttagatactctgtctcgcgtataccacatgctcgctagaagccacaccgcacccgtcctggccttggcaatggagcagagaagaggccagctggccacagtttctcaggacaggactgttagaatttgggatttagcaacactccagcagttgtacgacttcacatcttcagaggatgctccgtgcgctgtgacgtttcatcctacacgcccaactttcttttgtggcttctcctctggggctgtgcgaagtttctcactagaggctgccgaggttcttgtggagcacacatgccataggggcgctgtgacaggtcttaccgcgaccccagacggcagattgcttttttcctcatgtagccagggttctctggcccagtactcttgcgcagatccacagtggcacgtcttacgggtggccgcagatatggtgtgccccgatgctccggcaagcccgtctgcccttgcagtgtcccgcgacggaaggttgctggccttcgttggcccatcccgatgcactgtgaccgtgatgggaagtgcctccttggatgagctgcttcgcgtcgatatcggcactttggatctggcgagttcacgacttgactctgccatggccgtgtgttttggacctgctgccctgggtcacctgttggtgagcaccagctccaaccgagtcgtagtcctggacgcagtttctggtaggatcattcgggagttgcccggagtgcatccagagccctgtccctctttgactttatctgaggatgccaggttcctactgattgctgccggtcggactattaaggtttgggactatgcgacgcaagcttctcctggaccgcaggtgtatattgggcatagtgagcctgtccaggcagtggctttctcgcccgatcagcagcaggtattgagcgccggagacgcagtcttcctgtgggatgtgttggcgccaacagagagtgatcagagtttccctggcgctcctcccgcatgcaagacaggaccaggcgctggtccactggaagacgctgcatcccgggctagcgagttacccagacagcaggtacctaaaccttgtcaggcctctccccctcggttgggtgtgtgtgccagacccccagaaggcggtgacggagcaagagacacccggaactccggggcaccccgaacgacatacttggcctcttgtaaggccttcactccagcacgtgtatcatgtagcccacactccgctaaaggcacttgtcctcctcctgctagtgggggatggttaaggctcaaggctgtagtgggctactccggtaatggcagagctaatatggtgtggcggcctgacacgggcttctttgcctacacatgcggtcgcttagtcgttgtagaggaccttcacagcggagctcagcagcattggtcaggtcacagtgccgaaatatccacattggctctgtcccatagtgctcaggtgctggcctcggcaagcgggcgttccagcacaacggcccattgccaaataagagtctgggacgtaagtggcggtctctgtcagcatctgatatttcctcactctactacagtgcttgctctggcctttagtccagacgatcggctacttgtgacactcggtgatcatgatggccgaacactggcactgtggggcacagccacctatgatctggtgtcaagcacccgcctgccggaacccgtgcacggcgtggcattcaacccttgggacgccggagagttaacatgcgtcgggcaaggcaccgtgacattctggctgttgcaacagcgcggagccgatatttccctgcaggttcgccgagagcccgtgccagaagcggtgggagcgggtgagctaacaagcttgtgttatggggctcccccattactctactgtggtacttcctcaggccaggtctgcgtgtgggatacacgggcaggcagatgtttcctctcttgggaagcagacgatgggggaatcgggcttttactattctccgggtctcggctcgtttcaggcagctcaaccggaagactgcgcctgtgggcagttggcgcagtgagcgaattgcgctgtaagggcagcggggctagctctgtcttcatggagcacgagttggtcctagatggagctgttgttagcgcctcctttgacgacagcgtggacatgggagtggtaggtaccactgccggaaccctctggtttgtgagctgggctgaggggacatctacacgccttattagcggtcacaggagcaaggtgaatgaagttgtgttctcccctggagagagccattgtgctacctgttccgaggatggatccgttcgcgtgtgggcattagcctctatggagcttgtaatacagttccaggttttgaatcaaagctgcctgtgcctagcatggtcccctccatgctgtggcagacccgagcagcagaggttagcagcagggtatggagacggctcgctgagaattttttctgttagtcgcaccgctatggagctcaagatgcatcctcaccctgtcgccttaaccactgtggccttttcaacagatggccagactgtgctgagtggcgataaggatggattagtggccgtatcacacccctgcacaggtacaacatttcgggtcctgagcgatcaccagggggcacccatttcaacaatctgtgtcacatgtaaagaatgcgaggacttaggagtggaggggacagatctgtggctcgctgctagcggcgatcagcgcgtcagcgtgtgggcctccgactggctcaggaaccattgtgagctcgtggattggctgtcttttcccatgcctgccactaccgagacccaaggacacctgccaccatcactcgcggctttttgtccttgggacggcgcactgctgatgtacgttggcccaggggtgtataaagaggtgattatttataatctctgccagaagcaggtcgttgaaaagattccactgccattcttcgctatgtcattgtccctgtctccaggcacacatctgttagccgtggggttcgctgaatgcatgttacgtctggttgactgcgccatgggtactgcccaggacttcgcagggcacgataatgcggtgcatctgtgcagattcacgcctagcgccaggctgcttttcaccgctgcaagaaatgagatactagtctgggaggtgccagggctttag

SEQ ID NO: 61169 - DNA, 1911 bp, Artificial Sequence
  Description of Artificial Sequence: Synthetic coding sequence
atggccgaggcggtggaacgtaccgacgaactcgtgagagagtaccttttatttcggggttttacacataccctgcggcagttggatgccgaaatcaaggccgacaaagaaaagggctttagggtggataagatagtagatcagctgcaacagctgatgcaagtgtatgatctagctgccctgagggattactggtcatatctagaacgaaggttgttctcacgcctggaagacatctatcgcccaaccatccacaagctgaagacgtcccttttccgcttttacctcgtgtacaccattcagactaatagaaatgataaagctcaggagttttttgctaagcaggcgacggagctgcaaaaccaagccgaatggaaagactggtttgtcttgccctttctccctagtcccgacactaatcctaccttcgccacctacttctctcggcagtgggcggatacgttcatcgttagccttcacaacttcttgtctgtgttgtttcagtgtatgccagtcccagtgatcctgaacttcgacgccgagtgtcagagaaccaaccaagtgcaggaagagaacgaggtgctgaggcaaaaactcttcgcactccaggccgagattcaccgcctgaagaaggaagagcaacaaccggaagaagaggaagcactggtccaacataagctgcctccatacgtgtccaacatggaccggctcggagatagcgaactggccatggtgtgttcacaaagaaacgcctcgctcagccagagtccgagagtgggtttcctctcatctttacttccgcagtctaagaagagccccagtcggctatcccccgctcagggcccaccccagccacagtcttctgccaaaaaggaatcttttggagggcagggcaccaaaggcaaagatcccacaagcggtgcaaaagatgggaaatctctgctttctggtcttgccactggagaatcaggctggagccagcaccggcagcgtcggctccaggatcatggcaaagaacggaaggagctgttttccactacgacatcccagtgtgcagaaaaaaaacccgaagcctcaggaccggaagcagagccctgtcccgaactacataccgaacctgttgagcccctcacgcgggcaagctctgctggtcccgaggggggtggagtcaggccagagcagccctttatagtcctcgggcaggaggaatatggcgagcatcactccagtattatgcactgtagagtggattgctccggacgcagagttgcctcgttagacgtggatggggtcatcaaggtttggagcttcaaccccatcatgcagactaaggcttccagcatctccaaatcgcctctgctcagcctcgaatgggctactaagagggacaggcttcttctgttaggatcaggcgtcggaacggtgagactgtacgacacggaggccaagaagaatttgtgtgaaattaacatcaacgataacatgcccaggattctgagccttgcctgtagtccaaacggcgcatcctttgtctgcagtgcagcagcaccatctttgacctcgcaggtggacttctcagcccctgacataggaagcaaaggcatgaaccaggtacccggaaggctgctgctctgggacaccaaaacaatgaagcagcagctgcaattcagtctggatcccgagcctatcgctattaactgcactgcatttaatcataatggcaacctattagtcacaggagccgctgacggtgtgatacggctgtttgtgcatccagtagaacaccctcaggagtggcctcagggaattagggtacagcctccgctgagatgccacggcccactctgtgccgtttggattcagcgcctccaggccggatcaagcccccaggggccaacgttgaggttctag

SEQ ID NO: 61170 - DNA, 2244 bp, Artificial Sequence
  Description of Artificial Sequence: Synthetic coding sequence
atggctgaagcagtagagcgaacggatgaactggtgagggaatatttgctgttccgcggatttacacatactctgcgacagttagatgccgaaattaaagctgataaggagaaaggcttcagggtcgataagatcgtggaccaactccagcagctcatgcaagtgtacgatcttgccgctctgcgggattactggtcatatttagaaagacgactttttagcaggttggaagatatctataggccaaccatccacaagttaaaaacttctctgttccgcttttatctcgtgtacacaattcagactaatcggaacgataaggcccaggagttcttcgcaaaacaggctaccgagctgcagaaccaggctgagtggaaagattggtttgtgctgccgttcctgcctagcccagatactaacccaactttcgctacatacttcagccgccagtgggccgatacattcattgtcagcctgcacaatttcctttccgtactgtttcagtgcatgccggtgcctgtgatcctcaacttcgacgccgaatgtcagagaaccaatcaggtgcaagaggaaaatgaagtcctgagacagaaactcttcgcactgcaggccgaaatacatcgtctaaaaaaggaggaacaacagcccgaagaggaagaggcgctggttcaacacaaactcccgccttacgtttccaacatggacaggttaggcgattcagagctggctatggtgtgttcacaacggaatgctagtctatcgcaatctccaagagtcggttttctgtctagtctgctgcctcaatccaagaaaagcccaagtagactatcccctgcacagggacccccacagccacagtcttcagccaaaaaggagtctttcggcggacaagggaccaagggaaaggaccctaccagcggagcgaaggacggcaagagtctgctctccggcttggcaaccggggagagcggctggtcccagcacaggcagagaagattgcaagaccacggtaaagaaagaaaggagctgttttctactactaccagtcagtgtgcagagaagaaacctgaggctagcggcccagaggcagagccctgtcccgagctgcatactgagcctgtagaaccactgacacgggcatcttccgcaggtccagagggcggaggtgtgaggcccgaacagccgttcatcgtactggggcaagaggaatatggggaacaccactctagtataatgcattgccgggtggactgttccggcaggagagtggccagtctcgatgtggatggagttatcaaagtgtggagttttaaccctattatgcagactaaggcctcaagtatatccaaatctccccttctatcactggaatgggcaacaaagcgagatagactgctactgctgggtagcggggtgggtactgtcagactctacgacaccgaggccaaaaaaaacttatgcgagattaatatcaacgataatatgcctaggatcctctccctcgcctgttccccaaatggggcatcattcgtttgctctgcagcggctcctagccttacttctcaggtcgatttctcagcccctgacatcggttcgaaggggatgaaccaggttcctggcaggctgttgctgtgggatactaagacaatgaagcagcaactccagttctctctggatccggaaccgatcgctatcaactgtacggccttcaaccacaatgggaaccttcttgtgacaggtgccgcagacggcgtcatacggctattcgacatgcagcagcacgagtgcgctatgagctggcgggcacattacggcgaggtctactcagtggagttttcttatgacgagaacaccgtgtacagtatcggagaagatgggaagttcatacagtggaatatacacaaatctggcctgaaggttagcgagtatagcctgcccagcgacgctacagggccttttgtgctgagcgggtacagtggctacaagcaggtgcaggtcccgagaggccgtctgtttgcctttgactcagaaggcaactatatgctgacttgctccgccactggcggtgtgatttacaagctcggcggagatgaaaaggttctggagagctgcctcagccttggcggacatcgggctcctgtggtcaccgtggattggagtaccgctatggattgcggcacctgtctcaccgcttctatggacggaaaaattaaactaacgaccttgcttgcccataaagcttag

SEQ ID NO: 61171 - DNA, 2613 bp, Artificial Sequence
  Description of Artificial Sequence: Synthetic coding sequence
atggccacaaacattccgtgtgaggtggtcgcgttctccgaccgcaagcttaagcccctgatctacgtctactctttccccggacttactaggcgtactaaactcaagggcaatatactccttgactacaccctgttgtctttttcttattgtgggacatatctggccagttatagctcacttcctgaattcgagctggcgttatggaactgggagtcctccatcattctctgtaagaaatctcagccaggtatggatgtgaaccaaatgtctttcaatcctatgaattggcggcagctgtgcctgtcctctccatcaactgtttctgtgtggaccattgaaaggtccaatcaggaacattgctttagagctcgaagcgtaaagctgccgctggaagacggctccttcttcaacgaaaccgacgtggtgttcccacagtccttaccaaaagacctgatctatggacctgttctgccacttagcgctatcgctggacttgtgggcaaagaggcagagacattccgccctaaagacgacttataccccctgctgcatcctaccatgcattgttggacacccacctctgatctgtatatcggctgtgaagagggacacctgcttatgatcaacggggacactcttcaggtgactgttctcaataaaattgaggaagagtccccgctcgaagatcgtcggaactttataagccctgtgactcttgtctatcagaaggagggggtcctggcctctgggatcgacgggtttgtttatagcttcatcattaaggacagatcctatatgatcgaggatttcctggagatcgaacggccagtggaacatatgacgtttagcccaaactataccgtgcttctgatccagacagacaaaggatccgtgtatatctatacattcggaaaagagcccactctcaataaggtgctcgacgcttgtgacggaaagttccaggccatcgatttcattacccctggtacccaatatttcatgactcttacctatagtggcgagatctgcgtctggtggctcgaagattgcgcttgcgtgtccaaaatatatttgaatacgctcgcaaccgtgctcgcatgttgcccaagctccctgagtgccgcagtgggaaccgaggatggatccgtttacttcatttccgtgtacgacaaggaaagcccgcaggtggtacataaggcgtttctgtctgagtcctcagtccagcacgtagtgtacgatcagcaggggatcttcctgttagtaggaacagccgaaggaaaggttttcattatcaacgccaactcttctagctcgttccagataattggatttaccgaagtcgccaaggatattctgcagatctcaaccgtgtccctcttggaaacggatatcgtcgaggttatggttctgtcctccttgcccgaggccggtcgaagtcgcctcgaaatgtttacgttgcctacgttactcccacaggtcagcacaactttcgctgacgagcggggaagactgaaggatgaaatcatccacaagtacctgtatgagctcgagcacgcacttagtagcgctgttctcggcttccaaagcaatcaaatttatggattctgtagccaggtgccatacatctgcagttatctgctgcccgaggaggagcatacgggtatctacatcctgaagccctataagaaggttcaaagtagacagtacggaccaggtctcctgtacctgtcctcacatggactgtggctgattaccatcgccaagtgtggaattctctgcatcagagatgtctatactttagaaactttcgcttggtgtcgctcccactctcatcaagggcatggaatccaatctatgaggatctccatggacggacaaaacatactcgtgaatggtcgcgacgatggaactctcgtgtatctcaagtggaaacgcttcgggggacatctcgccagtgagatccttgactattaccaaaaactcctcatatcacttagttcggccatggacaaagagaatcactatttgtctaccacacccaaggtgtcagtcgacctgggctctgatagtgaacacactaaacagaaggcaagcaccgacctgtcacaggacgagcttgtgcttacagacgtgaagaaagagatcccctggatccaacagaagtcacaggaggctatcaaaaaggaagtcaatttgttttctaaaaagcgcaaggagattaagcagggcatcaagtcactgtcaaaaacaattcttaacatgatggaggagaatgacaagctggaaaacattgcaaaactggaccagcaggagttcgggttggacctggaagaactggagagactgcatgacgagagccaggaggaagtggcaaaaatgatcaaagacgtggagatgcacaatttggccaagagttaccttgccgagctgattaaagaggaatgctggaattctatggctgtcaagggtagggccttgaaatgctttcacatcccctgcgtggtggagaacttccccatgaaagccaggaccgtggaggaactgaaggaactcgagcgggttctgcagcagaagaagattgaggctgaatgcctgaaggttctgttttag

SEQ ID NO: 61172 - DNA, 4998 bp, Artificial Sequence
  Description of Artificial Sequence: Synthetic coding sequence
atggcccagggacgggaaagggacgagggacctcatagcgccggaggagcaagtctgtccgtgcgctgggtgcagggctttcccaaacagaacgttcacttcgtgaacgataacaccatctgttacccgtgtggcaactacgtaatattcatcaacatcgagacaaaaaaaaaaactgtgcttcagtgttcaaatggaattgttggtgtcatggccaccaatatcccttgcgaggtggtcgctttttcagataggaagctgaaacctcttatctacgtgtactccttcccaggcctcacccgcaggaccaaactcaaagggaacatactgttagactacaccctactatcattctcttattgtggcacctatttagcttcttacagctccctgccagagttcgagttggctctgtggaattgggaaagttccatcattctctgcaagaaaagtcagccgggtatggacgtgaatcagatgtctttcaatcccatgaattggcggcagctctgtctttcttccccctccaccgtctcggtgtggaccattgaaaggtccaaccaagagcactgcttcagagctaggagcgtcaagttgcctctggaggatggatccttttttaacgaaaccgacgtcgtcttccctcagtctcttcccaaagacttaatttatggcccagtccttcctctgagtgcgatcgccggattagtgggaaaggaggcagagactttcagaccaaaagatgacctatatcccttgttacatccaaccatgcactgctggaccccaacatctgatttgtatatcggctgtgaggaagggcatctgctgatgatcaacggcgataccctgcaggtgacagttctgaacaaaattgaagaagagtcccccctcgatcgcagaaactttatatcaccagtcactttagtatatcagaaggagggagtactcgcgtcaggtattgacggattcgtgtattcattcatcattaaagatcggtcatatatgatcgaagattttttagagatcgaacgcccagttgagcacatgacattttccccaaattacacagtgctgttaatacaaacggacaagggatcagtgtacatatacactttcggaaaggaaccgacccttaataaagtgctggatgcatgtgacggcaagttccaggcaatcgatttcatcacaccgggaactcagtattttatgacccttacatattccggtgaaatatgcgtgtggtggctggaggattgtgcttgtgtaagtaagatctatcttaacacgcttgcaacggtgctggcctgttgtccgagctccctctccgctgccgtgggcacagaggacgggtctgtttactttatcagtgtgtacgacaaagagagtccccaagtcgttcacaaggcattcctgagtgagtcatccgtgcagcacgtcgtatatgaccaacaggggatcttcctgctggtcgggaccgccgaagggaaagtttttattatcaacgctaactctagcagctcatttcagatcatcgggttcacagaagtcgccaaagatattcttcaaatttccactgttagcctgctcgagaccgatatcgtggaggtaatggtgctcagtagcttgcccgaggccggacgcagtagactggagatgtttaccctccctactttgttgccacaagtatccacgacatttgccgatgaaagagggaggctgaaggacgaaatcatccacaagtacctatatgaactggagcacgctctgtccagcgccgtattaggtttccagagtaatcagatctatggattctgctcacaggtgccatatatttgtagctatctgcttcccgaagaagagcacaccggaatttatattctaaaaccttataagaaagttcagtctaggcagtacggacctggacttctgtacctgagcagtcacggcctgtggctgataacaatcgcaaagtgtggcatcctgtgtatccgtgacgtgtacaccctcgagaccttcgcatggtgcagatcccacagtcatcagggacatggcatccagtcaatgcggatctctatggatggccaaaatatactggtgaatggtcgagatgacgggaccctcgtgtatttaaagtggaagcggtttgggggacacctcgcctcagaaattctggattactatcagaaactcctgattagcctgagcagtgccatggataaggagaatcattatctgagcaccacccctaaggtaagcgtggatctcggctctgattctgagcacacaaagcagaaagccagtaccgatctcagtcaggacgaactcgtcctgaccgacgtcaagaaagaaattccatggatacagcagaagtctcaggaggctatcaaaaaggaggttaacctctttagcaagaagcgcaaggaaatcaagcagggaatcaaaagcctttctaagaccatactgaatatgatggaggagaacgataagctggaaaatattgctaagctggaccagcaggaattcggactggacttggaggaactcgagagactgcacgatgagtcacaagaagaagtggcaaaaatgattaaagacgttgagatgcacaatctagctaaatcttacctcgcggaacttatcaaagaggaatgttggaactccatggccgtaaaaggccgagcactcaaatgctttcatattccttgtgtcgtggagaatttcccaatgaaggctcgtactgtcgaggagctcaaggagctcgaacgggtactgcagcagaagaagatagaggccgagtgtctcaaattaagaaaagagatagtagaggctcaaagtggcgttaaactaatcaagcagagacatgaggaggacgatgaggaggaggaggaggaagacaaaactgtgaagtactccaatctgcccaattacctgctaggctccctcagcaccgactttggagttgacacatctctgcttagcagtcaactcgagctgcactctcgggaggaaaagatcaaccagattattctgctgaaagatatcatttataaggtgaagacggtatttaataacgagtttgacgctgcctataaacaaaaggagttcgagatagcgagagtcaaagaaaggaacgtgagaatacgagagattattttggaccttgagcttgaggaggctgtttggcagcctgagtttgaggactgtgagaagcccgagcgcacgctcgtggtacaggacgaggaaatcacagctcacaagcatattaaaccatggcataaggccaaagaactgatagtgaaccatgaaaaagaacattggcttctgattcaagacgcaagcacgcgcctcagggcactcatggacatgatgggcggagtgttagaggtgaagaaagaggatatactgaggatggttatccctcagccggcttttatggctaagccagatgccgtgtggaccgaagaagagagaaagcagttcaaggactatgaaaaaaaggtcaaggagttgaacgaggaaagagataagtaccgcaaaagcttggaagccgaactgaagaaactgcagaacagtatccaggaatcgacacaggcttttgacgagcatctaaaaagattgtttgagcgcagggttaaggccgagatggtaactaaccaagaggagctgaaaattagcaatctggcctttagcctgctgttggatgaagaactgtcgtctagagagaagttcctgaacaactacttgaccagaaagcagcatgaaaagtctcagacttccgaagcagtacgaaaatctagggaagatctcgacgtgtgcaaggaacactacgacaacttgctggccgaagataaggtgatggaccgctcttttaagaaggaattcagcgaaatccccggacaccaggtggacatcctgtacaaactgtttaagcggagacctagaattagcaaacagaaaactcattccgaaacaacctcagtcgtgcctttcggcgagcttccaggctcaggaaagctgaacaaggacgctttcgcgcagttgatgaaagccatggacgaactagataacatctctaacatgcccgagggtctcgacccgctggtgtggaatcacttctgcatgacaagaagagccaaagtggagaatgagcaaaaggttaagcagaaagccgcagatttgctggaaatggcaacatttttacagaagcgcgtggaggaagaagagaaggtgcaacaggagatcgagcgtgtcttccacgaactgatacttctgcaagaagagaaggtcaggtttcaattaaaccttaccatacagattctactcaaacaaggacaggttgaactggagaatttccagctcgttctcgagtacagcgacgccatactgatcaacaaaaacatcatcgaggaccttaattccgtgattcgtacccagggccaaaagaaagtggcatcgatgatggaatccaaagacgtccataagaggatcctgcagatcgaatgggaacacaagaagatggagatggagcgcgaggatctgaatcagaaagcctgggatatccagatgctctttttctcccgcgatcggcagaagtaccttaatgaacctaattatgaggctctgatctccatccagatcggtataatggaacagactattgccgttcttgataaaatgcacaaaaagaatgttgagaactgtaaaaagctcctcaagaagctcgggaaattcagtaatcagaaggatatcgctaactacgctctgagctgtaatctgagagaagagctcgttgcggtaagcgaacggaaagatatctgcaatgcaatgggcagcaaactgacctgcgaaaaaatagtgaaggagcgctatgaaaacatgatgcagcagcagaagttaaccaacatatctaaacagcaggcagaacaaatctcaatcctacaaactgaagtggaacgcctgcgaatgaagacttttcctgccctagttcaaatgtag

SEQ ID NO: 61173 - DNA, 912 bp, Artificial Sequence
  Description of Artificial Sequence: Synthetic coding sequence
atggccactaatatcccatgcgaagtagtggcgttctcagaccggaagctcaagcccttaatttacgtgtattcgttccccggtctaacacgtaggactaagttgaagggaaacattctgctcgattacacactattgagtttttcttactgtgggacctacttggcaagctacagctccctcccagagttcgagctggccctctggaattgggaatcatccattattctgtgtaagaagagccagcctggcatggacgtgaatcaaatgagcttcaatcccatgaattggcgccagctgtgcttatcctccccctccactgttagtgtgtggacaattgagcggagtaatcaggagcactgcttcagggctagaagtgtgaaattgccattagaagatggaagcttcttcaacgaaacggacgtcgtgttcccacaatccctgcccaaagatctcatttatggacctgtgttgcccctctccgccatcgctggactggttgggaaagaggctgaaacgtttcggcctaaagacgacctttatccactgctgcatccgactatgcactgctggacacccacctccgacctctacattgggtgcgaggagggccacctgctcatgattaatggcgatacattgcaggtcaccgtcctgaataagatagaggaggagtccccccttgaggacagacggaacttcatcagccccgtgacactggtgtaccaaaaggagggcgtgctggcttccggtatcgatggctttgtctactcttttattattaaagacaggtcctatatgattgaggacttcctagagatcgaacggcctgtggagcacatgactttcagccccaactataccgtcttgctgattcagaccgataaagtgtgttggatggtgatttcctag

SEQ ID NO: 61174 - DNA, 1239 bp, Artificial Sequence
  Description of Artificial Sequence: Synthetic coding sequence
atggcaacgaatatcccttgcgaggttgtagcctttagcgaccgaaaactcaagccactcatctacgtctattcatttcccggactcacgaggcgcactaagctcaagggcaatattttgctcgactacacactgctgagcttttcttattgtggtacttatctggcctcttactcatccctgcccgagttcgagcttgctctatggaactgggaatctagtataattctgtgtaaaaagtctcagcccggaatggatgttaaccagatgtccttcaatcccatgaattggcgacagctgtgtctgagctccccatccacagtcagcgtgtggacaatagagcggtccaatcaggagcattgcttccgggctcgctcagtcaaattgcccctggaggatggaagtttttttaacgaaaccgacgtggtgttcccccagagcctccccaaagatttaatctacggcccagtgttgcccctcagcgctattgccggactggtaggcaaggaggcagaaacgttcagacccaaagatgacctgtatcccctgttgcaccccacaatgcattgttggaccccaacctccgatctctatattggatgtgaggagggtcacctgttgatgatcaatggcgacacactacaggtgacagtgttgaataaaatcgaggaggagagccctcttgaggacaggcggaatttcatcagccccgtcactctggtttaccagaaggaaggcgtgttggcaagcgggatcgacggttttgtctactccttcataattaaagatagaagttacatgatcgaagactttttagagatagaacgccctgttgaacatatgaccttttctccaaactacaccgtgctgctaattcagaccgacaagggatctgtttacatttacacatttggcaaagagccaaccttgaataaggtgcttgacgcttgcgacgggaagtttcaggcgatagacttcatcactccaggaacacaatattttatgacacttacatactccggtgaaatttgcgtgtggtggcttgaagattgtgcatgcgtatccaagatctatttgaacactctagcaaccgtgctggcttgttgcccgtcctctctcagcgcggcagttggaactgaagacggctctgtttactttattagcgtttatgataaagaatcaccacaggtagtgcataaagccttccttagcgagtcttcagtgcagcatgtggtctag

SEQ ID NO: 61175 - DNA, 4914 bp, Artificial Sequence
  Description of Artificial Sequence: Synthetic coding sequence
atggctcagggtagagagagagacgagggtccccatagcgcaggaggagcttcactgagcgtgcgttgggtgcagggcttcccgaagcagaatgtgcattttgtgaatgacaacactatttgctacccctgcgggaattatgtcatttttattaatatcgagacaaaaaagaagacggtgcttcaatgttcaaatggcattgtgggcgtgatggccacgaatatcccctgtgaagtggtggccttttccgaccggaagttaaagcctttgatttatgtgtattctttccctgggctcactaggcgaacgaagctgaaaggcaatattctcctggactacactctgctcagctttagttattgtgggacataccttgcctcatatagttcgctccctgaattcgaattggccctttggaactgggaaagttctattatcttatgcaagaaaagtcaacctggcatggatgtgaatcagatgtcttttaatccaatgaattggagacaattatgcctcagcagcccctccaccgtctctgtctggactattgaaaggtcaaatcaggaacactgcttcagggcacggtccgtcaagttacccttggaagatggcagcttctttaacgaaacagacgtagtgtttccacagtctcttcctaaggacctgatttatggcccagtccttccactgagcgccattgctggccttgtgggtaaggaagcagagacatttaggcccaaggatgatctctatcccctcttgcaccccaccatgcactgctggaccccaacaagcgacctgtatattggctgtgaggagggacacctgcttatgatcaatggcgatacattacaagtaaccgtgctgaataagattgaggaagagtcccctctggaagaccgtcggaactttattagccctgttaccctggtgtatcagaaggagggggtcttagcctcaggtattgacggctttgtatactcatttatcattaaggatcgatcttatatgatagaagacttcctcgaaatcgagcgcccagttgagcacatgacattctctccaaattacacagttctgctgatccagacggacaagggtagcgtttacatctatacctttggcaaagagccaactctaaacaaagtacttgacgcatgtgacgggaaattccaggcaatagatttcattacacccggaacccagtactttatgacgctgacctactccggggagatctgtgtatggtggttagaggattgcgcatgtgtgagtaaaatctacttaaacacactggcaacagtcctggcatgctgcccgtcatcactctcggcagccgtgggaacagaggatggcagtgtgtatttcatctccgtatacgataaagagtccccacaggtagtgcacaaggccttcttatccgagtccagcgtccagcatgtagtttacgaccagcaggggatcttcctattggtcggcaccgccgagggtaaggtgtttataatcaatgctaactcctcctcatcttttcagatcattggattcaccgaggttgccaaagacatattgcagatttcaaccgtgtccctattagagacagacattgttgaagtcatggtgctgagctccctgccagaagcaggaaggtcgaggctcgagatgttcaccctccctacactgctccctcaagtttcaactactttcgccgacgagcgcggacggctaaaagacgagatcatccataaatatctatacgagttagagcacgccctgtcaagcgctgtacttggcttccaatccaatcagatctacggcttttgcagtcaggtgccttatatctgttcctatctgctcccggaggaggaacacacgggcatctatatcttaaaaccatataaaaaggtacagtctcggcaatatggacccggacttctctatttgagctcccatgggctgtggctgattaccatcgctaaatgtggtattctttgcatccgagatgtctatactctagagactttcgcatggtgtagaagccacagccatcaagggcatggcatccagtccatgagaatatccatggacggacaaaacattttagtcaacggcagggatgatggcactttggtgtacctgaagtggaagagatttggaggacacctggcctccgaaattctggattactaccagaagctactgattagtctgtccagtgcaatggacaaggagaaccactatctcagcacgacacccaaggtgtccgtggatctgggctcagacagcgaacacaccaaacagaaagcatccactgatttgtcccaggacgagctcgtgctgacagacgtcaagaaggagatcccatggattcagcaaaagtcccaggaggcaatcaagaaggaggtcaacctctttagtaaaaagagaaaagaaattaaacagggtattaagagtctctcaaagaccatcttaaacatgatggaggagaacgataagctcgagaatattgctaagctggaccagcaagagttcggtctcgaccttgaagagttggagagactgcacgatgagagccaggaggaggtagcgaaaatgattaaggatgtggagatgcacaacctggccaagtcctatcttgctgaattgattaaagaggaatgttggaacagcatggcagtgaaaggcagggcactcaagtgttttcatataccttgcgtggtagagaatttcccgatgaaagctcgaacggtggaggagctcaaggagctggagcgagtcctgcagcaaaagaagatagaggcggaatgcctcaagttaaggaaggaaatagtggaagcccagtccggcgtcaaattaatcaagcagcgccatgaggaggacgacgaggaagaagaggaggaggacaagactgtcaagtactctaacctgcccaactacttactgggctctttgagcaccgattttggtgtggacacatctctactgtctagccagctagagttacacagtcgcgaagaaaagattaatcaaatcattctgctaaaggatattatttataaagtgaaaactgtgttcaacaatgaattcgacgccgcttacaaacaaaaggagttcgaaatcgccagagttaaggagcggaacgtgagaatcagagagatcattctggatttggagctagaagaagccgtgtggcagccagagttcgaggattgtgagaaacccgagaggactctcgtggtgcaagacgaggaaataaccgcccacaagcatatcaagccatggcacaaagccaaagagctgatagtaaaccatgaaaaggagcattggctgttgattcaggatgcgagcactaggctgcgcgcacttatggacatgatgggaggagtcttggaggtgaaaaaagaggacatcctgaggatggtgatcccccagccggcatttatggcgaaaccagatgcagtctggactgaagaggaaaggaaacaattcaaagattacgagaaaaaagttaaagagctgaacgaggaaagggacaagtatcgaaaaagcctggaagctgagctgaagaagctgcaaaacagtattcaggagagcacccaggcctttgacgagcacctgaagcggctctttgagaggcgggtcaaggccgagatggtgaccaaccaggaagagttaaagatatccaacctggctttttcactactgcttgacgaggagctctccagccgggagaaatttttgaacaactacctgacccgcaagcagcacgaaaaggtgatggaccgcagctttaaaaaggaatttagtgaaattccaggccaccaagttgatatactgtataaactgttcaagcgccgtccacgtatttcaaaacagaaaacccacagcgaaaccacatccgtcgtacctttcggcgagcttcccggttcagggaagcttaacaaagacgcctttgcccaattgatgaaagcaatggacgagctcgataatatctcaaacatgcctgagggtcttgatccgctggtgtggaatcatttttgcatgacgcgccgtgccaaggtggagaacgaacaaaaggtaaaacagaaagctgcagatctgctggaaatggcgacatttttacagaagagagtggaggaggaggaaaaagtccagcaagaaatcgagagagtgttccacgagctgatacttcttcaggaggagaaagtgcgcttccagctgaacctgacaatccagattttactaaaacagggacaggtcgagcttgagaactttcagctcgtgttggaatacagcgacgccattttgatcaataaaaatatcattgaggacctcaactccgttatacggacacaagggcagaagaaggtcgcctcaatgatggaatcgaaggacgtgcataagagaattcttcaaatcgagtgggaacataaaaagatggaaatggagcgggaagatctgaaccaaaaggcttgggatattcagatgctctttttctccagggacagacagaagtatctgaatgagcctaattatgaggctcttatttcaatccaaattggaatcatggagcaaacaattgcggttctggataaaatgcacaaaaagaacgttgaaaactgcaaaaagttgctgaagaagttaggcaagtttagtaaccagaaagatattgcaaattatgctctgtcctgcaacctgagagaagagctggtcgcagtgtccgagcgaaaagacatatgcaacgcaatggggtccaagctgacctgtgaaaagattgtcaaggaaaggtatgaaaacatgatgcagcagcagaagctgactaatatcagcaaacaacaggcagagcaaatttcgatccttcagacggaagtcgaaaggctccgaatgaaaaccttccccgctttagtgcaaatgtag

SEQ ID NO: 61176 - DNA, 2994 bp, Artificial Sequence
  Description of Artificial Sequence: Synthetic coding sequence
tagcccggtctgctctatctatcttcccatggcctctggcttattactatagctaaatgtggaattttgtgcatcagggacgtgtataccctcgaaaccttcgcctggtgccgcagccactctcatcagggacatggaatccaatcaatgcggatctctatggacggacaaaatatcctcgtaaatggtagggatgacggtacactggtctatcttaagtggaaaaggttcgggggacatctggcttctgagatacttgactattatcagaagctgctcattagcctaagctcagctatggataaggagaaccactatctctcaaccacaccaaaggtgagcgttgatctgggctccgacagcgagcatacaaagcagaaggccagcacagacttgtcacaggatgagctcgtgttgacagatgtaaagaaggagatcccatggattcagcaaaagagtcaggaggcaataaagaaggaggttaacttattcagcaagaagcggaaggagatcaaacagggaataaaatccctctcaaaaaccattctgaacatgatggaggagaatgataagctggaaaatatcgccaagttagaccagcaggaatttggcctggacctcgaggaacttgaaagattacacgatgaaagccaggaggaggtggccaaaatgattaaagatgttgagatgcataacctcgcgaagtcttatttagccgaactcatcaaggaagagtgttggaattccatggccgtgaaagggcgtgccctcaaatgttttcacataccatgcgtagttgaaaattttcctatgaaagccaggactgttgaggaactgaaggaactggagagagtgctgcagcaaaaaaaaattgaggccgagtgtctgaaactgcgcaaagagatagtcgaagcacagtcaggggtgaagctgattaaacagcgccatgaggaggacgatgaggaagaagaagaagaggacaaaacagttaaatattctaacctgccaaattacttactgggttcccttagcacagacttcggcgtggatacaagcctgttgtcaagccagcttgaattgcattctcgggaggagaagattaatcagatcattctacttaaggatattatttataaagtgaaaacggtgtttaataacgaattcgatgctgcgtataagcagaaagagttcgaaattgccagagtgaaagaaagaaacgtgcgcatccgggagattatcctggacctcgaactggaagaggctgtttggcagcccgaattcgaagactgtgaaaaacccgagagaactttggtcgtccaggatgaagagatcaccgctcacaagcatattaagccctggcacaaggctaaggagttgatagtgaaccacgaaaaagaacattggttgttgatacaggatgcttcgactcgtctaagggctctgatggatatgatgggcggtgtccttgaagttaaaaaagaagacattttgagaatggtgattcctcagccggcttttatggctaagcctgatgccgtttggaccgaggaggaaagaaagcagttcaaagattatgagaagaaggtgaaagaactcaacgaagaacgggacaaatacagaaagagcctggaggcggagttgaagaaacttcagaactcaattcaggagagtacacaggcgttcgacgagcatctaaaaagattatttgagaggagagtcaaagcagagatggtcacgaatcaagaggagctcaaaattagcaaccttgcatttagcctgctccttgacgaagaattatcgtccagggagaagttcctcaataattacctcacccgaaagcagcacgagaaagtgatggatcggtcttttaagaaggaattttccgagattcccggacaccaggttgacatactttacaagctgtttaagcgcaggcctcggatttcaaaacagaaaactcatagcgagacgacctccgtcgtcccctttggagaattgccaggctctgggaaactgaataaggacgcattcgcccagctaatgaaggcaatggacgaactggacaacatcagtaatatgcccgagggcctcgacccgcttgtgtggaatcacttctgcatgacacgtcgggcaaaggttgaaaacgagcagaaggttaagcagaaagcagctgacctgctcgagatggctacgttcctccagaaacgtgtcgaagaggaagagaaggtgcaacaggaaatcgagagagtgtttcacgaattgatacttttacaggaagagaaggtgaggtttcagctaaacctgactatccagattctactcaaacaggggcaggtcgaattagagaatttccagctggtacttgaatactccgacgccatcctcatcaataagaacatcattgaagatctaaactctgttatccgaacacagggccagaaaaaggtggccagcatgatggagtccaaggacgtccacaaaagaattctgcagattgaatgggaacataaaaagatggagatggaaagggaagacttaaatcagaaggcttgggacatacagatgctgtttttctcaagagaccggcagaaatatctaaatgaaccgaactatgaggccttaataagcattcaaataggaataatggaacagactatcgcagtgctcgacaaaatgcacaagaagaatgtggagaactgtaagaaattgttgaaaaaattgggcaagtttagcaatcagaaagacatagcgaactatgcactgtcttgtaacctcagagaagagctcgtcgcagtaagcgagcgcaaagacatttgcaatgccatgggctctaaattaacgtgcgaaaagattgttaaggagagatatgagaatatgatgcagcagcaaaagcttaccaacatatccaagcagcaggcagagcagatatccattcttcaaactgaggtcgagagactgagaatgaaaacgtttccagctcttgtgcagatgtag

SEQ ID NO: 61177 - DNA, 1545 bp, Artificial Sequence
  Description of Artificial Sequence: Synthetic coding sequence
taatggactgaagaggaaagaaagcagttcaaggactatgagaaaaaggtaaaggagctgaatgaggaaagggataagtatcgaaagagtctggaggccgagttaaaaaagctgcagaactcaatccaggaatctacccaggcctttgatgaacacctgaagagactgtttgagcggagagtgaaggctgaaatggtgaccaaccaggaggagcttaagatcagcaatctcgcattttctcttctcctggatgaggagctgagttctcgtgaaaagttcctcaacaactatctgacccgaaagcagcacgagaaaagccagacctccgaagcagtccggaagagcagggaagacctcgatgtgtgcaaggaacactatgacaatctcctggcagaggacaaggtaatggataggagttttaaaaaggaattctccgaaattcccggacatcaggtcgatattctgtataaactgttcaagcgtcgtcctcgcatcagtaagcagaagacacattcagagacaacctctgttgttccatttggggaactgcccggtagcggcaaactaaacaaggatgcatttgctcaactcatgaaagctatggacgaactggataacatttccaacatgccagagggcctcgacccgcttgtgtggaaccatttttgcatgacccgtagggctaaggtggagaacgaacagaaggttaaacagaaggccgcagacctgcttgaaatggcaacattcctgcagaagagggtcgaagaggaagagaaagtgcagcaagagatcgaacgggtgtttcatgagctgattcttcttcaggaagaaaaagtccgctttcagctgaatctgaccatccagattctactgaagcagggacaggtagagctggaaaacttccagctggtgcttgagtatagcgatgccatcctgatcaacaagaatatcatcgaggacttgaattctgtgattagaacccaagggcagaagaaggtggctagcatgatggagagtaaggacgtccataaaagaatactgcaaattgagtgggagcataagaagatggaaatggagagggaagacctgaaccagaaggcttgggacattcagatgctctttttcagccgggaccgccagaaatatctgaacgagcctaattacgaggccctcatcagtatccagatagggattatggaacagacaatcgccgttctggacaagatgcacaaaaagaacgtggagaactgtaagaaactgctgaaaaagctgggaaaatttagcaaccagaaagacattgcgaactacgctctgagctgtaacctgagggaggaactcgtcgccgtcagcgaacgcaaggacatttgtaacgctatgggatccaagttgacgtgtgagaagattgtgaaggagcggtatgaaaacatgatgcagcagcagaagctcacaaacataagtaagcagcaggccgaacagatcagcatactacaaacggaagtggagcgcttgagaatgaagacattcccagcactagtacagatgtag

SEQ ID NO: 61178 - DNA, 1965 bp, Artificial Sequence
  Description of Artificial Sequence: Synthetic coding sequence
atggcgccactcgtacctgggccaccgctcgaagcttctcctactaccttggacgcggctgtgcggtggggtttgcagcgcccagtccggggacacatggcccctggtcaggcaggcggaagaggcgatgcatctgctctgggggctcagtactcatgggccagagacggcagatccgccgtaggtagcaaattgtcatgggtgggtccagctgcacccgagtctaaggccgctcagggcagagagatggggagagatgtaggcaaggcagtggactgcctagatctaagcgggccagatggggcaagctgtctccagctgagcctgagaaaatccgaattatttcccgcagctagacgccctggcagacctgccgatcccggtcttagtccccgatgtttgcgacggccacctctgagacctggacccgcaagcacccctctcaggggtcccggagctgcacggccaccaccgcttcctccgcattctcgcggacggtctgctgtgagtttcctggcatttctgccgcctcagcgctcaccctcagctcctagagaagctgccggttctagagggggtcttcgcgcatctgggggaagatgcggcggacctgccggagctgctgccggatctggaggcggtggcgatgcgccaggtcccgctggtcgcgctatgcagaggtcacgtgccggagctgacgaggccgctctgctgttggccggattggcattgcgggaactcgagccgggatgtggttcgcccggtcgcggtcggcgaggcccacgacctgggcctggagatgaggccgcaccagcgcttgggcgaaggggcaaaggaagtggcggtcccgaggcgggagcagacggcctgtcacgcggtgagcgcggacccagaagagccgcagtacctgaattaagtgcacaaccagcgggatctcctagagccagtttggcagggagcgatggcggaggcggtggagggtctgcccgatctagtgggattagcctgggctacgaccagcgacacgggagccctagaagtgggaggagcgatcccaggcctgggccagggcctccctccgtcggttcggcacgctctagtgtctcatctttggggtcaagaggcagtgctggtgcgtacgccgactttcttccccctggagcctgcccagctccagctcgttcaccagagcctgctggaccggcaccgttcccactgccagcactgcccctccctcccggtcgtgagggaggaccaagcgcggcagagagacgcctggaggcccttaccagagagctggaacgtgcgctggaggcgaggacggcccgtgattattttggcatctgcatcaaatgcggcttggggatttatggagcccagcaggcctgccaggctatgggcagtctgtatcacaccgactgtttcacctgcgacagctgtggacgcaggctgcgcggaaaagccttctataacgtaggagaaaaagtgtactgtcaggaagactttctttattccgggttccagcagaccgctgataaatgctccgtctgcggtcatctcatcatggaaatgatcctccaggcattgggcaagagctaccatcctggctgcttcagatgctcagtgtgcaacgaatgcctggacggcgtaccattcaccgtggacgttgaaaataatatttactgtgtgcgtgattatcatacagtgtttgcacctaagtgcgcctcctgtgctcgaccaattcttccagcacagggctgcgaaaccaccatccgtgtggtttccatggacagggactaccacgtagcctgctaccactgtgaagactgtggtctccagttaagtggagaggaaggcaggcgctgctaccccctcgcagggcatcttctgtgtcgcagatgtcatctacgcaggctgcagcctggtcctctcccatctcccaccgtgcacgtgacagagctgtag

SEQ ID NO: 61179 - DNA, 5402 bp, Artificial Sequence
  Description of Artificial Sequence: Synthetic coding sequence
atggctacggactccggcgaccctgcttccactgaagactctgaaaaaccagacggcatcagtttcgaaaaccgggtacctcaggtggcggctaccctgaccgtggaggcccgactgaaggaaaaaaactctacatttagtgcctccggcgagacagtggagaggaagagattctttagaaagtccgtggagatgacggaggacgacaaggtcgcagaatcctcccctaaagatgaaaggattaaggctgccatgaacattccaagagtcgataagctaccaagcaacgtcctgcgcggaggtcaggaggtcaagtacgagcagtgcagtaaatcaacatctgaaatttctaaagattgctttaaagagaaaaacgagaaggaaatggaagaagaagccgagatgaaggccgtggcaacatccccgtccggcaggttccttaaattcgacatcgaacttgggcgaggcgcttttaagactgtgtataagggcctcgacacagagacatgggtggaggttgcttggtgcgagctacaggatagaaaactcacgaaggctgaacagcagaggttcaaggaagaggccgaaatgctgaaggggcttcagcacccaaatattgtgaggttttatgactcatgggaatccatactgaaggggaagaaatgcattgttctggtgacagagttaatgacatctggcacattgaaaacctacctgaagagattcaaggttatgaaaccgaaagtccttcggtcgtggtgccgtcaaatcctgaagggcttacagtttctgcacactaggacacccccaatcatacacagagacctgaagtgtgataacatcttcatcactgggcctacagggtctgtcaagattggagatttaggcctggccaccctcatgcggaccagttttgcaaagtcagttatcggcactcctgagtttatggcgccagagatgtacgaagagcactacgatgaaagcgtggatgtatatgccttcggtatgtgcatgctggaaatggcgacctcggaatacccctatagtgaatgtcagaatgcggcacagatctataggaaggtcactagcggcatcaagcctgccagctttaataaggtgacagatcctgaagtcaaggagattatcgaaggctgtatccgccagaacaagtccgagcgcctgtccatcagggatttacttaatcatgcctttttcgcagaagacacaggactcagagtggagctagcggaggaggatgactgctctaactcttcactggccctccggttgtgggtagaggatccaaaaaaacttaaagggaaacacaaggataacgaggctattgagttttcattcaacctggagactgatactccggaagaggtagcctatgagatggtcaagtctggatttttccacgagtccgactccaaggctgtagccaaaagcattcgcgacagggtcacccccattaagaaaaccagagaaaagaagcccgcaggctgtctcgaggaacggcgagactcccagtgcaaatctatgggtaatgtgttcccccagccacagaacacgactctccccctggctccagctcagcagaccggcgctgaatgtgaagagaccgaggtggatcaacacgtaagacagcagttgttacagcgcaagccacagcagcattgttcttcagtgacaggggataacctctcagaggccggtgctgcctctgtgattcatagcgacacatcctcccagccatcagtggcctattcatcaaaccaaaccatgggctcccaaatggtttccaatattccacaggccgaagttaacgtccctgggcagatttactctagccaacagctcgtcgggcattatcaacaggtgagtggcctgcagaagcattctaaattaacgcaaccacagattctaccactcgtgcagggtcagagcaccgtgttgcctgtgcacgtccttggaccaacagtagtgagtcagccccaggttagtccattgacagttcagaaggtcccacagataaaacctgtatcccagcctgttggtgccgagcagcaggctgcgttactcaagcctgatcttgtcaggtcactgaaccaagatgtggccactaccaaagagaatgtctcatctccagataatccatccgggaatggtaagcaagaccggatcaagcagcgccgtgcaagctgccctcgccctgagaaagggactaaattccagctcactgtcttacaggtgtctacgtccggcgacaacatggtggagtgtcaactggaaacccacaataacaagatggttaccttcaagttcgatgttgacggagacgcacccgaggacatcgccgactatatggtcgaggataactttgtgcttgaatccgagaaagagaagttcgtggaagaactcagagccatcgttggacaagcccaagagatcttacatgtacacttcgcaaccgaacgcgcaactggagtcgactcaattacggtggattcgaattccagccagaccggctcgtcagagcaggtgcaaattaacagtacttcaactcagacctccaatgagtccgcacctcagtctagtccagtggggagatggagattctgcatcaatcaaaccataaggaacagagagacgcagagccctcccagtctgcagcatagcatgtctgccgttcccggaaggcatcctttgcccagccctaaaaatacttctaacaaagagattagcagggatactcttctaacaatcgaaaacaacccctgccacagagccctgttcaccagcaagagtgagcacaaagacgtggtggacggaaagatttcagaatgtgcctccgtcgaaacaaagcagcctgctatactttaccaagtggaagataatcgccagataatggcaccagtgaccaattcctcttcatattcaaccacctctgttagggccgttccagcagaatgtgaagggctgaccaagcaggcgtctatattcatcccggtctatccctgtcatcagaccgcctcccaggccgacgccttgatgtcccacccaggggaaagtactcagacaagtgggaattcattgaccacgcttgcattcgatcaaaagccacagacacttagtgtgcaacagcccgcaatggacgccgaattcatctcccaggaaggggagaccaccgtgaacaccgaagccagctctcctaaaactgtcattcccactcagacccctggcctcgaacccacaacacttcagcctactacagttctggagagcgacggagaacgccctccaaaactcgagttcgcggataatagaattaaaaccttagacgaaaagttgagaaacctgctgtatcaggaacacagcatatccagcatctaccctgaatcacagaaggatactcaatcaatagacagcccgttcagcagttctgcagaggacactttgtcctgtcccgtcacagaggtgatagccatttcccattgtgggatcaaggactctcccgtccagagtcctaattttcagcaaactggatcaaagcttttgagtaacgtagcagccagccagccggctaacatatcagtattcaagcgcgacctgaacgtgatcaccagcgtgcctagcgaactgtgcctgcatgagatgtcaagcgacgcctccctccccggtgaccccgaggcatatccggctgcagtatcctccggtggggcaatccacttgcagacaggcggagggtatttcggcctgagtttcacctgcccaagcctgaagaacccaatctccaagaaatcgtggactcggaaactgaagagttgggcctatcggctacggcagagcacaagctttttcaagagaagcaaagtgcggcaggtcgaaactgaggagatgcggtccgccattgcccctgatcccatccctttaacccgggaaagcaccgcggacacccgggcactcaatcggtgtaaagctatgtcaggatccttccaaagagggagatttcaggtcatcaccatacctcagcagcagagcgctaagatgacttcattcggcatcgagcacatttctgtgtttagcgagactaatcatagctccgaggaagcattcatcaaaacagcaaaatcccaactggtagaaattgagcctgctacacagaatcctaaaaccagtttttcctacgagaagctgcaagcgctgcaggagacctgtaaagagaataagggcgtgccaaaacagggggacaacttcctttccttctctgcggcttgtgaaaccgacgtgagtagcgtgacacctgaaaaggaattcgaagaaacctcagccaccggttcttctatgcagtccggcagcgaactgcttcttaaagaaagggagattctcaccgcgggaaagcagccctcatctgattctgaattttccgcgagcctggctggatccggcaaaagcgtggccaagactggacccgagtccaaccaatgtctgccccaccatgaggagcaggcttatgctcagacgcagtcctcccttttttatagcccaagtagccccatgtccagcgacgacgagtcagagatcgaggacgaggacttgaaagttgagctgcagaggctccgggagaagcatattcaagaagtggtgaatctccagacccagcaaaataaagagcttcaggaactgtacgagcgtctccggagcattaaagatagcaaaacacagagtactgaaatcccactaccccctgcctctccacggaggcccagaagctttaagtcaaagttgcgatcccgtccacaatctctgacccacgttgataacgggatcgtagctacgggaaagagctgtctcatcaacgaactggagaatccgctctgcgttgagtcgaatgcggctagctgccagcagagccctgcatctaagaaggggatgttcacggacgaccttcacaaactcgtcgatgattggacaaaggaagctgtggggaactcgctgatcaaacccagcctgaaccagctgaagcaaagccagcataagctggagaccgagaactggaacaaggtctctgagaacacaccttccactatgggatacactagcacctggatctcttccctgagtcagatccgcggtgctgtcccgacctctcttcctcagggattgtcactgcctagcttccccggacccctgtcaagctacggcatgcctcatgtatgtcaatacaatgccgtggccggagctggctacccggtgcaatgggtgggaatttccggcacaacgcagcagtcagttgtcatccctgcccaaagcggaggccctttccaacctggcatgaatatgcaagctttcccaaccagcagcgtgcaaaatcccgctactatccctcccggacctaaata

SEQ ID NO: 61180 - DNA, 1065 bp, Artificial Sequence
  Description of Artificial Sequence: Synthetic coding sequence
atgcaggggctgctgttcagtacacttctgctggctggcttggcccagttttgttgcagagtccagggaaccggacccctggatacaacccccgaaggcagacctggagaagtcagcgatgcaccgcagcgcaaacagttttgccactggccgtgtaagtgcccacaacagaagccaaggtgcccacccggagtgtccctcgtgcgtgacggttgcggttgctgtaaaatctgcgcgaagcagcccggagaaatttgcaatgaagcagacctgtgcgaccctcataaggggctttattgcgactactctgtagacaggccacgctacgagacaggtgtgtgtgcctacctggtggctgtgggatgtgagtttaatcaggtacactatcataacggacaggtctttcagcctaatcccctctttagttgcctgtgcgtgagcggggctattggatgcacacctctgttcatccctaaattagctggttcacattgttctggtgcaaagggcggaaaaaaatcagaccaatctaattgttcattggagcctttgttgcagcagctctccacaagttataagaccatgccagcctacaggaatcttcctttaatatggaaaaaaaaatgtcttgtccaagcgacaaaatggaccccctgttctcgaacttgtggaatgggtatctcaaacagagtgacaaacgagaatagcaattgcgaaatgcgcaaagaaaaacggctgtgctatatccaaccctgcgatagtaatatcctgaagactattaaaattcccaaagggaaaacttgtcagcctacctttcagctaagtaaggccgaaaagtttgtgtttagcggttgctcatccacccagagctataagcctacattctgtggtatctgcctggacaagagatgttgcataccaaataaaagtaaaatgataacaattcagttcgactgtccaaatgaaggcagctttaagtggaagatgttgtggataacctcttgcgtgtgtcagcggaactgccgcgagcccggtgacattttctccgagcttaaaatcctgtag

SEQ ID NO: 61181 - DNA, 2139 bp, Artificial Sequence
  Description of Artificial Sequence: Synthetic coding sequence
atgctaaaggattatctgagcgtggctcaggatgctctaagaacacagaaggagctgtaccatgtgaaagaacaacgtttagcactggccttggatgagtatgttcgcctgaatgacgcctataaagagaagtctagttctcatacaagtctgttctccggctcatcatcaagcactaaatacgaccccgatatccttaaggctgaaataagcaccacgcgcctgagagtaaaaaagctaaagagagaattgagtcaaatgaagcaggagctgctgtataaagagcagggttttgaaacattgcagcaaatcgataaaaagatgtccggcggacagagtggatatgagctcagcgaggccaaagccatcctgaccgaactgaagagtattcggaaagcaatctccagtggtgagaaagaaaagcaggatctgatgcagtcgttggcgaaattacaggaacgcttccacctcgatcaaaacattgggaggagcgaacccgatctccgctgtagccccgtaaattcccacctgtgtttgagtcgacagacgctggacgcaggctcccagacctctataagcggagacattggcgtcaggagccgcagcaatttagcggagaaggtgagattatctttgcagtacgaagaagctaaaagaagcatggctaaccttaaaatagagctctctaagctggactctgaggcctggccgggtgccctcgacatagaaaaggagaagttaatgcttatcaacgagaaggaagaactactgaaggaactccaatttgtgacaccacaaaaaagaacacaggatgaattggaacggcttgaagccgagcggcaaaggctggaagaagagcttctcagcgttcgcggaaccccatcccgagcactggcggagcgactgaggctggaggagaggcgaaaggaacttcttcagaaactggaggaaacaaccaagttgactacgtacttgcatagccagctcaaatctctgtcagcttccactctgagtatgagtagtggttcatcacttggttccctggcctcttccagggggagcttaaacacctctagtcgtgggagcctgaattcgctgtcctccaccgaactctactacagcagccagtcggaccagatcgacgtagattaccagtataaactggactttctcctgcaggaaaagtcgggctacatcccaagtgggccaattacaaccattcatgaaaacgaggtcgtgaagtcccccagccagccagggcagtccggcctgtgcggagtagcagctgccgctaccggacataccccccctctggccgaagcgcctaaatctgtcgcctctttgagttccaggtcctcgctgagctctctttctccccctggttctcccctggtactggaagggactttccccatgagcagctcccacgacgcatctctacaccaatttaccgccgattttgaagactgcgagctgagctctcacttcgctgacatcagtctgatagaaaaccaaattttgttggattcagatagcggcggagcttcccaatcgcttagcgaggacaaggatttgaatgagtgtgccagagaacccctatacgagggcacggccgacgtcgagaagtccctgccgaaaaggcgcgtcattcatctcctgggagaaaaaacaacctgcgtgagtgcagccgttagtgacgagtccgtggccggtgattctggagtctatgaggcatttgttaagcagccatctgaaatggaggatgtcacctacagtgaggaggatgtcgcaatcgtggaaaccgcacaggtacagatcggattgcgatacaacgcaaagtcatcctcgtttatggtgattattgcccagctcaggaacctgcacgctttcttgatcccacacaccagcaaggtctattttcgcgttgctgtcctgccctcatcaactgacgtcagctgcctgttccggaccaaggtgcatcctccgacagagtcaatcctgttcaacgacgtttttcgcgtcgcaatctcccaaacagcacttcaacagaagacactcagaaaaaatttcacctttgtcaccgcaataactcacggagtgtgccttccgctgcccgtgccaatgcccagcttcgcctag

SEQ ID NO: 61182 - DNA, 3579 bp, Artificial Sequence
  Description of Artificial Sequence: Synthetic coding sequence
atgccgaggcgcgctgggtcaggccaactccctttgccacgtggctgggaggaagccagggattatgacggtaaagttttctacatcgaccataataccaggcgtaccagctggattgaccccagggaccggcttaccaagccacttagcttcgcagattgcgtgggcgatgagctcccgtggggctgggaggccggttttgacccacagattggcgtatactacatagaccacatcaacaaaaccacacagatcgaagacccccgaaagcagtggagaggagaacaggagaagatgctgaaggactacctgagcgtagcgcaggacgcattgcgtacacagaaggagctgtaccacgtcaaggaacagcgtcttgccttagccctcgacgaatacgtccggctgaacgacgcctataaggaaaagagcagttcacatacttccctctttagcgggtcgtcttccagcactaagtatgaccccgatatactgaaagcggaaataagcacaacgagactaagggtcaagaagctcaaacgcgaactgagtcagatgaaacaggaactgctgtataaggaacagggctttgaaaccctgcagcagattgacaaaaagatgtctggaggacagtccggctacgaactatctgaagccaaagcaatactcactgagcttaaatctattcgtaaggctatttcttccggggaaaaggagaagcaggacctgatgcagtctttggcgaaactgcaggagaggttccatcttgatcagaatatagggagaagtgaacccgacctgagatgcagcccggtcaacagtcacctgtgccttagtcgccagaccttagatgcaggatcacagacgtccatctccggcgatatcggagttcgtagcaggtcaaatcttgctgagaaggttaggctgtccttgcagtacgaagaggccaagaggtccatggcaaacctgaagatcgaattatccaaactggattccgaagcctggcccggagccctggacatcgagaaggagaagcttatgctcataaatgaaaaggaagagcttctcaaggagctccagttcgtaaccccgcagaagagaactcaagatgagttagaaaggcttgaggcagagcgacagcgactggaagaggaactgctgtcagtgaggggaacccccagtcgggcactcgcagaacggttgcgacttgaggagcgcagaaaagagctgctgcagaagcttgaagagaccactaagttaacaacgtatctgcacagtcaattgaaatcactgagcgcatccaccctctccatgtcttctggctcttccctgggctccctggccagttcgcggggatccctgaatacttcctcacggggttctctgaactctcttagttctaccgagctgtactacagctctcagtccgatcaaatcgatgtggattatcagtacaaactcgacttcctattacaggaaaaatcaggatacatcccttccggaccaatcaccactattcatgaaaacgaggtggtgaagagcccctctcagcccggacagagcggcctttgtggggtggcggcagccgctacgggacacactccccctctggcggaggcacctaaatcggtggcgtccctatcgtctagatccagcttgtccagcttatccccccctggcagtccactggtcctggaaggcacttttccaatgagctcaagccacgacgccagtctgcatcagtttacagccgattttgaggattgcgagctgtcctcacacttcgcggacatctccctgattgagaaccagatcttgctggactccgattcagggggtgcctcccagtccctgtctgaggacaaagatttaaacgaatgcgccagggaacccctctatgagggcaccgcggatgtggagaagagccttcccaagaggagggttatccacttgcttggcgagaagactacttgtgtatcagctgcggtatccgatgaatcagtagctggagactccggggtgtatgaggcgtttgtcaagcaaccaagtgaaatggaggacgtgacatactccgaggaggatgttgccatcgtggaaaccgctcaagtccaaattggcttgagatacaatgccaagtcttccagctttatggttatcattgctcagctgcgcaatctgcatgcctttctgattcctcacacatccaaggtctactttcgcgtggcagtcctgccttctagcacagatgtttcgtgcctctttcggactaaggtgcatcccccaacggaatccattctgttcaacgacgtctttcgcgtcgctatttctcagactgctcttcagcaaaaaactctcagagtggatctttgctccgtatccaagcatcgcagggaagagtgtttggcgggtacacaaatatccctcgctgacttacccttctcatcggaagtgtttaccctgtggtataatcttctcccctccaaacagatgccgtgcaaaaagaatgaagagaacgaggactccgtttttcagcccaatcagccactggttgacagcatcgacttagacgccgtgagcgccctccttgccaggaccagtgctgagctgctagcagtggagcaggagctcgctcaggaggaggaggaggaatcggggcaggaggaaccacgcggacctgatggggactggctgacgatgcttagggaggccagcgacgagatcgttgctgagaaggaggctgaggttaagctcccagaagacagtagttgtacagaagatttatcttcttgtacatccgtcccagagatgaatgaggatggtaaccggaaggagagcaactgcgctaaagaccttcgctcccagccccctacacgcatacccacgctcgtggacaaagagaccaacacggacgaggcagcgaacgacaatatggcggtgaggcccaaagaacgctcttcgctcagcagcagacagcacccattcgttagatcctccgtgattgtgcggagccagaccttcagccccggtgagcgtaatcagtatatctgtcgcctcaataggtctgactctgatagctctaccttggcaaagaagagtctatttgtaagaaactccacagagcgacgatccctgcgcgtcaagagaaccgtgtgtcagagcgtcctgcggaggacaacccaggagtgccctgtgcgcacatctctagatttggagctggatcttcaggcttcactgaccaggcaatcccggctcaatgacgagctgcaagcactcagggatctgcggcaaaaactggaggagctcaaagctcagggggaaacagacctcccccctggcgtccttgaagacgagcgctttcaacgcctcttgaagcaggcggagaagcaagctgagcagagcaaagaagagcagaagcaaggattgaacgccgaaaaactgatgcgccaagtgtcgaaagacgtatgtcgactccgtgagcagtctcaaaaggttcctcggcaggtacagagcttccgcgagaagattgcatactttaccagggcaaaaatcagcatccccagtctaccggctgacgatgtgtag

SEQ ID NO: 61183 - DNA, 3651 bp, Artificial Sequence
  Description of Artificial Sequence: Synthetic coding sequence
atgccacggagagccggatccggacagctgcccttgccccgaggttgggaggaggcgcgagactatgacggcaaggtgttttacatagaccacaatacgcgcagaaccagctggattgatccacgagacaggttgactaagccattaagtttcgctgactgtgtcggggacgagttgccgtgggggtgggaggccggtttcgatcctcagattggagtttattatatcgatcatatcaacaagaccacccagatcgaagaccctaggaagcagtggaggggggaacaggagaaaatgttaaaagattacctgtccgtggcacaagacgcccttagaacccaaaaagaactataccacgttaaagagcagcggcttgccctagccctggatgaatatgtgcgactcaacgatgcatacaaggagaaaagttctagccatacttcactcttctctggcagttcgagctcgaccaaatacgacccagacatcctgaaagcggagatttcaacaacaagactccgcgttaaaaagctgaaacgggaactgtctcagatgaaacaggagctcctgtacaaggaacagggttttgaaacattgcagcagatcgacaagaaaatgtccggtggacaaagtggatacgagctatccgaggccaaagcgatactgactgagctgaaaagcattaggaaagccattagctcaggagagaaggagaaacaggatcttatgcagagcttagcgaaactccaagaaaggtttcaccttgaccagaatatcggcaggtccgagccggatctccgttgcagtccagtcaacagccacctgtgcctgagcagacagaccctcgacgccggaagccagacttcaatctccggagatatcggcgtgcgtagcaggtcaaacttggctgaaaaggtgcgcctgagcctccagtatgaagaggccaagcgctcgatggctaatcttaagattgagctgtccaagctggactctgaggcttggcccggtgccctggacatcgagaaagaaaaactaatgctcattaacgaaaaagaagagttgttgaaggagctgcaattcgtgactccacagaaacggacgcaggacgagctcgaaagactggaggccgaaaggcagcgcctcgaagaggaactcctttctgtacgcggaacccctagcagagccctcgcggagaggttacggctcgaagagagacgcaaagagttgctccagaagctggaagaaaccactaagctgaccacctatttacattcacagttgaaaagcctctcagcatccacattgagcatgtcgtccggtagctccttaggctctctcgcttcctcaagggggtccctgaatacaagttcacggggttccctgaattccttatcctccacggaactgtattacagtagccagagcgatcagattgacgtggactaccaatataagttagatttcctgctccaagagaagtcgggttacattcccagcgggcctataacgacaatccatgaaaatgaagttgtgaagtctcccagtcagcccggtcaaagtggactgtgtggtgtggccgcagcagcgacaggtcacacacctcctctggcagaagctccaaaaagcgtcgcctcgttgagttcccgctccagtctttcatctctttctccgccagggagccccctagtccttgaggggacgttccccatgtcatccagtcacgacgctagcttacatcagttcactgcggacttcgaagactgtgagctgtcaagtcactttgcagatatcagtctgatcgagaaccaaatcctgctggacagtgactccggcggagcctcgcagagcctcagtgaagacaaagatctcaacgaatgcgcacgcgagccactctacgagggaacggctgacgtcgaaaaatcactgcccaaacgtagggttatccaccttctgggggaaaaaactacctgcgttagcgcggcagtatcggatgaatccgttgccggagactccggggtatacgaggccttcgtgaagcagccctctgagatggaagacgtaacctattccgaggaagacgtggctatcgtggaaacagctcaagtacaaataggcctccgttataatgctaaatcaagctctttcatggtgatcattgcccaactcaggaacttgcacgcatttttgatacctcacactagcaaagtatatttccgggtcgcagtattgcctagctccacggatgtaagctgcctgtttcggacaaaagtccacccaccaactgaatctatattgttcaatgatgtgtttcgtgtggccatttcccagacagcactacagcagaaaacgctgcgcgtcgacttgtgctctgtaagcaagcaccggagggaagaatgcttggctggaacacaaattagtctcgcagacctccctttcagctctgaggtgttcaccctgtggtataaccttctgccgagcaaacagatgccttgcaagaaaaatgaggaaaacgaagattctgtctttcaacctaaccagccactggttgattccatcgacctggatgccgtgtctgccttgctggccagaacctcagcggagctgctggccgttgagcaggagcttgcgcaggaggaagaggaggaaagcggccaggaagaacccaggggaccagacggcgactggctcaacacctattttctctgctgttgggagttgaaggatgatgtgttcacccggctcacagtaaaaccactgctaacaatgctgcgcgaggcgtccgacgagatcgtcgcggagaaagaagctgaagttaaactccccgaggattcatcatgtacagaggatctatcctcatgtacctccgtgccggagatgaatgaggacggcaaccgaaaagagtcaaactgcgctaaggacctgcggtcccaaccccctactagaattccaactctggtagataaggaaaccaatacggatgaagccgctaatgacaatatggccgtgagacccaaggagcggagctctctcagctcacggcaacatcctttcgtcaggtcttctgttatcgtgcggtcacagacgttcagtccaggcgagcgaaatcagtacatttgtcgcttgaatagaagtgactccgattcatccacgttagccaaaaaaagtctttttgtgcgtaacagcaccgagcgacgatccctgcgcgtaaagaggactgtgtgtcagagcgtacttcgacgaaccacccaggagtgccccgtgagaacaagcctggacctggaactcgatctgcaggcttcacttactcggcaaagcaggctcaatgatgaactacaggcactgagggatctgaggcagaagctggaggagctgaaggcccagggcgagaccgaccttcccccaggcgtgctcgaagatgaaaggtttcagagactgctcaaacaggccgagaagcaggccgagcagtccaaagaggagcagaagcaaggcctaaatgctgaaaaactgatgcgccaggtgtctaaggatgtttgcagactcagggaacagtcccagaaagtcccaaggcaagttcagtcatttagagagaagatcgcctattttactcgagctaagatatcaatcccgagcctccctgccgatgatgtgtag

SEQ ID NO: 61184 - DNA, 963 bp, Artificial Sequence
  Description of Artificial Sequence: Synthetic coding sequence
atgccacggctgcgggtgcatggcgcttgcttgccaaccaaaagcgtgctattcttgttctatcacaggttgaccatgctgcgggaagcatccgacgagattgtggcggaaaaggaggcagaggtgaagctccccgaagattcaagttgtacagaggatttgtcttcttgcacctcagtaccagagatgaacgaggatggaaatagaaaggagtctaattgtgcaaaagacctgaggagccagcctcccacaaggattccaacgcttgtggataaagaaaccaacacagatgaggctgccaacgacaacatggccgtgaggccaaaggaaagatcaagcctgtcctccaggcagcaccctttcgtgagaagttcagtaattgttagatctcagacattctcgccaggggagcgaaatcagtacatttgtaggttgaataggtcagatagcgatagtagcacactcgcaaaaaaatccttgttcgtgagaaatagtaccgaacgcaggtctctgcgcgttaaacgcactgtgtgccagagcgtgctacgtcggaccacacaggagtgccccgtgcgcacgtctcttgacttggagctggatttacaggcctcgcttactaggcagtccagacttaatgatgaacttcaagctctgagggatctccgacagaagttggaagagctcaaggcccaaggcgaaaccgatcttccccctggggtactggaggatgagcgcttccagagactgctgaaacaagctgaaaaacaggccgaacagtcaaaggaggaacaaaaacagggactgaacgcggaaaagcttatgagacaagtttctaaggacgtttgcaggctgagggaacagagccagaaagtgccaaggcaggtgcagagcttccgggagaagatcgcctattttacccgcgctaagattagcatcccttctctccccgcagatgatgtatag

SEQ ID NO: 61185 - DNA, 3432 bp, Artificial Sequence
  Description of Artificial Sequence: Synthetic coding sequence
atgcccaggcgagctggcagcggccagttgccccttccgaggggctgggaagaagccagagactacgacggcaaggtgttctatattgatcataacaccagaagaacaagctggatagatccgagggatcgacttactaaaccgttaagcttcgcagactgcgtgggagacgagctgccatggggatgggaagctgggtttgacccccagatcggcgtttactacattgatcacataaacaaaaccactcagatcgaggaccctaggaagcaatggagaggagaacaagagaagatgctgaaggactacctgtctgtcgcacaggatgctctcagaacccaaaaagagctctaccacgtgaaggagcagagattggctttggcccttgacgagtacgtgagactgaatgacgcttataaagaaaaaagttcctcacatacatcgctgttcagtggatcctccagcagtactaaatatgatccagacatattgaaggccgaaatcagtactacacggctgcgcgtaaagaaactcaagagggagctgtcacagatgaaacaggaacttctatataaggagcagggtttcgagacgctacagcagattgacaaaaaaatgtccggagggcaaagtggctacgagctgtcagaggccaaagcaattctaaccgagctgaagtcaatccgcaaggccatatcaagtggggagaaggaaaagcaggacttgatgcaaagtttagctaagttgcaagagcggtttcacctggatcaaaatatcggaagatccgagcctgatctgaggtgcagccccgttaatagccacttatgcctctcacggcagactctggacgcgggaagccaaacctcaatttctggcgatattggcgtgaggagccggtcaaatcttgccgaaaaagtgagactttcgctgcaatatgaggaagccaagaggtctatggccaacctgaagatagagttatccaaactcgatagcgaggcctggccgggagccctggacatcgagaaggaaaagcttatgctgattaatgagaaagaagagctgctcaaggaactgcagttcgtcacgccgcagaaacgcacccaggatgaactcgagaggctggaagccgagagacagcgcctcgaggaagaactgctctcagtcagagggacgccatctcgagccctggccgagaggttgcgattggaggagcggagaaaggagctgttacagaagttggaggaaaccacaaaattaacaacctacctccactctcaactgaagagtctcagcgctagcaccctttctatgtcttctggtagttctctgggaagtttagccagctcccggggaagcttgaacacaagttcccgcggaagcctcaactccctgtcatctacagaactgtattactcgtcacaatcagaccagatcgacgtagactaccagtataaacttgacttccttctccaggagaaatccgggtatattccgagcggaccaatcacaaccattcacgagaacgaggtagtgaagtccccatcacagcctggccagagcggcctctgcggcgtcgcagctgctgccacaggtcatactcccccactcgcagaggcgccaaagtccgtcgcaagcctatcatcccgatcctccctgtccagtctcagccctccaggcagccccctcgtgctggagggcactttccctatgtcctccagccacgatgccagtttgcaccagtttacagcagactttgaagactacgtggaaaaaagtcttcccaagaggcgcgtgatacacctgctgggagagaaaacgacgtgtgtcagcgctgccgtaagcgacgagtccgtagcaggcgactccggagtgtacgaggccttcgtgaagcaacctagtgagatggaagacgtgacctatagtgaggaagatgtggcaatcgtggagacggcccaggtccagattgggctgcgctataacgcaaaaagtagcagtttcatggtgatcatcgcacagctgagaaacctccacgcttttcttatcccccacactagtaaggtgtattttcgggttgctgtcttacccagttccacggatgttagctgcctgttcagaacaaaggttcacccccctacagagtccattctgtttaacgatgtgttcagagtcgccatcagtcagactgccttacagcagaaaaccctccgcgtggatttgtgttccgtgagcaagcaccgacgcgaggaatgcctggcagggacacaaatttcactggccgacctgcctttctcctcggaggtattcacactgtggtacaatttgctgccctctaaacagatgccttgtaagaagaacgaagagaatgaagatagcgtgtttcagccgaaccaaccactggtggactccatcgacttagacgccgtctcagccctcctcgcgagaacatccgctgagctcctggctgtagaacaagaacttgcccaggaagaggaggaagagtccggacaggaagaaccacgtggtccagacggggattggctgaccatgcttcgcgaagcctccgatgaaattgtggcagaaaaggaagccgaggtgaaactgcccgaagatagctcctgtacagaagacctaagcagttgcaccagcgtgccagagatgaacgaggacgggaatcgcaaggagagcaactgcgctaaggacctgcgctcccagcccccaacccggattcccaccttagtggacaaggagacaaacacagacgaggccgcaaacgataacatggcggtgcgtccaaaagagcgcagctcattaagtagtaggcaacaccccttcgtgcgaagctcagtaatcgtccgctcacagactttctcgcccggagagcggaaccagtatatttgccgtctgaatcggtctgatagtgattcttcaacgctagctaagaagtccctctttgtaagaaatagcaccgagagacgtagcctgagagtgaagagaaccgtgtgccagtcagtcctgcgacgcaccacccaggagtgcccagttagaacctctctggacctggagctggatctgcaggcatctctgaccagacaatcccgactaaatgatgagctgcaagcgctgagagaccttagacagaaactggaagaacttaaggcccagggcgagaccgacttgccaccaggcgtgttggaagatgaaagatttcaacgcctgctcaagcaagctgaaaaacaggcggaacagtccaaggaagagcaaaaacagggtctaaatgccgagaaactgatgaggcaggttagtaaggacgtctgcagactgcgggagcagtcgcagaaggttccacggcaggtgcagtcttttagagaaaaaatcgcttattttacgagggcaaagatcagcataccaagcctgcctgcagacgatgtctag

SEQ ID NO: 61186 - DNA, 315 bp, Artificial Sequence
  Description of Artificial Sequence: Synthetic coding sequence
atgaagtcgtgccagaaaatggaaggaaaaccagaaaatgagagcgagcccaaacatgaagaggaacccaagcccgaagaaaagccggaagaagaggaaaagctggaggaagaggcaaaagcgaagggcacttttagagaaaggctgatacagtctctacaagagttcaaggaagatatccataatcgacatctgtctaatgaggatatgtttcgcgaagtcgacgaaatagatgagattagacgcgtccgtaataaactaatcgtgatgcggtggaaagtgaatcgcaaccatccgtacccctatctgatgtag

SEQ ID NO: 61187 - DNA, 315 bp, Artificial Sequence
  Description of Artificial Sequence: Synthetic coding sequence
atgaagtcctgtcagaagatggagggaaagccagagaatgagagcgaaccgaagcacgaagaagaacccaagcctgaggaaaagcctgaggaagaagagaagttagaagaagaagccaaggctaaaggcactttccgcgagaggcttatacagagtttgcaagaatttaaagaggacattcacaataggcacctttcaaacgaagatatgttccgcgaagtggacgagatcgacgaaatcaggcgagttcgaaataaattaattgtgatgcgctggaaagtgaatcgaaaccacccttatccttatttgatgtag

SEQ ID NO: 61188 - DNA, 3279 bp, Artificial Sequence
  Description of Artificial Sequence: Synthetic coding sequence
atggatcacattaataagttgactcaaattgaggacccgcgagagcaatggcgtcgagaacaagagcgcatgctgaaggaatacctgatcgtggcacaagaagcccttaacgctaaaaaagagatttaccagatcaagcagcagagatttgagcttgcacaagaggagtatcaacaactgcacaagatgtgcgaggatgactcgcggagttatgcttcgagctttagcggatatagtaccaacaccaaatatgaccctcaccaaataaaggctgaaattgccagccgcagagatagactcagtcgattaaagagagaactgacccagatgaagcaggagctgcagtataaggagaaaggcgtggaaaccttacaggaaatagaccgcaagatgtccagcacccatactagctacaagctcgatgaggctcaagccatcatgtccgaacttagaacaatcaaaaaagccatctgcaccggcgaaaaggagaggcgggaccttatgcactctctggcaaaactgaccgacagcttcaagaactcctgcagcgtcactgactcacttgtggacttccctcatcacgtgggcgtccctggggatgctggcgtgccacagcaattttgtgacgctggctctcagacggatataattggggaattcgtgttcgacgataagacccgcctggtggatcgagtgcggctcaactggcagtatgaagaagctcgcaagcgtgtggctaacatacagcagcagctggcccgtctggacaatgaatcctggccatcaacagccgaggcggaccgtgatagacttcaactgattaaagagaaagaggccctgctgcaggagctacagttgatcatagcacagagacgctccgctggagacgtcgcacgactcgaagaggagcgagagcgtctggaggaggagctgagacgggctagggctactagtgcccagggcgcaacggagaggatcctgctacaagagaaacgtaactgtcttttgatgcagctcgaagaggcgactcgtcttaccagctatctgcagtctcaactcaaatcactatgcgccagtacactgaccgtgagttccggcagctccagaggatctctggctagttcgcggggaagcctcgccagctctcggggaagtttgagctcagtgagcttcacggacatttacggactcccgcagtacgaaaagcccgacgctgaaggatcgcagctgttacgattcgacctaatcccgttcgatagcttgggcagagacgcacccttcagtgagccacctggtcctagcggatttcataagcagcggcgaagcctggacacaccacagtctttggcatccctatcatcgaggtccagcctgagttccctgagccctccaagcagccccctggacaccccctttctgcccgcatctagagacagccccttggctcagctggctgacagctgcgagggcccaggactgggtgccttggaccgcctgcgcgcacacgccagcgctatgggtgatgaggatctgccgggtatggcagccctgcaaccccacggcgtccctggtgatggggagggccctcacgagcgagggccaccacctgcgtcggcgccagtgggcggaacggttacactgagggaggattcagctaagagacttgaacggcgtgctcggcgaatttcagcttgcttatccgactactctctggcttctgactctggagttttcgagccgctcactaaaaggaacgaggacgctgaggagccagcttacggagatactgcgagcaatggtgacccccaaattcacgtaggtcttcttagggattccggaagtgagtgtctactcgtccacgtgttacagctgaaaaatcctgccggactggctgttaaggaagactgtaaggtgcacatcagagtttacctccctccattggacagcggcacccctaacacttattgttcaaaggctttggagttccaagtgcctttggtttttaacgaagtgttcaggatcccagtacattcatcagccctgacacttaagtcactccagttatatgtgtgctctgtgacgccgcagctgcaagaggaattgctggggattgcccagattaacctggccgattacgatagtctgagtgagatgcaacttcgctggcatagcgtacaagtgtttacatcttcagaacccagccgcacaagagaagctggatgtgccggtgaaagctcggcacgtgatcccgctcacactatctctatatccggaaagacagacgctgtgactgttttgttggccaggacaaccgcccaacttcaggcggtggagagggagctcgccgaagagcgagccaaactggaatacacagaggaagaggtgttggaaatggaacggaaggaggagcaagccgaggccatcagtgaaagaagttggcaagctgacagcgtagattctggctgtagtaactgcacccagacttcaccaccctaccctgagccctgctgcatggggattgactccattcttggtcacccctttgccgctcaggccggtccatattctccagaaaagttccagccatcacccctaaaggtagacaaggaaactaatactgaggatctcttcttagaagaggcagcatcccttgtgaaagagcggccttcccgtcgtgcacgcggaagccctttcgtgcggtctggaacgatcgtccggtcccagaccttctcacccggagcgaggtcacagtacgtgtgcagactctatcggtctgatagcgactctagcacactgccccgtaaatctcctttcgtcagaaatactctagagcgcagaactctgaggtacaaacagtcctgcaggtcctccctggccgaactgatggctcggacctcattggacttagaacttgatctgcaggcctcccggacacgccagcgccagctcaacgaggaactgtgtgctctgcgcgagttacggcagaggctggaagacgcacagcttagaggtcagacggacctcccaccctgggtgttgcgggatgagagactcagaggtttactgcgcgaggctgaaagacaaactcgacagaccaaattagactatcgtcacgaacaagccgcagaaaaaatgttaaagaaggcttcaaaagaaatttatcagctgcggggacaatctcacaaggaaccaattcaggtacaaacctttagggagaaaatcgctttcttcactcgcccaaggatcaatataccccctttgcctgctgacgacgtttag

SEQ ID NO: 61189 - DNA, 1749 bp, Artificial Sequence
  Description of Artificial Sequence: Synthetic coding sequence
ctgtcacacattagtgagttaacccagatagaggaccccagagagcaatggcggagagagcaggaacggatgctgaaggaatatctgatagtagcccaagaggccctcaacgccaaaaaagagatctatcagataaagcagcagagattcgaattggcacaagaggaatatcagcagttgcataagatgtgcgaggatgattccaggtcctacgcaagttctttctcaggatattccaccaataccaagtacgacccccaccagatcaaggccgagattgcttcacgcagagatagactcagccgcttaaagcgtgaacttacccagatgaagcaagaacttcagtacaaagagaagggtgtggagactttgcaggaaatagacagaaagatgtcaagcacacacaccagctataagcttgatgaagcccaagccatcatgagcgagttgcgcacgatcaagaaggcgatatgtacaggtgagaaggaaagacgagacttaatgcattcactggccaagctcaccgattctttcaagaacagctgttcagtgacagattctctcgtggatttcccccatcacgtgggcgtccccggtgacgcaggcgtcccacagcagttctgtgatgctgggtctcagacggatattatcggggaatttgtcttcgacgataaaacacggctggttgaccgcgtgcgcctgaattggcagtacgaggaggccaggaaacgcgtcgccaacattcagcagcagttggcgagactggataacgaatcctggccctcaactgcagaagccgatcgggatagactgcagctgataaaggagaaggaggcactgttgcaggagctccagctgatcattgcccagaggcgcagtgcaggggacgtggccagactggaagaggagagagagcgcctggaagaggaattacgcagagctagagcaactagcgcccagggagccactgagagaattcttttgcaggaaaagaggaattgcctgctgatgcagcttgaagaagctaccaggcttacaagctaccttcagtctcagctgaagtctctgtgcgcttccaccctcactgtatccagcgggtcctcacgcggtagcctggctagtagtcgcggaagtctggcttcatcccgagggtccctgagcagcgtgagttttacagatatatatgggttgccgcaatatgagaagcccgacgcggaggggtcacaactccttagattcgatcttataccatttgactctctgggtagggatgcccctttcagcgagcctcctgggccatcagggttccataagcagcggagatccttagacacacctcagtcactcgccagcctctctagccgtagcagtctttcatcactgtccccgccaagttccccactggatacacctttcctcccggctagtagagactccccgctggcgcagcttgccgattcatgtgagggccctggcctgggcgcactggacaggctgcgggctcatgctagtgctatgggagacgaagaccttccaggcatggcagccttgcagccacacggtgtgccaggggacggagagggccctcacgagcgcggaccaccacccgcatctgccccagtgggcggaagcaagtgcgggtgctccgacagctccagaagacagtgccaagaagttggcgaggaaggaacacctcatctccggatgagcgttgggctttttgcctctcagagacaatggggcgtgtag

SEQ ID NO: 61190 - DNA, 3279 bp, Artificial Sequence
  Description of Artificial Sequence: Synthetic coding sequence
atggatcacatcaacaagcttacgcagattgaagacccgcgagaacagtggaggagggagcaggaacgtatgctgaaagagtacttgatagttgctcaggaagctctcaatgctaagaaggagatctaccaaattaaacagcagcgattcgaactagcacaggaagagtaccaacagttgcataagatgtgcgaagacgatagccggagctatgcctcttcattttcgggctatagtaccaacacgaaatacgacccacatcagatcaaagccgagatcgcatcccgacgcgaccgtttaagccgattaaagcgcgagctaacacaaatgaagcaggagctgcagtacaaggaaaagggagtcgaaaccctacaagaaattgaccgcaaaatgagttcaacacacactagctataagttggatgaggcccaggccatcatgagtgagctccgaactatcaaaaaagcgatttgcacaggcgaaaaagagcgtcgggatctcatgcattcattggccaaattaacagattccttcaaaaactcctgttctgtgactgactcgctggtcgatttcccacaccacgttggtgtgcctggagacgccggagtcccacaacagttttgcgatgcaggctctcagactgatattattggagaatttgtgttcgacgacaagactagactagtggaccgcgtcaggttaaactggcagtacgaggaggctcgtaagcgagtggcaaacatccagcagcagctggcccgactcgataatgaatcctggcccagtactgccgaagctgatcgagacagacttcagctgatcaaggagaaggaggcgcttctgcaggagctccagcttatcatagctcaacgccgtagcgcaggagacgtagccaggctggaagaggaaagagaacggctggaggaggagctcagaagggcgagagccacatctgcacagggggctacagagcgtatactgttacaagagaaacggaattgtttgctcatgcaacttgaagaagcgactcgcctaacctcgtacttgcagagccagcttaaaagcctttgcgccagcactctaactgtgtcgtcaggttctagtagagggtccctggcttcgtccagaggcagtctagcctcttctcgcggatcgcttagcagcgtcagctttacggacatctacggtcttccacaatatgagaaacctgatgcagaaggctcacagctgctccgatttgatctaatcccttttgacagcctgggaagggatgcacctttctctgaacctcctggacccagcggattccacaaacagagacgcagtctcgacacgccgcaatctctagcatccttgtcatcccgctctagcttatcgtcactttccccccctagctcacccctggatacgccctttctaccagctagccgcgatagccccctcgcacaactggccgatagttgtgaaggcccaggattgggtgctttagaccggctaagagctcatgcatccgccatgggagatgaggatttgccgggaatggcagctctgcagccccacggagtccctggagatggagaaggccctcacgagcggggacccccacctgcaagcgcgccagtcgggggtacagtgacattgcgcgaggattctgcaaaacgacttgagaggagggcgaggaggataagcgcttgcctgagcgactattccctggcttctgatagtggcgtgttcgagcccctgacaaagcgcaacgaagatgcggaggagccggcatacggggatacggcgagtaacggtgatccacagatacacgtcgggctgcttagggactccgggagcgagtgcttgctggtgcacgtactgcagctcaaaaatcctgccggattagctgtgaaagaggactgtaaggtgcacatccgggtatatctgccccctctagactccggaacaccgaatacctactgctccaaggctctcgaatttcaggtacccttggtcttcaatgaagtcttcagaatacctgtgcatagctccgcgctgaccctgaagtcgttacagctgtatgtgtgttcagtgacaccccagctgcaagaggagctgctcggtatcgcacaaatcaatctggccgattacgattcattgtccgaaatgcagctacgctggcactccgttcaggtgtttacttctagcgaaccctcaagaacgcgagaggcaggatgcgccggtgagagtagcgcaagggatcccgcacatactatctcgatctcagggaagacagacgccgtgacagttctccttgccagaaccacagctcagctccaggccgtcgaaagggagctggcagaggagagggcaaaactcgagtataccgaggaggaggtgctggagatggaacgcaaggaggaacaggccgaagctataagcgaacgctcctggcaggcggactccgtcgactctggatgttcaaattgtacgcagacatccccaccctacccggagccctgctgcatgggcatagatagcatcttgggacacccctttgccgctcaggctggaccatacagccctgagaagttccagccctcccctttgaaagtcgacaaggagacaaatactgaggatctctttttagaagaagctgcctctctagtgaaagagagaccctctcggagggctagagggagtcctttcgtgcgttctggaacaattgtccgtagtcagacattttcaccaggggctcggagccagtatgtatgccgtctgtacagatccgattctgattcttcaacactgcctaggaaatctccatttgtccggaataccctcgaacgccgaacattgcgatataagcagagctgcaggagctctttggcagagttaatggcgagaacaagtctggatctggagctcgatttgcaagcctctcgcactcggcagcgccagttgaatgaggagctgtgcgctctcagggagctaaggcagcggctggaggatgcccagttgagaggccaaaccgacctccccccttgggttctacgcgatgagcgcctccgcggtcttttaagggaggccgaaaggcagacacgtcagactaagctggattataggcacgagcaggctgcggagaagatgctcaaaaaggcgtccaaagaaatttaccagctccgcggtcagtcccacaaggagccaatccaggtgcagacatttcgggagaagatagcattcttcactcgccctcgaatcaacattccacccctgccagctgacgatgtgtag

SEQ ID NO: 61191 - DNA, 639 bp, Artificial Sequence
  Description of Artificial Sequence: Synthetic coding sequence
atgcagcttgaggaagctacaaggctgactagttatctgcagagccagctgaagtccctgtgcgcctctactttaactgtgtcctctggctcatcgaggggcagcctggcatcatctagagggtctcttgcgagctctcgcggttccttgtcaagcgtatctttcactgacatttacggacttccccagtatgagaagcctgacgctgaaggatcccaacttctgagatttgacctgatccctttcgactcgctcggaagagacgctccattcagcgagcctccgggacctagcggctttcataagcaacgcaggtccctggacaccccccagtcgctcgctagcctgagctcacgaagctctctctcttctctgtcccccccttcaagccctctcgacaccccatttttacccgcaagtcgagactctccattagctcagctcgctgattcttgcgagggtcctggtctgggggctctggatcggctacgcgcacacgcgagcgctatgggggacgaagatcttccaggaatggccgcactgcagcctcatggagtcccaggagacggggagggaccacatgaacggggaccgccaccggcatcagcaccagtaggaggcaagatacttacctcatag

SEQ ID NO: 61192 - DNA, 1764 bp, Artificial Sequence
  Description of Artificial Sequence: Synthetic coding sequence
atgggcgatgaagatttaccaggtatggccgcacttcagccccacggggtgcccggagacggcgaagggcctcatgagagaggaccccctcctgcttcagcccctgtcggtggtacagtcacactgcgtgaagactctgctaagagactggagcggcgtgcccgtcggatctctgcctgtctcagcgactacagcctggcgagcgacagcggggtattcgaacctttaactaaaagaaatgaagacgcagaagagcccgcatacggcgacaccgcctcaaacggagacccccagatccacgtaggtctcctgcgcgacagcggatcagaatgccttctcgtccatgtgcttcaactcaagaacccggcaggccttgcagtcaaagaggattgtaaagttcatatccgcgtttacctcccgccactcgattccggcacgcccaacacctattgttctaaagctctggaattccaggtccccctggtgtttaatgaggtcttcagaattcccgtgcacagctcagctctgaccctcaagagcctccagctttacgtgtgttccgttactccccagctacaggaggagctgcttggcatcgcgcagatcaacctggctgactatgattccctttcagaaatgcagctgagatggcactcagtgcaggtgtttacctcctcagaaccctcccggacacgcgaggctgggtgcgctggtgaaagctctgctagagacccggctcacactatcagcatctctggtaagactgacgcggtgacagtgctacttgcaaggacaacggcacagttacaggcagtggagcgcgaactggctgaggaacgcgcaaaattagagtacaccgaggaggaggtgctcgagatggaaaggaaggaagagcaggccgaagcaatatccgagaggtcgtggcaggccgattcggtggacagtggatgctcaaactgtactcaaacttcccccccatatccggaaccttgttgcatggggatagattctatcctgggacacccttttgctgcacaagccggaccttattcccccgaaaagttccaaccaagccctttgaaagtggacaaagagaccaacacggaagacctgtttctagaggaagctgctagcttagtcaaagagaggccctcccggagggccaggggcagtccctttgtcagatcaggcactatcgtcaggtcacagaccttttctcccggagcccgaagccaatacgtctgccgcctgtatagatcagacagcgatagctcaacactacctcgaaagagtccctttgtacgaaacacgctggaaagaagaactctacgatacaagcagtcctgtcggagctcgctagctgagctaatggcaaggactagcctggatctggagctggatctgcaagctagccgcaccagacaaaggcagctcaacgaggagctttgtgctctgagggagctgcgccaacgtttggaagatgcccagctccgcggtcagaccgatctgccaccttgggtgctgagagacgagagattaaggggccttctgagagaagccgaacgacagactcgacagacaaaactcgattataggcacgagcaggctgccgagaaaatgctgaagaaagccagcaaggagatctaccagttgcgaggacaatcacacaaggagcccatacaagttcagacctttcgagaaaagattgcattcttcactcgccctcgcatcaatattccgcctctgccggctgacgatgtgtag

SEQ ID NO: 61193 - DNA, 210 bp, Artificial Sequence
  Description of Artificial Sequence: Synthetic coding sequence
atggagtcccctaagaagaagaatcagcagctcaaggttggcatactgcacttggggtctagacaaaaaaagatacggatccaactcaggtcccaagtgctgggtcgagaaatgcgcgacatggagggagatctccaggagttacatcagagcaacactggggacaagagtggctttggctttaggaggcagggtgaagataacacttag

SEQ ID NO: 61194 - DNA, 441 bp, Artificial Sequence
  Description of Artificial Sequence: Synthetic coding sequence
atgctgctatggtgcccaccccagtgcgcctgctctcttggtgtttttccaagcgctcccagccccgtctggggaacaagacggtcatgcgaaccagctacccgcgtgcctgaggtgtggatcctgtccccgctactccggcacggcggacacacccagactcagaaccacacagcatcccctagatctcctgtcatggagtctcctaagaaaaaaaatcaacagttgaaggtcggcatccttcaccttggctcacgccaaaagaagatccgcatccaactgcgctcacagtgtgctacctggaaggtaatttgcaaaagttgtatttcgcagaccccaggcatcaatttggatctcgggtctggggtcaaggtcaagatcattccgaaggaagaacattgtaagatgcccgaggccggtgaagaacagccccaggtatag

SEQ ID NO: 61195 - DNA, 441 bp, Artificial Sequence
  Description of Artificial Sequence: Synthetic coding sequence
atgctgctgtggtgtcctccccaatgcgcttgctccctaggggtttttccctcagctccatcccctgtgtggggaacaagaaggtcctgcgagccagcaacacgcgttccagaagtctggattctctcgcccctgctgagacatggcggacatacgcagacccagaatcataccgccagcccacggagccccgtgatggaatccccgaagaaaaagaatcagcagctgaaggtcgggatcttgcatctcggtagcagacagaagaaaataagaatccagctgaggtcacaatgcgccacctggaaggtaatttgcaagagctgcattagtcagacacccggaattaatctggatctgggttctggggtcaaggtcaaaataatcccgaaagaagagcattgcaaaatgcctgaagctggtgaggagcagccacaggtctag

SEQ ID NO: 61196 - DNA, 210 bp, Artificial Sequence
  Description of Artificial Sequence: Synthetic coding sequence
atggagagccctaaaaaaaagaatcaacagctgaaggtgggcatcctacacctgggatcaagacagaagaagattagaattcaacttcgtagccaggtgttggggagagagatgagggacatggagggggacttgcaagaattacatcagagcaacactggcgataaaagcggatttggttttaggagacagggagaggacaacacgtag

SEQ ID NO: 61197 - DNA, 336 bp, Artificial Sequence
  Description of Artificial Sequence: Synthetic coding sequence
atgatctggcgcggacgctccacttatcgcccacgtcctcggaggagcgtgcctccccctgagctgatcggccctatgttagagccaggagatgaagaaccccagcaggaagagccaccaactgaatcaagggaccccgcacccggacaggagagagaggaggaccagggcgcagccgaaacccaagtccctgacctggaggcagatctacaggagctgagtcagagtaagactggtggtgagtgtgggaacgggccagacgaccagggaaaaattttgcctaagtctgagcaattcaagatgccagagggaggggatcggcaaccccaggtgtag

SEQ ID NO: 61198 - DNA, 336 bp, Artificial Sequence
  Description of Artificial Sequence: Synthetic coding sequence
atgatctggagggggaggtcaacgtacaggccaagacctcggaggtcagtgccgccaccggaattgattggtccaatgctagaacccggtgacgaagagcctcagcaagaggaacctcctaccgagtcccgggatccggctcctggccaggagcgagaggaggaccagggtgctgctgagacgcaggtcccggacctagaggctgatctgcaagaattatctcaaagcaagaccgggggtgaatgcggaaacggtccagatgaccagggcaagatactgcccaagtccgaacagtttaagatgcctgagggtggagatcggcagccacaggtctag

SEQ ID NO: 61199 - DNA, 327 bp, Artificial Sequence
  Description of Artificial Sequence: Synthetic coding sequence
atgtcatggagaggcaggcgctacagaccgaggcggtgcctgcgcctggcccagctcgttggcccaatgctagagccatctgtgcctgaaccccaacaggaggaaccacccacagaaagccaggatcatactcccggacagaaacgtgaggatgaccagggcgcagctgagatccaagttcctaacctcgaggccgatctgcaggagctttctcaatctaagactggcgatgagtgcggagactctcccgatgtacagggaaaaatactgcccaagtcggaacaattcaaaatgcctgaaggcggtgagggaaagccacaattatag

SEQ ID NO: 61200 - DNA, 246 bp, Artificial Sequence
  Description of Artificial Sequence: Synthetic coding sequence
atggaatctcccaagaaaaaaaatcagcagcttaaagttggtattctccatctcggaagccggcaaaagaaaattcggattcagctaagatctcagtgcgccacctggaaggtaatctgcaaatcctgcatcagccagacacctgggataaatttggacctgggatcaggagtgaaggttaaaatcattcccaaagaagagcattgtaaaatgccagaggctggtgaagagcagccccaagtttag

SEQ ID NO: 61201 - DNA, 441 bp, Artificial Sequence
  Description of Artificial Sequence: Synthetic coding sequence
atgttgctttggtgtcccccacagtgtgcatgctctctaggcgtttttccctctgcccctagccccgtttgggggacacggagaagctgcgagcctgcgacgagagtcccagaggtgtggatacttagtcccctcctccgtcacggcggacacactcagactcagaaccacaccgcgagtcccagatcccctgtgatggaaagcccaaaaaagaaaaaccagcaactgaaggtaggcatactgcacttggggagtaggcaaaagaagatcaggattcagcttcgttcacagtgcgccacttggaaggttatatgtaaatcctgcataagccaaaccccgggaatcaacctggacttgggctccggcgttaaggtcaagattattcctaaagaggagcattgcaaaatgccggaagccggtgaggaacagccccaggtgtag

SEQ ID NO: 61202 - DNA, 210 bp, Artificial Sequence
  Description of Artificial Sequence: Synthetic coding sequence
atggaaagccctaagaagaagaaccaacaactgaaggtcgggatcctccatctgggatcaagacagaaaaagatccgcatacagctccgtagtcaggttctcgggagagagatgcgagacatggaaggggatttgcaagagctgcatcagagcaataccggggacaagagtggattcggattcaggcgccaaggggaagacaacacatag

SEQ ID NO: 61203 - DNA, 336 bp, Artificial Sequence
  Description of Artificial Sequence: Synthetic coding sequence
atgagttggcgaggacggagcacttaccgtccaaggcctagaagatctctgcagcccccagaactgatcggcgctatgctggaacccacagacgaggaacccaaagaggaaaagcctcccactaaatcccgcaaccccacacccgaccagaaaagagaggacgatcagggagctgccgaaatccaagtgccggatctggaggctgacctgcaggagttatgtcagacaaaaactggggatgggtgtgagggaggaactgacgtcaaaggcaagatcctccccaaagctgaacacttcaaaatgccagaggcaggcgaaggcaagtcccaggtctag

SEQ ID NO: 61204 - DNA, 336 bp, Artificial Sequence
  Description of Artificial Sequence: Synthetic coding sequence
atgtcttggcgaggcagaagcacataccggcctcgaccgaggagatcccttcagcctcctgagctcatcggcgctatgctcgagcccacagacgaggagcccaaagaagagaaacctccgacaaagagtagaaaccccactcctgatcagaagcgtgaggatgatcagggcgcagcggagattcaagtgcctgacctggaagccgacctccaggagctttgtcagacaaaaaccggagacggttgtgaaggaggcactgatgtaaaggggaagattctccctaaagccgagcacttcaagatgcctgaggctggtgagggtaaaagtcaggtgtag

SEQ ID NO: 61205 - DNA, 327 bp, Artificial Sequence
  Description of Artificial Sequence: Synthetic coding sequence
atgagctggagggggcgtcgctaccggccaagacgatgcctgcgtctcgctcagctggtcggtcccatgctggaaccttcagtgccagagccacaacaggaggagccccctaccgaatctcaggaccataccccaggccagaagagagaggacgatcagggcgcagccgaaatccaggtgcctaacctcgaagccgacctgcaggagctgtcgcagagcaagacaggcgatgagtgcggtgatagtccagatgttcagggcaaaattcttcccaagtcagaacagttcaagatgcctgagggaggcgaagggaagccacagctttag

SEQ ID NO: 61206 - DNA, 327 bp, Artificial Sequence
  Description of Artificial Sequence: Synthetic coding sequence
atgagctggcgaggccgtaggtaccgccctagaagatgtcttcgccttgcgcagttagtcggaccaatgctcgagccctctgtgccagaacctcagcaggaagaacctccaactgaaagccaggaccacactccaggccaaaagagagaggacgatcagggcgctgcagaaatccaggtccccaatttggaggcggacctgcaggagttgagccagagcaaaactggggacgagtgtggagactctcccgatgtgcagggaaagatcttgccaaagtccgaacagtttaagatgccggaaggcggagagggcaaaccccaactctag

SEQ ID NO: 61207 - DNA, 228 bp, Artificial Sequence
  Description of Artificial Sequence: Synthetic coding sequence
atgagttggagaggcagacgctaccgtcctcgccgttgccttcgactggctcaattagtgggcccaatgctagaaccttcagtgcctgagcctcagcaggaggagcccccaacagaatcccaagatcacaccccagggcagaagcgcgaggatgaccagggtgccgctgagatacagggaacctctattctggcacaggacaagacacaattcagtgaaaccgggtag

SEQ ID NO: 61208 - DNA, 327 bp, Artificial Sequence
  Description of Artificial Sequence: Synthetic coding sequence
atgtcatggcgcggtcggaggtaccgcccacgtcgttgcttgcgcctggcacagttggtcgggcctatgcttgagccctctgtccctgagccgcagcaggaggagccaccaaccgaatcccaggaccacacccccggtcaaaagcgcgaggatgatcaaggggcagccgaaatccaggtgcctaatctggaggccgacctgcaggagttgtcacagtctaagacaggagatgagtgcggagactcaccagatgtccagggaaagatattgcccaagtccgaacagttcaagatgcccgagggaggtgagggcaagccccagctatag

SEQ ID NO: 61209 - DNA, 270 bp, Artificial Sequence
  Description of Artificial Sequence: Synthetic coding sequence
atgaaatataccaaacagaacttcatgatgagcgtcctgggcataattatctacgtgaccgatcttatagtggatatatgggtgtccgtacgattttttcatgaggggcaatacgtttttagtgctctcgctctctcatttatgttatttggtacgctggtggcccagtgtttctcttatagctggttcaaagcagatttgaagaaagccggacaggagtctcagcactgttttttgctgttgcattgcctgcagggcggtgtgttctag

SEQ ID NO: 61210 - DNA, 492 bp, Artificial Sequence
  Description of Artificial Sequence: Synthetic coding sequence
atgcggagactgctgattccactggcactgtggcttggggctgtgggcgttggggtcgcggaacttactgaggctcaacgccgaggactgcaagttgcactggaggagttccacaagcatccgcctgtgcagtgggcttttcaagaaacctccgtggaaagtgccgtggataccccatttccagctgggatctttgtgcgtttagagttcaaactccagcagactagctgtagaaaaagagactggaaaaaacccgagtgcaaggtgaggccgaatggcaggaagcggaaatgcttagcatgtattaaactcggaagcgaggataaggtcttagggcgactggtgcactgcccaatcgaaacacaggtgcttcgggaggccgaagagcaccaggaaacccaatgtctcagggtgcagagggctggggaggacccgcacagtttttacttcccaggtcagttcgcattttctaaagcactccctaggtcctag

SEQ ID NO: 61211 - DNA, 621 bp, Artificial Sequence
  Description of Artificial Sequence: Synthetic coding sequence
atgtcttgggtgcaagccgctagtctgatacagggccctggcgacaagggcgacgttttcgatgaggaggcggatgagtctctactggctcagagggagtggcaaagcaacatgcagcgcagagtcaaggaggggtatcgagacggcatcgatgcaggcaaagccgtgactctgcagcagggcttcaaccaaggctataaaaagggcgctgaagtgattttgaattatggacgcctccggggaacactcaggaatagcaccgactggtctctgctcggtcttcgcgctcctctgcggtctcctgaggtggggacccagttgttgccacgcccactaccggttcccggtcacatggcctccggagcaacacctaagcagcccactgagctggaagccacgcttctgtcgctggtcccacaaagtgggagggccacaccaagattccccgctcgcctgcgggctccgggtcccggtactccctcccatcgcagacgattcagaagaaagcctcatcgtgatccggctgccgcttgtccggcatggccgccagaggccccatctaattccgagactcatttctctacttacaataggatcatcattcgaggtggccacatctag

SEQ ID NO: 61212 - DNA, 972 bp, Artificial Sequence
  Description of Artificial Sequence: Synthetic coding sequence
atgtctcgtcctcgcatgagacttgttgtcactgcagacgatttcgggtactgcccacgcagggatgaggggattgtcgaggcgtttctcgctggtgccgttaccagcgtcagcttgctcgtaaacggtgctgcaacagaatcagccgcagagcttgctcgaagacacagtatacccacgggcctccacgctaatctgtcggaaggacgacccgtagggccagcccgaaggggggcatcatcactcctcggaccagagggtttcttcctggggaagatgggcttccgtgaggccgtggctgccggagacgtagatcttccacaggtgcgggaggagttggaggcccagctcagctgttttagagagctgctgggtagagccccaacccatgctgacgggcaccagcacgtgcatgtgttgcctggagtctgtcaggttttcgctgaggccctgcaggcgtatggggttaggttcacacgactccctctcgaacgaggggtgggcggatgcacttggcttgaggcgccagcccgagcctttgcctgtgccgtcgaacgcgacgccagggccgcagttgggccattctccagacacgggctgcgctggaccgacgccttcgtcggtctgtccacatgcggtcggcacatgtccgctcacagagtatccggtgcccttgccagggtgctcgagggtacgctggccggacacactctgaccgctgagttgatggcacatccagggtaccccagcgtgccaccaactggaggatgcggggaggggcctgatgccttttcttgtagctgggaaagactgcatgagctgcgggtgctgaccgccccaacccttcgcgctcagcttgcccaggacggagttcaactatgcgccctcgacgatctcgactcaaagcggcctggggaagaggtgccttgcgagcccaccttggagccattcctggagccttcactgttgtag

SEQ ID NO: 61213 - DNA, 450 bp, Artificial Sequence
  Description of Artificial Sequence: Synthetic coding sequence
atgtccagaccaagaatgagactggttgtcacagccgacgactttggttactgtcccagacgagatgaaggcatcgtcgaagccttccttgccggtgcagtaacatcagtgagtttgctagtaaatggggctgcaactgagagcgcggctgagctcgcaaggcggcactccataccaaccgggctacacgccaatctcagcgaaggccgtcccgtcgggcctgctcggagaggagctagcagtctgctgggccctgagggcttcttcctcgggaagatggggttcagagaggctgtggcagccggagacgtggatctgcctcaggtaagagaagaattagaggctcagctgtcttgcttccgggagctcttgggcagggccccaacccacgcagatggacatcagcatgtgcacgtactgccagggggacagacaccatcttgggcatag

SEQ ID NO: 61214 - DNA, 900 bp, Artificial Sequence
  Description of Artificial Sequence: Synthetic coding sequence
atgtcttctgcggcaggacctgatccatctgaagcccctgaggagaggcatttccttcgcgctctggagctgcaacctccactggctgacatggggagggctgagctgtcatctaacgccactacatctttggtgcagcgtagaaagcaagcctggggacgccagtcctggctggagcaaatttggaatgccggtcctgtttgtcagtcaacagcagaagctgctgctttagagcgggaattgttggaggactatcgattcggcagacagcaattagtggaactgtgtgggcatgccagcgcagttgccgtcactaaggccttccctttgcctgcactgtcaagaaaacaacgcaccgtcctggtggtctgtggccctgagcagaacggggcagttggattggtgtgcgccaggcacctgagagtattcgagtacgaaccgactatcttttacccaaccagaagtctagacctactgcatagagatctgacaacacagtgtgaaaagatggacatcccgttcctgtcctaccttcctactgaggtacagctcattaacgaggcgtacggattggttgtcgatgctgtcctcgggcctggcgtggaaccaggcgaggtggggggaccttgcacaagagcactcgcaacacttaagctgttaagtatccctctggtttctcttgacatccccagtgggtgggatgcggaaactggctccgattctgaggacggattgcgtccagatgtgttggtgtctctcgccgctcccaaacggtgtgccggtcgtttttctggcaggcaccacttcgtcgcaggacgctttgtgccagacgatgttcgaaggaaattcgcccttcggctacctgggtataccggtacagactgtgtggccgctctgtag

SEQ ID NO: 61215 - DNA, 750 bp, Artificial Sequence
  Description of Artificial Sequence: Synthetic coding sequence
atgtccagcgctgctgggcctgacccctctgaggccccagaggaacggcattttctgagtacggccgaggccgctgctctggaaagagagctgctggaggactaccggttcggtaggcagcagctggtggaactatgcggccatgcctccgcggtggccgttactaaagcattcccgctgcccgcactgagcaggaagcagcgcacagtcctggtcgtctgcgggccagagcagaatggggctgtgggcttggtgtgtgccaggcacctgcgtgtatttgagtatgaacccacaattttttatcctacccgatcgttggatctgttgcatcgggacctaactacacagtgcgaaaaaatggatatccccttcctgtcttacttaccaacagaggtgcagctaatcaatgaagcttacggcctggtggtcgatgcggtgctgggaccaggcgtagagccaggcgaggtgggcggtccctgtaccagggccctggccacactgaaacttctctctatcccgttggtttcactggatattccctcaggctgggacgccgagactggatcagacagtgaggacgggctgcggccagacgtccttgtcagcctggctgcacccaaaaggtgcgcaggcaggttctccgggcgtcatcactttgtcgctggccgttttgtgcccgatgatgtgcgcaggaagttcgcactccgcctccccggatacactggaaccgattgcgtggccgcactctag

SEQ ID NO: 61216 - DNA, 750 bp, Artificial Sequence
  Description of Artificial Sequence: Synthetic coding sequence
atgtccagcgcggcagggccagacccctccgaggcccctgaggaaaggcacttcctgtcaacagctgaggccgcagctcttgagagggagctcctggaggactacaggtttggcagacagcagctggtggaattatgtggacatgcaagtgccgtagcagtaactaaagcatttcccctgccggcactctcacgtaaacaaaggacggtcctggtagtctgcggtcctgaacagaatggtgccgtcggattggtgtgtgctcgtcatcttcgggtctttgagtatgaacctaccatattctaccctacccgctctttagatttgctacatagagacttaactacacaatgcgagaaaatggatatacccttcttgagctacttgcccactgaagtgcagctcattaatgaggcctatgggttggttgtggacgcggtactcgggcctggcgtggagccaggagaggtaggaggcccatgcaccagggccctggcaactctcaaactgctgtcaattcccctcgtgtctctggacataccatctggatgggatgcggagacgggatcagattcagaggacggcttgcggccagatgtgctggtgagccttgccgctcctaagcggtgcgctggccgtttcagtggcagacaccactttgttgccggaaggtttgtgcctgacgacgtccgcaggaagtttgctttgagactgcccggatacactggaacagactgcgtcgccgcactgtag

SEQ ID NO: 61217 - DNA, 900 bp, Artificial Sequence
  Description of Artificial Sequence: Synthetic coding sequence
atgtcctcagctgccggaccggatccgtctgaagctcctgaagagcgacactttctccgtgctcttgagctccagccccctctagctgatatgggacgcgctgagttgagcagcaatgctacaacaagcctggttcaacgaaggaaacaggcttggggtcgacaaagctggctagaacaaatttggaacgcaggacccgtgtgtcagagcactgcagaagcagccgcactggaaagggaattgctggaagactatcggttcgggaggcagcagctggtcgaactctgtggacacgcctctgccgtggcagtcaccaaggcatttccactaccagccctgtcacgtaagcagagaactgttctggtggtgtgcggacccgaacagaacggtgctgttgggctcgtgtgtgctcggcacctgcgggtttttgaatacgagcctaccattttctatccaacgagatctctagacctgctccacagagacttgaccacacagtgtgaaaagatggatattccatttctgtcgtacctcccgaccgaagtccagctcatcaacgaggcctacggactggttgtggacgcagtgctgggacccggtgtggagcccggagaagtgggagggccatgcacgcgtgccctggctactctgaaacttctcagcatccccttggtatccttggatattccctccggatgggatgctgagactggcagcgattctgaagatggcctccggccagacgtactggttagccttgccgctccaaaacggtgtgctggcaggttctcggggcgacatcacttcgtagcaggacgattcgtgcctgacgacgtgcgccgtaaattcgctttgcgtctccccggatacactggaacagattgcgtcgccgctctgtag

SEQ ID NO: 61218 - DNA, 822 bp, Artificial Sequence
  Description of Artificial Sequence: Synthetic coding sequence
atggccgcttcaaaggtcaaacaggacatgccccctccaggaggctacgggccaattgattacaaaaggaacttgcctagacggggactcagcggctacagtatgcttgcaattgggattgggacgttgatttatgggcattggagcataatgaagtggaacagagagcgtcgccgacttcagatagaggattttgaggcacggatagccctcctgccccttttacaggccgagacggaccgacgtacattgcaaatgcttagggagaatttggaggaggaggcaatcatcatgaaggacgttccagactggaaggccttccctttacccgctttatccaggaagcaacggacagttctcgttgtgtgtggaccagaacaaaatggtgccgtggggctggtttgcgccagacacctgcgggtatttgagtacgagcctactatattctacccaacacggagcttggacctcttgcacagggatttaaccacacaatgtgagaaaatggacatcccatttctcagttaccttcccaccgaagtgcaactcatcaacgaagcttacggactcgtggtagatgcagtgctgggccctggcgttgaacctggagaggttggcggtccctgcacccgggctctagccacactcaagctcctgagtattcccctggtctccctggacattccaagcgggatgcccggtcggggaggacacattggggcttggggcgcatgggttgaagctcccgttcctcaactgttggtcgcccctgcttgcctgaaccttaacttgccctctcttgacggcccaaccctgggatag

SEQ ID NO: 61219 - DNA, 507 bp, Artificial Sequence
  Description of Artificial Sequence: Synthetic coding sequence
atggaatttgtgccaggcggtagtatctcgagtattattaaccgcttcggcccactgcctgaaatggtcttttgtaaatacacaaaacagatacttcagggagttgcttacctgcacgaaaactgcgtcgtacatagagatataaagggtaataatgtgatgctgatgcctacagggattatcaaactgatagactttgggtgcgcgcgaagattggcctgggcagggcttaatggaacacattctgatatgctgaaatccatgcacggcactccctattggatggcgcctgaagtaatcaacgagtctggatatggtcggaagagcgacatttggagcattggctgcaccgtgttcgagatggctacgggtaagccacccctggcttccatggacagaatggcagccatgttttatattggggctcaccggggactgatgccaccactgcccgatcactttagtgagaacgcagcggacttcgtgagaatgtgtctgactaggtag

SEQ ID NO: 61220 - DNA, 3648 bp, Artificial Sequence
  Description of Artificial Sequence: Synthetic coding sequence
atgtctagcatgccaaaacccgaacgccacgctgagtcactgctggacatctgtcatgatacaaattcttctccgaccgatttaatgacagtgactaaaaatcagaacattattctacaatccatttctcggtcggaagagtttgaccaggatggcgactgcagccactctaccttggtgaacgaggaagaagacccgtcagggggaaggcaggactggcaacctagaacagaagagtttagcaccagtcacatgaagtattctggtaggtccattaagtttctccttccaccactgtcactccttcctacgcggtctggcgttctcacaattccacaaaatcataaatttcccaaggagaaggagagaaatatcccatctctcaccagctttgtcccaaagctgtccgtgtcagtgcggcaatccgatgaattgtcccctagcaatgagccacctggcgctctcgtgaagtctcttatggaccccaccctgcgtagcagcgacggcttcatctggtcaagaaatatgtgcagctttcctaagactaatcatcacaggcaatgtttagaaaaggaggagaactggaaatcaaaagaaatcgaggagtgtaataagattgagattacacatttcgaaaagggccaatccctcgtgagctttgagaatctcaaggaaggcaacatcccggctgtgcgcgaggaggacatagactgtcacggctctaagacccgcaagcctgaagaggaaaatagccagtatctgtcctctcggaagaatgagagttctgtggccaaaaactatgaacaggatcccgagattgtgtgcacaattccatctaagtttcaagagacacaacattcggagattacaccatctcaggacgaggagatgcgaaataacaaggccgcatcaaagagagtttcattgcataagaatgaagcaatggaacctaacaatatattagaggagtgtaccgttttaaaatcactgagtagtgtagtgttcgatgatcctatcgacaagctcccagagggctgtagctcaatggagacgaatatcaagatttcgatcgcagagagggctaagcctgaaatgagccggatggtcccactgattcacattaccttcccagtagatggttctcccaaagaaccggtgatcgcaaaaccatccctccaaactcgtaaggggaccatccacaacaaccactccgtaaacatacccgtgcatcaggagaatgacaagcacaaaatgaactcgcatagaagcaagttggatagcaaaacaaaaacatcaaagaaaactccacaaaattttgttataagcactgaaggcccaattaagcctaccatgcacaagaccagcattaagacccagatcttccctgctctggggctggtcgacccgcgtccctggcagctccccaggttccaaaaaaagatgccacagattgctaagaaacagtcaactcaccgaacgcagaagcctaaaaagcagtctttcccttgcatctgtaaaaaccctggcacacaaaagtcctgcgttcctctcagtgttcagcctaccgagcctaggctgaattacttggatctgaaatattccgacatgtttaaggagattaatagtaccgccaacggacccggtatatatgaaatgttcggaacaccagtgtattgccatgtgcgggaaacagagcgggacgaaaatacgtattaccgagagatctgctccgccccaagtgggagacgcattacgaacaagtgccgctcgtctcactccgagagaaagtcaaatatacgaactcggctgtctcaaaaaaaaactcacatgaagtgccctaagaccagcttcgggattaaacaggagcataaggtgctgatcagtaaagagaaatccagcaaagccgtgcatagcaatcttcacgacatcgagaatggcgatgggatcagtgaacctgattggcagatcaagagcagcggtaacgaatttctctcatcaaaggatgagattcacccaatgaacttggcccagacgcccgagcagagcatgaagcagaacgagtttccacctgtctcagacctgagtatcgtcgaggaagtgagcatggaagaaagtaccggcgatcgcgacataagcaataatcagatcctgactactagtctacgtgacctccaggagctggaagagttacatcatcaaatcccatttatcccctcggaagactcatgggccgtgccctccgagaagaattctaataagtacgtgcaacaggaaaagcagaacacagcttcattgtctaaggtcaatgcctccagaatcttgactaacgacctggaattcgattcagtctcagaccactcaaaaactctgaccaacttttccttccaggctaaacaagaaagcgcctcttcacagacgtatcaatattgggtccattacctcgatcacgattcactagctaataagtccataacataccaaatgtttggcaagacgcttagcggaacgaatagtattagccaagagattatggattcagtcaacaatgaagaactcacagatgagttgcttgggtgccttgccgctgaactgttggccctggacgagaaagacaataattcttgtcagaagatggctaacgagacggacccagagaacctcaatttggtgcttcgctggcggggatccacccctaaagagatggggcgagagactaccaaggttaagattcagcgccacagctctgggctgagaatctatgacagagaggaaaagtttctgataagtaatgagaaaaaaatattctcagagaatagcttaaaaagcgaagaaccaattttgtggacaaagggggagattttaggtaaaggtgcttatgggaccgtgtattgtggcttaacctcccagggacaactgatagccgttaagcaggtggctctcgatacttccaacaaactagcagccgaaaaggaataccgcaagctacaggaagaggtggatctccttaaggctttgaaacacgttaacatcgtggcctatttgggaacctgtcttcaggagaacactgtctcaatttttatggagtttgtgcccggaggtagtattagttccattatcaaccgtttcggacccctcccggagatggtcttctgtaagtacaccaagcagatactgcagggggtagcctacttacacgaaaactgtgtggtgcatcgggatatcaagggcaataatgtcatgctgatgcccaccgggatcatcaaactgatagacttcggatgtgcaagaaggctagcatgggcaggcctgaatggcacccattccgatatgctgaaaagtatgcacgggacgccctattggatggcgcctgaggtaattaacgagtctggctatgggcgaaagtccgatatatggtccatcgggtgcactgtgttcgagatggctaccggcaagccaccacttgcctcaatggaccgcatggccgcaatgttctatatcggtgcccaccggggtctcatgccaccacttcctgaccacttttccgagaacgcggcagattttgtgaggatgtgccttacacgcgatcaacacgagcggccaagcgccctgcaacttttgaagcatagcttcctggaaaggtcccattag

SEQ ID NO: 61221 - DNA, 1533 bp, Artificial Sequence
  Description of Artificial Sequence: Synthetic coding sequence
atgtcctccatgcctaaaccagagcgtcacgctgagagccttctcgacatttgtcacgatacaaacagctcgccgacagatctcatgactgtgacgaagaaccagaacatcatccttcagagcatatcacggagcgaagagttcgatcaggacggcgactgctctcattccactttagtgaatgaggaggaggatcctagcggcggacgacaagactggcagccacgcactgagggggttgaaatcacagtgacattcccgagggatgtcagtcccccacaggaaatgagccaggaagacttaaaggaaaaaaatctgatcaactcctccttgcaggagtgggctcaagcccatgctgttagtcacccaaatgagatcgagacggtggagctgcgcaaaaaaaaactgactatgaggccgctggttctgcagaaggaggaatcaagcagagaactttgtaatgtgaacttaggctttttgctaccacgctcctgcctggagcttaacatcagcaagtctgtgactcgagaagatgccccacacttcctcaaggagcagcaaaggaaatccgaagaattttccaccagtcacatgaagtacagtgggagatctatcaagagacacagcagtggcctgagaatctacgaccgggaggagaagttcctcatctccaacgaaaagaagatatttagcgagaattctctcaaatccgaggaaccaatactgtggacaaaaggtgagatattaggaaaaggcgcttatggtaccgtctactgtggcttgaccagccaaggccagctgatagctgtcaagcaagtggctctggacacaagcaacaagctcgccgctgaaaaggagtacaggaagctacaggaggaggtggacttactgaaggccctgaagcatgtcaatatcgtcgcataccttggaacctgcttgcaagaaaataccgtgagcatttttatggagttcgtgcctggtggctcaatatcctcgatcattaataggttcgggcctctgccagaaatggttttttgtaagtacaccaagcagatcctccaaggggtggcgtacctccacgagaattgcgtagtacaccgggatatcaagggtaacaacgtaatgctgatgccaacaggaattataaaactgattgatttcggttgtgctcgcagactggcatgggcaggtctgaacggaactcacagcgatatgcttaaatccatgcacgggacaccctactggatggcccctgaagtcataaatgagtctggatatggccgaaaatccgacatctggagtatcggctgcaccgttttcgaaatggccacagggaagccgcctctggcctctatggataggatggctgcaatgttctatatcggggctcataggggactcatgcccccactgccagaccattttagcgaaaatgcagccgacttcgtgcgtatgtgtttaaccagagatcagcatgagaggccctcagccctgcaactgctgaaacacagttttctggagcgttctcactag

SEQ ID NO: 61222 - DNA, 3987 bp, Artificial Sequence
  Description of Artificial Sequence: Synthetic coding sequence
atgagctctatgccaaaacccgaaaggcatgccgagtctctgctggatatatgccacgatactaatagcagtccaactgatttaatgactgtgacgaaaaatcagaacatcatcctgcagtctatctctcgctcagaggaatttgaccaagacggcgattgcagtcactccacactggtgaatgaggaagaagacccctcggggggaaggcaggactggcagcctcggactgaaggggttgagattaccgtgactttcccacgcgatgtatcgccgcctcaagagatgtcccaggaagacctcaaagagaaaaacctgattaactcaagcttgcaggagtgggcacaggctcatgctgtcagtcacccaaacgaaattgaaacagttgaactacgcaaaaagaagctgacaatgaggccactggtacttcagaaagaggagtctagtcgcgaactgtgtaatgtaaacctgggcttcttacttccacgcagctgcctggaattgaatatcagcaaaagtgtgaccagagaagacgccccacattttcttaaagaacagcagaggaagagtgaagaatttagcacttcacacatgaaatattctggtcggtccatcaagttcttactgcccccactcagtctgctgccaactaggagcggggttctgactattccccagaatcacaaattcccgaaagaaaaagagagaaacatcccctccctcaccagctttgtacctaagctgagcgtgtctgttcgccaatcagacgagctgtcaccgagcaatgagccacccggtgccctcgtgaagagcctgatggaccctactctgcgtagcagtgacgggtttatttggagtcggaacatgtgttcatttccgaaaacaaatcatcaccggcagtgtctggagaaagaggaaaattggaaaagtaaagagatagaagagtgtaataagattgaaatcacacattttgaaaaggggcagagtctagtgtcattcgagaacctgaaggaggggaatattcctgcagttcgggaggaggacatcgactgtcacggatcaaagacccgtaagccggaggaagaaaacagtcaatatttgagcagtagaaaaaatgagtctagtgtggccaaaaattacgaacaggaccccgaaattgtatgcactatccccagtaagtttcaggagactcagcactcggaaatcaccccctctcaggatgaagagatgcgcaacaacaaagcagccagcaagagggtatcactgcataaaaacgaggccatggagcccaataacattctggaggagtgtacagtactgaagtcactctcatccgtcgttttcgatgatccaatcgacaaactgccagaagggtgttcctccatggagaccaatattaaaatatctattgctgaacgagccaagccggagatgtctcgcatggtcccattgatccatatcacctttccggtggacgggtcccccaaggagcctgttatcgcgaagcctagcttgcagacccgcaaaggcaccatccacaacaaccacagcgtcaacattccggtccatcaggaaaacgataaacacaaaatgaatagtcaccgttcgaaactggattcaaaaaccaaaacctcaaaaaaaactccccaaaactttgtgatttcaaccgaggggcctataaaacccaccatgcacaagacttctatcaaaacacagatttttccagctttgggattggtggatcctcgaccctggcagttacccaggttccagaaaaaaatgccacagattgccaaaaagcagtcgacacatcgcacacagaaacctaaaaagcagtctttcccatgcatttgcaagaatccaggtacacagaaaagctgtgttccgctgtcagtgcagcccactgaaccgcgtttaaattatttggatctgaaatattcagatatgtttaaggagatcaactccaccgccaacgggcctggcatttatgagatgtttggaactccagtgtactgtcatgtgcgcgaaaccgagagggacgaaaacacttactaccgcgagatctgcagcgccccaagcggcaggcgcattacaaacaagtgtaggtcatcccactctgaaaggaaatctaatatccgaactcggctgtcacagaagaaaactcacatgaagtgtccgaagacaagctttgggatcaagcaggagcacaaggttctaatcagcaaagaaaagagctcaaaagctgtccactcaaatctgcatgacatcgagaatggggatgggatatcagagccggattggcagatcaagagttccggcaacgagttcctaagttccaaggatgagattcatcctatgaatctggctcaaacacccgaacagtctatgaagcagaacgagttccctcctgtgtccgatctgtcaattgtggaggaggtgtcgatggaggaaagtaccggtgaccgcgacatttctaacaatcaaatactgacaacctcccttagagacctccaggaactcgaggagttacaccaccagatcccctttatcccatctgaggattcatgggccgtcccaagtgagaaaaactcaaacaagtatgttcaacaggaaaagcagaatactgcatcactctccaaggtaaatgcatcaagaattctaacgaatgacttggaattcgattcagtctccgatcacagtaaaaccctcacaaacttctcctttcaggccaagcaagagtctgccagctcacaaacgtaccagtactgggtccattatttggatcatgatagcctggcaaataagagcatcacttaccagatgttcggcaaaacactttcgggtacaaattccatatcccaggagatcatggattccgtgaataatgaagaactgactgacgaactcctcggctgcttggccgcagagctactggccctcgacgagaaggacaataactcttgccagaaaatggctaacgaaaccgatcctgaaaacctaaatctcgtgctccggtggcggggatccacccccaaagaaatgggacgcgagaccaccaaggtcaaaatccagcggcactctagcggccttcggatctacgaccgtgaggaaaagtttctgatatcaaatgaaaaaaagatttttagcgagaactcgttgaaatccgaggagcccatcttatggactaaaggggagatcctcggcaagggcgcttacggtaccgtatattgtggcctgacctcccagggccagctgattgctgtgaagcaggtggctctggatacctctaataaacttgccgctgaaaaggagtacaggaaactccaggaggaggtcgatctactgaaggctctcaaacatgtcaatattgtagcatatctaggaacatgcttacaggaaaacactgtaagtatattcatggaatttgtgccaggaggcagcatctcttcaattatcaaccgatttgggccactgcctgaaatggtattctgtaaatacacaaaacaaattctgcagggcgtagcctacctgcacgagaactgcgtcgtgcacagagatataaagggcaacaatgtgatgcttatgcctacaggcatcataaagctaatcgattttggttgtgctaggcgccttgcttgggcaggcttaaacggaacccattccgatatgctgaaaagcatgcacggtacgccctactggatggctcctgaggtaatcaatgaatctggatacggccgaaagtcagacatctggtccattggctgcacagtgtttgaaatggcaaccggcaaacctccgctggcgtctatggatcggatggccgcaatgttctatattggggctcaccgtggattgatgccccctctgcctgaccattttagtgagaatgccgcagatttcgtccggatgtgcctgactcgggatcagcatgagcgcccttccgcgctgcagcttttgaaacacagtttcctggagcggagccattag

SEQ ID NO: 61223 - DNA, 1383 bp, Artificial Sequence
  Description of Artificial Sequence: Synthetic coding sequence
atgagctccatgcctaaacccgagcggcatgctgagagccttctggacatctgccacgataccaactcctctccaactgatctcatgacggttacaaagaaccagaatatcatcttgcagagcatctcacgctctgaggagtttgaccaggatggagactgctcccactccaccctggtgaacgaggaggaagatcccagtggtggccgacaggattggcagcctagaactgaaggcgtggagatcactgtgactttcccacgggatgtgagccctccccaggaaatgagccaggaagacctaaaggagaaaaatctgatcaactctagcctgcaggaatgggcacaggcgcacgccgtgtcacacccaaacgaaatcgagacagtggagctgagaaaaaaaaagttgacaatgcgcccactagtgctccagaaggaggaatctagccgggagctttgcaacgtgaacctggggtttctgcttccgaggtcttgcctggagttaaacatatccaagtcagtgacacgtgaggatgctccccatttcttgaaggagcagcagagaaagtcagaggagttttctacttctcacatgaaatactccggccgatctattaaggtctactgcggactgacgagtcagggccagctgatcgccgttaagcaggtcgccctggacacctctaataagctggcagcggaaaaagagtacaggaagctgcaagaggaggtggatcttctgaaagcattgaagcacgtgaatattgtggcttacctgggtacctgtctccaagaaaatacggtgtctatctttatggaattcgtccctggtggctctattagtagtatcatcaacaggttcgggccacttccagagatggtgttctgcaagtatactaagcagatcctccaaggtgtggcatacctgcacgagaattgtgtcgtgcatagagatattaaaggtaataacgtgatgttgatgcctacgggcatcatcaaactgattgattttggatgtgcaaggcgcctggcatgggccggtttgaacgggacccacagcgacatgctcaaatccatgcacggcactccatactggatggcccctgaagtcatcaatgaaagcggctatggacgcaagagcgacatctggagcatcggatgtactgtgtttgaaatggcaacaggtaaacctcccctcgcatccatggataggatggcagctatgttctacattggggctcatcgcggtcttatgcctcccctgcctgaccactttagcgaaaatgcagctgacttcgtccggatgtgcctgacacgtgatcagcacgagaggccttcagcacttcagttgctgaagcatagttttctggaacgaagccactag

SEQ ID NO: 61224 - DNA, 1389 bp, Artificial Sequence
  Description of Artificial Sequence: Synthetic coding sequence
atgtcgagcatgcccaagccagaaaggcacgccgaatccctgctcgatatatgccatgatacaaacagtagtccaactgacctcatgacggtgaccaaaaaccagaatatcatcctgcaaagcatcagccggagtgaagaattcgaccaggacggggattgttcccactctacactggtgaacgaggaggaggatccaagtgggggacgccaggattggcagccccgtaccgaaggcgtagagataaccgtgactttcccgagggatgtctccccaccacaggaaatgtctcaggaggatttaaaagagaaaaatctgataaattcttctctgcaagaatgggcccaggcccatgcagtgtctcatccaaatgagattgaaactgtcgaactgaggaagaaaaagctaacaatgaggcccttagtgctgcagaaggaagaaagctcgcgggagctgtgcaacgtcaacctggggtttctgctgcctaggtcctgcctcgagcttaatatcagcaaaagcgttacgcgcgaagacgcccctcacttccttaaagagcaacagcgcaaatcagaggaattttccacctctcatatgaagtacagcggcaggagcataaagcgtcactcctccgggctgaggatttacgacagggaggagaagttcctgatctcaaacgagaaaaagatcttttccgaaaacagtctcaaatcagaagagcctattctctggaccaaggtggacttgctgaaggctctgaaacatgttaacatagtcgcctatcttggaacctgcctgcaggagaatactgtctctattttcatggaattcgtgcccggaggaagcatctccagcatcattaacagatttgggcctttaccagaaatggtattctgtaaatatactaagcaaattcttcagggagttgcatatctgcatgagaattgtgtcgttcatcgtgacattaaaggcaataatgtaatgctcatgcccactggcattatcaagcttatcgattttggctgtgctaggagactcgcgtgggccggattgaatggaactcattctgatatgttgaagagcatgcatggcactccatattggatggctcccgaggtgatcaatgagtccgggtatggaagaaagagcgatatttggagcattgggtgtaccgtgtttgaaatggcaacaggaaagccccctctggcttcaatggaccgaatggccgctatgttctatataggggctcacagaggcctgatgccaccccttcctgatcatttttccgagaatgccgcagattttgttcgtatgtgcctgacgagagatcagcacgaacgcccaagtgctctgcagttactaaagcacagctttttagagcggtcacattag

SEQ ID NO: 61225 - DNA, 2094 bp, Artificial Sequence
  Description of Artificial Sequence: Synthetic coding sequence
aaacaaagcttcccctgcatctgcaaaaaccctggcacacagaaatcatgtgtccccctgagcgtgcagcccaccgagcctcggctgaattaccttgacctcaaatattcggatatgttcaaggagattaacagcacggcaaacggccctggcatatatgaaatgtttggtactcccgtgtattgccacgtgcgggaaaccgagcgggatgaaaatacttactatcgcgaaatttgttctgcaccctctggtcggcgaataacaaataagtgcaggtcctcccacagcgaacgtaaatcgaatatccggactagattgagccagaagaagactcatatgaaatgcccgaaaacgtcattcggcatcaaacaggagcataaggtcctgattagcaaggagaaatcatcgaaagctgtccactccaatctgcatgacattgaaaacggtgacgggatcagcgagcctgattggcaaatcaagtcctcaggtaacgagttcctttcgtcaaaagacgaaattcacccaatgaatctagctcagacccctgagcaatcaatgaaacagaatgaattcccacccgtaagtgatctgagtatcgtggaagaagtgtccatggaagaatctaccggcgatcgggatatttcgaacaatcagatcctcacaactagtctgagagatctgcaggagttggaggagctccatcatcagataccctttatcccaagtgaagactcctgggctgtcccttctgagaagaacagtaataaatatgttcagcaagagaagcaaaacactgcatccctttccaaggtgaatgccagcaggatactgactaacgacttggagtttgactcagtctcagaccattcgaaaactttgactaatttttcctttcaggccaaacaagaaagcgcctcctcgcagacttatcagtactgggtccactacttggaccacgacagtctggccaataagtcaataacataccagatgttcggtaagacactgagcggtaccaactcaatttcccaggagataatggactcggttaacaacgaagaactaactgacgagcttctcgggtgtctggccgctgagcttctggccctcgatgagaaagacaataatagctgtcagaagatggcaaatgaaacagacccagaaaatttgaaccttgtgctgagatggcgaggatccacacctaaagagatgggcagagaaaccaccaaagtgaagatacagcgacattcatccggtctgcggatctacgaccgggaggagaaattcctgatatcgaacgagaagaagatcttctccgaaaacagtttgaaaagtgaagagccaattctgtggacgaaaggggagattttagggaagggcgcatatgggaccgtttactgcggcttaaccagtcagggtcaactgatcgccgtgaaacaggttgccctggacacttctaacaagttggccgcagagaaggaataccggaagctacaagaggaagttgatctcttgaaagctctgaagcatgtaaacatcgtcgcctaccttggaacatgtctgcaggaaaacaccgtgtcaatattcatggagtttgtgcctggaggctctatctcttcaatcattaatagattcggacccctgcccgagatggtgttttgtaaatacacgaaacagatcttacagggcgtcgcttatctgcatgagaattgtgtggtgcaccgagatatcaagggcaataatgttatgttaatgccaaccggtatcattaagctgattgatttcggatgtgcccgtcgcttagcttgggccggtttgaatggcacacattctgatatgcttaaaagcatgcatgggacaccttattggatggcacccgaagtcatcaatgagtctgggtacgggagaaagtctgacatctggtctatagggtgcacagtgtttgagatggctaccggcaagccccctctcgcctcaatggataggatggcagccatgttttatatcggtgcacaccgtgggctcatgcccccactccctgaccactttagtgagaatgccgcagacttcgtgaggatgtgcctcactcgctag

SEQ ID NO: 61226 - DNA, 4293 bp, Artificial Sequence
  Description of Artificial Sequence: Synthetic coding sequence
atgtctcgtccttcttccgtaagccctagacagcccgcacccggtgggggtggtggcggtgggccttcaccctgcggcccagggggaggaggcagagctaaagggctaaaggacattcgcatcgacgaagaagtgaaaattgccgtgaacatcgcactggaaagatttcgctatggggatcaaagagaaatggagttccccagtagcctgacaagcactgagcgagccttcatccaccgtctctctcagtccctgggactggtgtccaaatccaaaggtaaaggagcaaacaggtacctgaccgtcaaaaaaaaggacggaagtgagaccgctcacgctatgatgacttgtaacctgacgcataataccaagcacgccgtgcggtccttgatccaacggttccctgtaacgaacaaggagcgaaccgagctcctgccaaagactgaacggggaaatgtgtttgccgtcgaagctgaaaatagggaaatgagtaagacctccggccgacttaataacgggattccacagattcccgtgaagagaggcgagtcagaattcgattcctttagacagagcctacctgtttttgaaaaacaagaagagattgtgaaaatcattaaggagaataaggttgtactgatagtaggtgagacgggtagcggtaaaactacgcagattcctcaatttctgctcgatgactgctttaaaaatggcattccttgtaggattttttgcactcaacccagacggttagccgctattgctgtggccgaacgcgtggccgctgagagaagagagcgcatcggccaaaccatcggataccaaatccgacttgagagtagggtaagccctaagaccctcctgacattttgcaccaatggggtgttgctcagaaccctgatggccggtgactctactctgagtacagtgactcacgtgattgtagatgaagtccacgagcgtgatagattcagcgactttcttctgacgaagcttcgggacctgttacaaaaacatcccactctgaaacttattctttctagcgctgcactggacgtcaacctatttattcgatactttggcagctgccccgtgatttatatacaggggcgaccatttgaagtcaaggaaatgttcctggaagacatactgaggaccaccgggtacactaataaagaaatgttgaaatacaagaaggagaagcagcaggaagagaaacaacaaacaactcttaccgaatggtattcagctcaggagaacagctttaagccagaaagccagcgacagcgaacagtgctgaatgtgaccgatgagtatgatctgctcgacgacgggggagatgccgtattctcccaattgaccgaaaaagacgttaactgcctcgaaccctggctcatcaaagagatggatgcttgtctgagtgacatctggctgcacaaggacattgacgcattcgcccaggtgttccatttgatccttactgagaacgtgtccgtggattataggcacagcgaaacctcagccacagctttgatggtggccgctggtcgcggatttgcctctcaggtggaacaactcatctcaatgggagctaatgtgcattccaaggcaagtaatggatggatggccctggattgggccaaacattttggacaaacagagattgtggatctgttggaatcctacagtgcaaccctcgagttcggtaatctggacgaaagcagtttggtgcagactaatggatcagacctgtccgctgaagacagagaactactgaaagcataccatcactcctttgacgatgaaaaagttgacttagacttaattatgcacttgctgtacaacatatgccacagttgcgatgccggagctgtcctcatattccttcctggttatgacgaaatagtcggactgcgagaccgaattcttttcgatgataagcggttcgctgattctacccaccgatatcaggtctttatgctccacagtaacatgcagacgtcagatcagaaaaaggtgctgaagaatcctcccgctggagtgcgaaagataatcctgtctactaatatcgctgaaaccagtatcacagttaatgacgtggttttcgtcattgacagtggcaaggtaaaggagaagtcctttgacgccctgaactttgtgaccatgctgaaaatggtctggatatctaaagctagcgctatccaaaggaaggggcgtgccggacgatgcaggcctggaatctgctttcgcctgttttcgaggctcagatttcaaaacatgctagagttccaaacacccgaactgctgcgcatgcctctgcaggaactgtgcttgcacacaaagttgctggcccctgtcaactgtccgatcgcagacttcctaatgaaggcacctgagcctcctcccgctctcatcgtcagaaatgccgtgcagatgctcaagactattgatgcaatggatacgtgggaggaccttactgaacttggctaccatctggctgaccttcccgtggaacctcacttgggtaaaatggtactgtgtgccgttgtgctgaagtgcctagatccaattctgactatagcatgtaccttggcctatcgtgacccctttgtgctcccgacacaggcctcccaaaagcgggctgccatgttatgccgcaagaggttcacagccggtgcctttagtgaccatatggcgctcctgcgagcgtttcaggcatggcagaaagctagatcagatggttgggaacgtgcattctgcgagaagaacttcctgagtcaggcaacaatggagattatcattggcatgcgcacgcaactgctaggccagctgcgagcttccgggttcgttagagcacggggaggtggtgatataagagatgtgaatacaaactctgagaactgggccgtggtgaaagcagccttggtagctggcatgtatcccaacctggtgcacgttgaccgcgagaacttggtcctaactgggccaaaggaaaaaaaggttagatttcatccagcctctgtgctttctcagccacagtacaaaaagatcccgccagccaacggtcaagcggcagctataaaggcccttccaaccgattggttaatttacgatgagatgacacgagcacatagaattgcgaacattaggtgttgctcagctgtcacacccgtcaccatcctcgtgttttgcggtcccgcacgacttgcatccaatgcccttcaggaacctagcagcttcagagtagatggaatcccaaatgactcctctgacagcgagatggaggacaagactaccgctaatttagcggctttgaaactggacgagtggttacatttcaccttagaacccgaggctgcctcacttctcctccagctgcgccagaagtggcactccctgttcctgcgccgtatgcgtgccccatccaagccatggtcacaggtggatgaggctacaataagagcaatcatcgccgtcttgagcacagaggaacagtccgccggattgcaacagccctctggtattggacagcgacctcgtccgatgagcagcgaggagctcccgctcgctagtagttggcgtagcaacaatagccgtaaaagtagcgctgacaccgaattctccgatgaatgtacaactgccgaacgcgtgttgatgaagagccccagccccgctctgcatcctccacagaagtacaaagaccgtggaatacttcaccccaaaagggggacagaggaccgctcagaccagtcctcccttaagtccactgacagcagctcttatccgagcccctgcgcttctccttcgcctccttcttcaggtaaagggtccaaaagtccatcgccacgcccaaacatgccagtccgctatttcatcatgaaatccagtaacctgcggaatctcgaaatcagccagcagaaggggatctggtccacaacaccaagtaacgaacgcaagttgaatcgcgcattttgggagtcatctatcgtttacctcgtgttttccgtacagggcagcggacatttccagggatttagtagaatgtctagcgaaattggaagggagaagtcccaggactggggtagtgctggactgggcggtgtgttcaaggtggagtggatcagaaaagagtctcttcccttccagttcgcccatcatcttttgaatccatggaatgacaataagaaagtccagattagccgggatggacaggagttggaacccctggttggcgagcagctcctgcagttatgggaaaggctgccattgggagaaaaaaatactactgattag

SEQ ID NO: 61227 - DNA, 4023 bp, Artificial Sequence
  Description of Artificial Sequence: Synthetic coding sequence
atgctgagaaagggggcaaaccgatatttgaccgtgaagaaaaaggacggttctgagaccgcacacgctatgatgacctgcaatctgacacacaacacgaagcatgcagtacgctcactcatccagaggttccccgtgaccaacaaggagcggaccgagctgcttcccaagaccgaaagaggaaatgtgttcgccgtggaggccgaaaaccgcgagatgtccaaaacgagcggacgattaaataatgggatccctcagatacccgtgaaacgtggcgaaagcgagtttgactcattcagacagagcttaccagtgttcgagaaacaggaagagattgtgaagattataaaagagaacaaagttgtgttgatagtgggagagactggcagcgggaaaacaacacagatccctcagtttctgctcgacgactgctttaaaaatgggattccatgccgcatcttttgcacccaacctagacgtctggccgcaattgctgtcgccgaaagggtcgcagccgaacgtcgggagaggataggacaaaccattggataccagatacggcttgagagcagggtctcaccgaaaacgctgctgacattctgtaccaacggagtactgctcaggacgcttatggccggagactccacattgtccactgtgacccacgttatcgttgatgaggttcacgagcgcgataggttctccgactttcttctcaccaagctgagagatctgctgcagaagcaccctacactcaaattgattttgtcctccgcggctctggatgtcaacttatttattcggtattttggcagctgtcccgttatatacattcagggaaggcctttcgaggtgaaagaaatgtttctggaagatatactgcgcacaacaggttacactaataaggaaatgctaaaatacaaaaaggaaaagcagcaggaggaaaaacagcaaaccacgcttacagagtggtattcggcccaagaaaactccttcaagccagagagccagcgacagcgcaccgtcctgaacgttacagacgaatatgacttgttagacgacggaggagacgcggtcttttctcagctaaccgagaaggacgtgaattgcctggaaccctggctcattaaagaaatggacgcctgcctgtcagacatctggctacacaaagatatcgacgcctttgcccaggtgtttcatctgatattgaccgagaacgtcagtgtcgactatagacactctgaaacctccgccaccgctctgatggttgccgcaggacgaggattcgcttcccaggttgagcaattgatctcaatgggggcaaatgtccacagtaaagctagcaatggctggatggctctcgactgggccaagcacttcggacagactgagattgtggatctgctggaatcatacagcgccaccctggagtttggcaatttggacgaatcatcactcgtacagactaatgggtctgacttgagtgcagaggaccgcgaactactcaaggcttaccaccattctttcgacgacgagaaagtggatctagacctcattatgcacctcttgtacaacatatgtcatagttgcgacgccggagccgtattgatcttcctccccggttatgacgaaattgtgggtttacgggataggatcctttttgacgataaacgctttgccgattccactcacagatatcaggtcttcatgctgcatagcaacatgcagacctctgaccagaagaaggttctgaaaaatccaccagcgggtgtgcgcaagataatattatctaccaacattgcggagacatcgattaccgtcaacgacgttgtttttgtgatcgacagtgggaaggtgaaggaaaagtcctttgatgcactgaactttgtgaccatgctgaaaatggtgtggatctccaaggcttccgccatccaacgtaaaggtagagccggaagatgtagaccagggatttgcttccgcctgttctctagactgcgttttcagaatatgctggaatttcagactccggagcttcttcgtatgcccctgcaggaactttgtttgcacacaaaactgctggccccagtgaattgtcctatagcagacttcctgatgaaagccccagagccgcctcctgctttaatcgttcgtaatgcagtgcagatgctaaagaccattgatgcaatggatacttgggaggatctgacggagcttggttaccaccttgccgatctgcccgtggagccccacttggggaagatggtgttgtgtgccgtcgttttgaaatgcttagatcctatccttactatcgcttgtaccttggcctaccgcgaccccttcgtgttgccgacacaagcaagccagaagagggctgctatgttgtgccgcaaaaggttcacggccggtgccttctccgatcatatggcacttctccgcgctttccaggcttggcaaaaggcccgatctgacggctgggagagagctttctgcgaaaagaacttcctcagccaggcgactatggagattatcattggaatgcggacacagctcctaggccagctacgcgcaagcggattcgtacgtgccaggggcggaggcgatatccgggatgtgaatacaaattccgagaattgggccgtggtgaaggccgcacttgttgctggaatgtacccgaacctggtgcacgtggatcgcgaaaatttggttcttactggaccaaaggagaagaaagtgcgttttcatcccgcttctgttctgtcacagcctcagtataaaaagattccgccagcaaacgggcaagccgctgctattaaggcgttaccaaccgattggctgatttatgatgagatgacccgggctcataggattgctaacatccggtgctgttcagccgtgacaccagtaaccattttggtgttttgtgggcctgccaggttagcatcaaacgcgctccaggaaccctccagtttcagggttgatgggattcctaatgacagctctgactcagaaatggaagataaaactacagcaaatcttgccgctttgaaactggacgaatggttgcattttacgcttgaacccgaggctgcatcactgctgttgcagctgcgccagaagtggcatagcctcttcctgcgaaggatgcgtgccccatccaaaccctggtcccaggtggacgaagctactatccgagccattatcgcagtgctatccacggaagagcagagtgccggactgcagcagccctcagggatcggccagcgacccaggccgatgtcatccgaggagctccctctcgcctcgtcatggcgctctaataacagtcggaagtccagcgccgatacagagttttccgacgagtgcactacagccgagagggtcttaatgaaaagcccctccccagccttgcacccacctcagaagtataaagacagaggcatccttcacccaaaaagggggaccgaggatcgtagcgatcagagctccctaaagagtacagatagcagcagctacccctccccatgtgcttcgccttcaccaccgtcttccggcaaaggctctaaaagcccatctcctagacctaatatgcctgtgcggtactttatcatgaaatcgagcaacctgaggaacctcgaaatttcccaacaaaagggcatctggagtaccacacctagcaacgaacggaaactcaatcgtgccttctgggagagttcaatcgtgtacctggtgttcagcgttcagggttctggccatttccagggcttctccaggatgtcctccgagatcggcagggaaaagtcccaggactggggtagcgcaggcctgggcggagttttcaaggtcgaatggatccgcaaagagtcgcttccttttcagtttgcgcatcatctgctgaacccgtggaatgataataaaaaggtccagataagcagggatgggcaggaacttgagccgctagtaggtgaacaattgctgcagctgtgggaacgactgccactcggcgagaagaacacaaccgactag

SEQ ID NO: 61228 - DNA, 597 bp, Artificial Sequence
  Description of Artificial Sequence: Synthetic coding sequence
atgttgttcctgggatctctgggggcttggggcacaacatctatcagcaccggctccatcttctctctgaaaactctaagatcacagcacggtgggcaggtgggcctaaaggtctcccggccacgagctccccgtatgggtgctgctacccctacccctagagcaccatgggtggcaaggtggctcatggggagccaagctttcactgcaacgccatctgcacgccctcctccaccacccatcaaacacaatatggatattggaacatgggataacaaaggcccagtcccgaaggcacctgtcccccaacaggctccatctccccaagctgcaccacagccccaacaggtggctcagccgctcccagcacaaccccctgccctggcacagccccagtaccagagtccccagcaaccccctcagacacggtgggtcgctcccaggaataggaacgcagccttcggccaatccggaggagctggatccgattcgaatagccccggaaacgtgcaaccaaacagcgcgccttccgttgagtctcaccctgtgctcgagaagctcaaagcggctcacagttataaccctaaggaattttag

SEQ ID NO: 61229 - DNA, 1530 bp, Artificial Sequence
  Description of Artificial Sequence: Synthetic coding sequence
atgtctgacccttacctgtcttcatattatccaccgtccattggattcccgtacagcctgaatgaggcgccttggagcacagcaggggatcctcctattccttacctaaccacgtatggtcagttaagcaatggcgaccatcatttcatgcatgacgccgtgttcggacagcctggcggtctcggtaacaacatctatcagcaccgttttaacttctttccagagaatcccgctttttccgcctgggggacttcaggatcccagggccagcagacccaaagcagcgcttacggcagctcctacacctatccgccatccagtcttgggggtacagtcgtcgatgggcagcctgggtttcacagcgacactctgagtaaagcccctggaatgaactcccttgagcagggcatggttggcctcaagattggggatgtatctagctctgcggttaagacagtgggaagcgtggttagttcagttgccctgactggcgtactcagtgggaacggcggaacaaacgtaaatatgcctgtctctaaacccactagttgggctgcaatcgcttccaaacccgctaaaccacagcccaagatgaagacaaaaagtggccctgtcatgggaggaggtctgccacccccaccaattaaacacaacatggatatcggaacatgggataataagggccctgtgcctaaggctcccgtcccacagcaggcccctagccctcaggccgctccgcaaccccagcaggttgctcagccactgccagcccaacctccagccctggctcaaccgcaataccagtctccacagcagcctccccagaccagatgggtagcacccaggaacaggaatgcagcctttggacagtcaggtggcgctggttccgactccaatagtcccggtaacgtgcagcccaacagtgctccttccgtcgaatctcacccagtcctggaaaaactaaaggcagctcattcttacaaccccaaagagttcgaatggaacctgaagtctggccgagtctttatcattaagtcctactccgaagacgatatccatcgaagcatcaaatattctatttggtgttccacggaacacggcaataagagactggactcagcctttcggtgtatgtccagtaaaggacccgtgtatctgctcttctccgtcaatggaagtggacatttctgcggcgtcgcggagatgaagtccccggtcgattacgggaccagcgctggagtgtggagccaggataagtggaaaggcaaatttgacgtgcagtggatctttgttaaagacgttcctaataatcagctgcgccatatccgcctggagaacaatgacaataagccggtgactaacagccgcgacacccaagaagtgcctctggaaaaagccaagcaggtgttgaaaattatcagctcctacaagcatacaacaagtatctttgacgattttgcacactacgagaaacgacaggaggaggaagaggtcgtccgcaaagagcggcaatcccggaacaaacagtag

SEQ ID NO: 61230 - DNA, 1680 bp, Artificial Sequence
  Description of Artificial Sequence: Synthetic coding sequence
atgtccgcaacctccgtggacacccagcgaacaaaaggccaagacaataaagtgcagaacggttcactgcatcagaaagatactgtccatgataacgacttcgagccctacctcaccggccagtccaatcagtccaattcctacccctccatgtctgacccctacttgtcctcatattacccccctagtattggcttcccctatagcctgaacgaggcaccttggtccacagctggtgacccccctatcccatatctaacaacttatggacagctctccaatggtgaccaccactttatgcacgacgcggtcttcgggcagccagggggactgggcaataacatctatcaacatagattcaatttttttcctgagaatcctgctttctctgcctggggcacgtctggatcacagggtcagcagacgcagtcatctgcgtacggcagcagctacacctacccgccatcctctctgggcggaacagtagtggacgggcagccgggatttcacagcgacactctctccaaggcacccggaatgaattctctcgagcaaggtatggtaggcttaaagattggcgatgtatccagcagcgcggtgaaaaccgttggttctgtggtatcctccgtggcactgaccggggtgctatcaggtaatggcggtacaaacgtgaatatgcctgttagtaagcctacttcctgggccgcaatcgcgagtaaacccgctaagccacagcctaagatgaagactaagtccgggccagtgatggggggaggtctgcccccaccaccgataaagcataacatggatatcggtacatgggacaataaaggacccgtccccaaggccccagtgccccagcaggctccctctccccaggctgcccctcagccacaacaggtggcccagcctctgcccgcacagcctccagccctcgcacaaccccagtaccagtctccccagcaaccccctcaaactcggtgggtggctcccagaaacagaaacgcagccttcggacaatccgggggtgcgggaagtgatagcaatagcccagggaatgtgcagccaaactccgctcccagcgtggaatcacacccagtcttagagaaacttaaggccgcacacagctacaatcctaaagagtttgaatggaatctgaaaagcggacgcgtgttcatcatcaaatcttactccgaggatgatatacaccggtcaataaagtatagtatatggtgtagcacagagcatggaaacaagcggcttgattccgccttcagatgcatgagcagcaaaggtccagtatacctcctctttagtgtgaacggatcggggcacttctgcggagtcgccgagatgaaaagcccagtggactatggcactagcgctggggtgtggtcacaggacaagtggaaaggcaagttcgacgtgcagtggattttcgtcaaagatgtgccaaataatcagttgaggcatattcgactcgagaacaatgacaacaagccagtgacgaattcacgcgacactcaagaagtgcccctggagaaggcaaagcaggtgctaaaaattatttcgtcatataagcacactacctctatcttcgacgacttcgcccactacgaaaaaaggcaggaggaagaggaggttgtgagaaaggagcgacaaagcagaaacaagcagtag

SEQ ID NO: 61231 - DNA, 879 bp, Artificial Sequence
  Description of Artificial Sequence: Synthetic coding sequence
atgcttaggaaattgtggcagtggttttacgaggaaactgagtcttctgacgacgttgaagtgctaacacttaaaaagttcaagggagacctcgcataccgcagacaggaataccagaaagctctgcaggaatacagttccatctccgaaaagctgtcaagtacgaacttcgctatgaaacgggatgtacaggagggccaagccagatgcctcgcacatctgggtcgccatatggaggcgttggagatagccgctaacctggaaaataaggctacaaatacagatcacctcacaacagtgctttacctgcagctggcgatctgtagcagcctgcagaacctggagaaaaccattttttgcctgcagaaactgatatcactccacccttttaatccttggaactggggaaagctggcagaggcttatttgaatcttgggccagcactcagcgcagctctggcaagctcccagaagcagcattcttttacttcctctgataagacaattaaatctttttttccccacagcgggaaggactgcctgctatgttttcccgaaactttgccggagtcctcactatttagtgtggaggcaaacagcagcaactcccagaagaatgagaaagcgctaaccaacattcagaattgcatggccgagaagcgagaaacagtactgatagaaacccagctcaaagcctgcgccagctttatccgcacacggttgctgctgcagttcactcagcctcagcagactagctttgcgttggaacgcaacctgaggacccagcaggagatagaggataaaatgaaaggcttcagttttaaggaagacaccttattattgattgctgaggtctcagtgagcctgggatttatgtag

SEQ ID NO: 61232 - DNA, 684 bp, Artificial Sequence
  Description of Artificial Sequence: Synthetic coding sequence
atggccgaactggatatcgggcagcattgccaagtggagcattgtcgccaaagggactttcttccttttgtgtgcgatgattgttcaggtatcttttgcttggagcatcgtagtcgagagagccacggctgcccagaggtgaccgtgatcaatgagcgccttaagactgatcagcacaccagttacccctgcagcttcaaggattgcgcagagagggagcttgttgcagtgatctgtccatattgtgagaagaatttctgtttgcggcaccgccaccagagcgatcatgaatgcgagaaacttgagatcccgaagcctcggatggccgctactcagaagctcgtcaaagatatcatcgactctaaaacaggtgagaccgctagcaagaggtggaaaggcgctaagaatagcgagaccgccgcaaaagtggcactgatgaagcttaagatgcacgccgatggggataaaagcctgccacaaactgaaaggatttattttcaggtctttctgccaaagggcagcaaagagaaatccaaaccgatgttcttttgtcaccgctggtcgattggcaaggctatcgactttgctgcctccctcgctaggctcaaaaacgataataataagttcaccgcgaaggtcaccagtcattacaataacatttcaatcctgatcaaagtgttatag

SEQ ID NO: 61233 - DNA, 786 bp, Artificial Sequence
  Description of Artificial Sequence: Synthetic coding sequence
atggccgaacttgatatcgggcagcactgccaggttgaacactgcaggcagcgcgattttcttcctttcgtgtgcgacgattgtagcggcattttttgtctggaacatcgatcccgtgaatctcatggatgtccagaagtgaccgttataaatgagcggttaaagacagaccagcatacttcatacccctgttccttcaaagactgcgcagagagagagctcgttgctgtgatctgcccttactgcgaaaagaatttctgcttgcgccaccgccatcagagtgaccacgagtgcgaaaagttggagattcccaaacccaggatggcagccacccagaagttggttaaagatatcattgactcgaaaactggtgaaaccgcatcaaagcgctggaagggggcaaagaattcagagactgcggcaaaagtggccctgatgaagcttaaaatgcacgccgatggtgacaaatcattgccgcaggtgtttttacccaagggcagcaaggaaaaatcaaaacccatgtttttctgccataggtggtctatcgggaaagccatagactttgccgctagccttgccagactcaaaaacgataacaacaagttcaccgccaagaaactacggctgtgtcacatcacatctggagaagccctccccctggatcacacacttgaaacatggatcgccaaagaagattgccctctgtacaatggaggaaacataattttagaatatttaaatgatgaagaacagttttgcaagaacgtcgaaagctacctcgaatag

SEQ ID NO: 61234 - DNA, 3696 bp, Artificial Sequence
  Description of Artificial Sequence: Synthetic coding sequence
atgtgtaaatgctgtaacctgtttagtcccaatcagagcgagctcttgtcccatgtgtctgagaaacacatggaggagggtgtgaacgtggatgaaataatcatccctttgcgcccattgtcgacgccggagcctcccaacagtagcaagaccggcgacgaattcctcgtcatgaagcgtaagcggggacgcccaaaaggttcaacaaaaaaatcaagcacagaagaggagttggccgaaaacatcgtgtctcctactgaggactcccctttagcccctgaggagggcaattctctgcccccttcttctctcgagtgttctaagtgttgccgtaaattcagtaataccagacagctgaggaaacatatatgcattatcgtcctgaacttgggtgaggaggaaggagaagcagggaatgaatctgatctggagctcgagaagaaatgtaaagaagatgaccgggagaaggcttcgaagaggccacggtcccagaagacagagaaggtacagaagatttcaggaaaagaggcaagacagctcagcggagcaaagaaacctattatctccgttgtccttacagcccacgaagccattccaggagctactaagattgtacccgtcgaagccggtcctcctgagacaggcgcaaccaattctgagaccactagtgcagacctagtgcctaggagaggctaccaggaatacgctattcagcaaacaccatatgaacaaccaatgaagtcatcccgtttggggccaactcagcttaagatattcacttgtgaatactgtaataaagtattcaaatttaagcactcacttcaagctcacctaagaatacatactaatgagaaaccgtacaagtgccctcagtgtagctacgcatctgctatcaaggccaacctaaatgtgcacttacggaagcacacaggtgagaagttcgcatgcgactactgctcctttacatgcttgtcgaagggacatctgaaggttcatattgagcgggtgcacaaaaagatcaaacaacattgcaggttctgcaaaaaaaagtattcggatgtaaaaaacctaatcaaacatattcgtgacgcccacgatccccaagataagaaagtgaaagaggcactggacgaattatgcctgatgacgcgtgagggtaagcggcagctgctctacgattgccacatctgtgagcggaaatttaagaacgaactggaccgggaccgtcacatgcttgtgcacggtgataagtggcccttcgcctgcgagttatgcggccacggtgcaactaaataccaggcccttgagttgcacgtgaggaagcacccgttcgtgtatgtttgcgctgtttgtaggaaaaagtttgtatccagcataagactgcgaacccacattaaagaggttcatggtgccgctcaggaggctcttgtctttacatctagtatcaaccaaagtttctgtctcttggaacctggaggggacatacagcaggaggctctgggcgaccagctgcagctggtggaggaggaattcgcccttcagggtgtcaatgcgctcaaagaagaggcctgccccggagacacacagctggaagaggggaggaaagaacccgaggctcccggagagatgccagctccagctgtgcacttagcctctccccaggccgagtctaccgcactcccaccatgtgagctggagacaactgtggtaagctccagtgatcttcacagtcaggaggttgtctcggatgacttcctgttgaaaaatgatacatcctccgccgaagcacacgctgcccctgaaaagcctcccgatatgcaacatagaagcagcgtgcagacacagggagaagtcatcactctgctcctttcaaaagcacagagcgcaggttctgatcaggaatcacatggtgctcagtctccgttaggcgagggtcaaaatatggccgttctgagcgcaggtgaccccgatcccagccgctgtctgcgaagcaaccccgcagaggccagcgatctccttcccccagtggctgggggtggcgatactatcactcatcagcccgacagttgcaaagccgcacccgaacataggtccgggattacagcgttcatgaaggtgcttaacagtttgcaaaaaaaacagatgaatacttctctctgtgaaaggatcaggaaggtgtacggggacttagagtgcgaatattgcggtaaactgttttggtatcaggtccactttgatatgcatgtgaggactcacacacgagaacacttatattactgttcacagtgccactattcctcaattacgaaaaactgtctcaagcgacacgtgattcagaaacatagtaacatccttctaaaatgccccactgacgggtgcgactactctacacccgataagtacaagctgcaagctcatttgaaggtacatactgccctggacaagagatcgtacagttgtcctgtgtgcgagaagagctttagcgaagatagattaatcaaatcccacataaaaaccaatcaccccgaggtgagcatgtccactatatccgaagttcttggcagacgggtacaattaaaagggctgatagggaagcgcgctatgaagtgcccttattgcgatttttattttatgaagaacggcagcgatctccaaaggcatatatgggcacatgagggcgttaaaccctttaagtgcagtctttgcgaatatgcaacaaggagcaaaagcaacctgaaggctcacatgaacagacatagtacagagaagactcatctatgcgacatgtgtggtaaaaaatttaaatcaaagggtacattaaagtctcataagctcttgcacacagctgatggtaagcagtttaagtgcacagtttgcgattacacggctgcccagaaaccacagctgctaaggcatatggagcaacatgtctcatttaagccttttaggtgtgcccactgccactactcctgcaacatcagcggtagcctaaagagacactataacagaaagcacccaaatgaggagtacgcgaatgttggtaccggggagttagccgctgaagtgctcatacaacagggtggtctcaaatgtcccgtctgctcctttgtatacggcaccaaatgggagttcaacaggcacttaaaaaataaacatggtctcaaagtggtcgagatcgatggcgaccccaaatgggaaacggccaccgaggctccggaggagcccagtacacaatatttacacatcacagaggccgaagaggacgttcagggcacccaggctgcagtggccgctctgcaggatcttcgctacacatcggaatctggcgacagactggacccaacagccgttaatatactgcagcagataattgagctcggtgcagaaactcacgacgcgacagcattggccagtgtggtggcaatggcccctggcaccgttacggttgtcaaacaggtcaccgaagaggagccgagctctaaccacaccgtaatgatccaggaaaccgtgcagcaggcctccgtggaactggctgagcaacaccacctggtggtgtcgagcgacgatgtggagggcatcgaaactgtcaccgtctacacacagggcggagaggcctcagagtttatcgtgtacgtgcaggaggctatgcaacctgtggaggaacaagcggtcgagcagcctgcgcaagaattatag

SEQ ID NO: 61235 - DNA, 1905 bp, Artificial Sequence
  Description of Artificial Sequence: Synthetic coding sequence
atggagccttccccgttgtctcctagtggggctgctcttccgctgcccctgtcccttgcccctccccctttgcctctgcctgccgctgccgtcgtccacgtgtcttttccggaggtgacatcagcccttcttgaatctctgaaccagcagcggctgcagggtcagctgtgtgatgtttccattcgggtacagggtagggaattcagagcccatcgagcggtcctcgccgcatcatctccctatttccacgatcaggtgctcctcaaaggtatgacctcaatctccctgccctctgtgatggatccaggggcatttgagactgtcctcgctagcgcctacactgggagactgtcgatggccgcagctgacatagttaatttcctgactgttggttccgtgcttcagatgtggcacatagtggataaatgtactgagctcctgagggaagggagggccagcgcgaccacaacaataacaacagccgcagcgacatccgtgactgtccccggtgccggtgtgccttctgggtctggtgggacagtggcgccagcgacaatgggttctgctcgctcccacgcctccagcagggcaagcgagaaccagtcacccagttcctccaattacttttctccacgcgaaagcaccgatttttctagtagttctcaggaggcatttgccgcttctgcagttggatcgggcgaacgcaggggtggcggacctgttttcccagctcccgttgtcggctccggcggagcaacctctggaaagttgctgctcgaggccgatgaactctgtgacgatggaggggatgggcgtggagccgtcgtcccaggggcaggattaaggcgtccgacttacacacctccttccatcatgccacagaaacactgggtctatgttaagagggggggaaattgtcccgcacccgctcctctagttccccaggaccccgatctggaggaggaggaggaggaggaggacctagtgctaacctgcgaggacgacgaagatgaagagcttggcggtagttcgagagtacccgttgggggaggccctgaagcgacactaagtataagtgacgtgaggactttaagtgagccccctgataagggtgaagaacaggtcaatttctgcgagagttctaacgacttcggcccttacgaagggggaggacctgtggctggtctggatgactccggaggccctactccaagttcatatgctccctcccatccacccagaccccttctaccacttgatatgcaagggaatcagattctggtgttcccaagctctagtagctcatcaagtagccaggccccagggcaacccccagggaaccaggcggagcacggagccgtgacggtgggaggaacttccgtgggaagtttgggggttcctggatctgtgggaggtgtcccaggtggcacagggagtggggatggcaataaaatttttctgtgtcattgtgggaaggctttcagccacaaatcaatgagagaccgacacgttaacatgcatctcaacctgaggcctttcgactgccctgtgtgtaacaagaagttcaagatgaaacaccacctgactgaacatatgaagacccataccggcttgaagccctacgaatgcggtgtgtgcgccaaaaaattcatgtggcgtgacagcttcatgagacatcggggacactgcgaaaggaggcaccgcttaggcggagtcggcgctgtgcccggaccagggacaccaacaggaccgtcactgccctctaagcgagagtctcccggtgttggtggcggatctggtgatgaggccagcgcagccacccccccatcatcccgcagggtgtggagtccacctagagttcataaggtcgaaatggggtttggcggtggcggtggcgcaaactag

SEQ ID NO: 61236 - DNA, 1905 bp, Artificial Sequence
  Description of Artificial Sequence: Synthetic coding sequence
atggaacctagcccgctgagtccaagcggggctgccttgcctcttccccttagtctcgctccgccacccctacccctgcccgcagctgccgttgtacacgtgtcctttccagaagttacctccgccttgcttgagagcctgaaccagcagagactgcagggtcaactatgtgatgtttcaatccgggtgcagggcagagaatttcgagcgcatagggccgtactcgcggcttcaagtccctattttcatgaccaggtcttgttgaaaggaatgacttcaatctccctaccttccgtgatggatccaggtgccttcgagacagtactagcctctgcctataccgggagattgtcaatggccgcagccgatatcgtgaactttcttacagttggaagcgtgctccaaatgtggcatattgtcgacaaatgtactgaacttttaagagaaggccgtgcttctgccacaaccactataacaaccgccgcagctacttccgtcactgtgccaggggctggggtgccgagcgggtcaggaggtaccgtcgcaccagctaccatgggatccgcaaggagtcatgcaagctcgagggcgtcggaaaaccagtcaccatcctcaagcaactatttcagtccgcgagaatccaccgacttttcctctagtagccaggaggctttcgctgcatcagcagttggctccggcgagaggagaggcggaggaccagtgttccccgctcccgttgtgggcagtgggggagctactagtggcaagttgttgctggaggccgacgaattgtgtgacgacggcggtgatggcagaggggcagtagtccctggtgcgggacttcgcaggccgacttacacccctcccagcattatgccacagaaacattgggtctacgtgaaacggggtggcaattgccctgcccctgcgcctttggttccacaggatcccgatttggaggaggaggaagaggaggaagacctggtgctcacctgtgaagacgatgaggatgaggagctgggagggtcttccagggtccccgttggcggtgggcctgaagccaccctctccatttcagacgtgagaacgctttctgagcctcccgacaagggtgaggaacaggttaacttttgcgagtcctccaacgattttggcccttacgagggtggtggacctgtggcaggccttgatgactccggaggcccaactccatcttcctacgccccttctcacccccctaggccgttgctcccgctcgatatgcagggaaaccagatccttgtgtttcccagtagctcttcctcctcctcctcccaggctcccggacaaccaccaggtaatcaggccgaacatggtgccgtgacagtcggcggaacaagtgtcggctccctgggggtgcccggttcagtcggcggtgtccccggtggaaccggatccggtgatggcaacaaaattttcctgtgtcactgtggaaaggctttctctcacaaaagcatgcgagacaggcacgtcaacatgcacctaaatcttcggcctttcgattgcccagtatgcaacaaaaagttcaaaatgaagcaccacttgactgaacatatgaagacacacacgggccttaaaccatatgagtgtggagtttgcgctaaaaaatttatgtggagagattcatttatgcgccatcggggacattgtgaacgacggcacagattaggcggagtgggcgcagtgcctggccctgggacgcccacgggaccctcactcccgtccaagcgagaaagcccaggggttggcggtgggtccggtgacgaagcctctgccgctacaccaccttcttcacggagagtctggagccctcctagagtccacaaggtggagatggggttcggtggtgggggtggagccaattag

SEQ ID NO: 61237 - DNA, 1905 bp, Artificial Sequence
  Description of Artificial Sequence: Synthetic coding sequence
atggagccttctcccttgagcccatccggggcagctctgcccctgccgctcagtttagcgccaccccctctgcctctgcccgcagcagctgtggtgcacgtgtcctttccagaagtcacgtctgctctattggagtcattaaatcaacagcgcctccagggacagctgtgcgatgtgagtatacgagttcagggcagggaatttagagctcacagagctgttttggccgcaagctcaccatatttccacgaccaggtactactaaaagggatgacaagcatctctctgccttctgtcatggacccaggagccttcgagactgtgctggcttccgcctacaccgggaggctgtcaatggccgcagccgatattgtgaatttcctcaccgtaggctcggtcttgcagatgtggcatatcgtggacaagtgcacagaactgctcagagagggcagggccagtgctacgacaactatcactacagccgcagcaacttccgttaccgtgcctggcgcaggtgtgccctcgggtagcggaggcaccgtggcacccgcaaccatgggtagcgctaggtctcatgctagctctagagcatccgaaaaccagtccccttcatccagcaattattttagtccgcgagagtctaccgacttttccagttcctcccaggaagccttcgctgcctcagccgttggctcaggcgaacgtcgtggcggaggaccagtgtttcctgcccctgtggtaggaagcggaggcgctacatctgggaagctcctactggaagccgatgaactgtgtgatgatggcggtgacggtaggggggctgtcgtgccgggagctggtctgaggagacctacttatacaccgccttcgatcatgccgcagaaacattgggtctatgttaaaagaggtggaaattgccctgccccagcaccacttgtcccccaagacccagatttggaggaagaagaagaagaggaggatttggtgctgacctgcgaggatgacgaggacgaagagcttggtgggtctagtagggtccccgttggcggtgggcctgaggccaccctttctatatcagacgtgcgcaccctgtccgaacccccagacaaaggggaagaacaagtcaatttctgcgaatcctccaacgattttggcccttacgaggggggtggacctgtggctggattggacgattctggagggcctaccccatcttcttacgctcccagccacccgcctcggcctctgctccccctggatatgcaaggaaatcagatcctggtgttcccctctagtagctcaagcagtagtagtcaggctcctgggcagccgcctggaaatcaagccgagcacggggcagtgactgtggggggaacttcagtgggctcactgggcgttccaggaagtgtcggaggcgtgcctgggggaaccggctctggcgacggcaataagatcttcctgtgtcactgcggcaaggctttttcccacaagagcatgagggatcggcatgtgaacatgcacctgaacctgaggccattcgactgtcctgtttgcaataagaagttcaaaatgaagcatcatctgacagagcatatgaagactcacaccgggttgaagccctatgagtgcggcgtgtgcgctaaaaaattcatgtggcgggattccttcatgcggcacaggggtcattgtgaaagacggcacagactgggcggagtgggagccgttccaggtcctgggacccctacaggcccttcacttccttctaaacgcgagagcccaggagtcggtgggggatctggcgacgaggcctccgccgctactccaccaagtagcagacgggtttggtcccctccgagggtacacaaagtagagatgggcttcggtgggggaggtggagccaattag

SEQ ID NO: 61238 - DNA, 450 bp, Artificial Sequence
  Description of Artificial Sequence: Synthetic coding sequence
atggaaccatccccactgagcccttcaggggctgcactgcccctgcctctttcactggctccccctcctctcccactgcctgcagcggcagtggtgcatgtctcttttcccgaggttactagcgctttgctcgaatcacttaatcaacagaggctgcagggtcaattgtgcgacgtttccattcgggtccaggggcgagagtttagagcccaccgcgctgtcctggccgcttcatctccatattttcatgatcaggttcttctaaagggcatgacctctatttctctgccttctgttatggacccgggagcttttgagacggtactggcttctgcgtacactggaaggctctcaatggctgctgcggacattgttaactttctcaccgtcgggtccgttctccagatgtggcacatcgtggacaagtgcacagaactgttgcgtgaatag

SEQ ID NO: 61239 - DNA, 450 bp, Artificial Sequence
  Description of Artificial Sequence: Synthetic coding sequence
atggaaccatcgccgctcagcccttcaggagctgccctgcccctgcccttaagtttggcaccaccgcctcttcctctgcccgcagctgctgttgtgcatgtcagctttcccgaggtgacctcagcccttcttgaatcactcaaccagcagcggctgcagggccagttgtgcgatgtctctatacgtgtccagggacgcgagttccgggcacatagggcagttttggccgcttcatcaccatatttccatgaccaggtgttgctcaagggaatgaccagcatcagcctcccaagcgtcatggacccaggggcattcgaaactgtgctggcatctgcttacaccggtcgactgtccatggccgctgccgacatcgtgaattttctgacagtgggctctgtgctgcaaatgtggcacatcgtagataagtgtactgagctgctgcgcgagtag

SEQ ID NO: 61240 - DNA, 450 bp, Artificial Sequence
  Description of Artificial Sequence: Synthetic coding sequence
atggaaccctccccactgtcccccagcggagcagcattaccgttgcccctttcgctcgctccaccccctctcccactgccggcagccgctgtggtccacgtcagctttcccgaggtcacttccgctctcttagagtcactgaaccaacaacgtctgcagggacagctgtgcgacgtctctatccgggtccagggcagagaattccgcgcacatcgtgctgtgctcgcagcttcttcgccatatttccacgatcaggtgctgctaaaaggaatgacaagcatcagccttccatctgtgatggatcctggcgcttttgagacagtgctggccagtgcctacactggccgactgtcgatggcagccgcagatattgttaactttctaactgttggttccgtgctccagatgtggcacattgtcgataagtgcaccgagttattacgcgagtag

SEQ ID NO: 61241 - DNA, 1905 bp, Artificial Sequence
  Description of Artificial Sequence: Synthetic coding sequence
atggagccttcacccctctctccaagtggagccgctctgcccctccccctgtccctggctcccccaccccttcccctccctgccgcagctgtcgtgcatgtttcttttccagaggtgacaagcgctcttctcgagtcgctgaaccagcaaagactccagggacagctgtgcgacgtgagcattagggttcagggtagagaattccgggcacaccgggcagttctggctgcctctagcccatacttccatgaccaagtcctcctcaaggggatgacctccatctccctcccctcggtgatggaccctggcgcattcgagacagtgttggcttctgcttatacgggacgcctgtcgatggctgcagccgatatagtgaactttctaacagtggggagtgtgctacagatgtggcatatcgtcgacaaatgtacagagttgctgagagaaggccgtgcgtcagctaccacaaccataaccactgcggctgccacaagcgtgaccgtccccggagcaggggtgccttccgggagtggtgggacagtcgccccagctaccatggggagtgcacgtagccacgcctcttctagagcgtccgaaaatcagtcgccttcaagttctaactacttttctcctagggagagcacagacttttcaagtagcagccaagaagcctttgccgcaagcgccgttggcagcggagaacgcagaggtggcggtcccgtttttcccgctcctgtggtggggagcggtggcgctaccagcggcaaactactgctggaggcggacgaattatgcgatgacggaggtgacggtagaggagcggtcgttccaggagcgggtctccgcagacctacctatacaccaccgagtatcatgccacagaagcattgggtgtacgtgaaaaggggagggaattgcccagcacctgctcctctggtcccccaagaccctgatttggaagaagaggaagaggaggaggacctggtgctgacttgtgaggacgacgaggatgaggagttagggggaagctccagggtgcctgttggaggtggccctgaggccacacttagcatctcagatgtccgcaccttgtcagagccaccagataagggggaagagcaggtgaacttctgtgaatcatcgaacgacttcgggccttatgaaggaggcggacctgtggccggattggacgactctggaggcccaacgccatcatcttatgcgccttcgcaccccccaagaccactgctgcccctggacatgcagggcaaccagatccttgtgttccctagctcctctagttcatccagctcccaggcccctggccagccgcctggaaatcaggctgagcacggagcagtaacggtgggaggcacttccgttggctctttgggggtgcctggctcagtcggaggggtgcccggtggcaccgggtcgggtgacgggaacaaaatttttctctgccactgtggcaaagcgttctcgcacaagagcatgagagatcgtcacgtgaacatgcatctgaatttgaggccttttgattgcccagtgtgcaataagaaattcaaaatgaagcatcatctcactgagcacatgaagacacacacaggcctaaaaccttatgagtgcggcgtgtgcgccaaaaagtttatgtggcgggatagcttcatgcgccaccgtggccactgtgagaggcgtcaccggttggggggtgttggtgccgtaccgggacctggaacccccacgggcccaagcctgccctcgaagagggaatctccaggcgtcgggggaggcagcggagacgaggcttctgccgcaaccccgccatcgtcccgaagggtgtggtctccacccagggtccacaaggtcgagatgggctttggagggggtggcggagctaactag

SEQ ID NO: 61242 - DNA, 1905 bp, Artificial Sequence
  Description of Artificial Sequence: Synthetic coding sequence
atggagccttcacccctatctccatcgggcgcagcacttccacttcctctctcgttagccccaccacctcttccattacccgcagcggctgtggtccatgtctcattcccagaggtaacttctgccctcctggagagtcttaaccagcaacgcttacaaggtcaactgtgtgatgtgagcatccgggtgcagggtcgcgagttcagggctcaccgagcggtgctggcggcatcctcaccctatttccacgatcaagtgttgttgaagggcatgactagtatctctcttccttcagtgatggacccaggagctttcgaaaccgtgctggccagtgcttataccggccgacttagtatggcggctgctgatattgtaaactttctgaccgtgggcagtgtcctgcagatgtggcacatagttgacaagtgcactgaattgctcagagaaggacgcgcttccgccaccaccacaattaccaccgcggctgccacgtccgttaccgtgcccggtgcaggcgttccatccgggtccgggggaaccgtcgccccagctacaatggggagcgcccgatctcatgcttctagcagagctagtgaaaaccagagcccatcctctagtaactacttctctccgagggagtcaactgatttttcttctagttctcaggaggcttttgctgcctctgccgtcggcagcggcgagaggagaggtgggggaccagtctttccggcacccgtggtgggctctggaggcgctacatctggaaagctcctgctggaggcagacgagctgtgcgatgacggaggggacgggcgtggggctgtggtcccaggtgccggacttcggcgacccacatacacacctccatcaattatgccgcaaaagcactgggtatatgtcaaacggggtggcaattgtccagctcccgcacccctagtacctcaagacccagacctcgaagaggaggaggaggaggaagatcttgtgctgacctgtgaggacgacgaagacgaggagctgggcggatcctctcgggttccagtcgggggaggaccagaggccaccctgagcattagtgatgtgagaaccctcagcgaaccacctgataaaggggaggagcaagtaaatttctgtgaaagttcaaatgactttggcccttacgaaggcggtggtcccgtggcgggactggacgacagcggaggccctactccatcttcctacgcaccctcccatccgcctcgtcccctactgccattggacatgcagggcaatcaaatcctggtgtttccttcctctagcagtagcagtagtagccaagccccaggacagccccctgggaatcaggccgaacacggcgcagtcacagtgggaggcacttccgttggtagtttaggggttccaggcagtgtgggaggggtcccaggcggtacgggaagtggagatggtaacaaaattttcctgtgccactgcggcaaggcattttcccataagtccatgagggacaggcatgtgaacatgcacctgaacctgcggccattcgactgcccagtgtgcaataaaaaattcaagatgaaacatcatctgaccgagcacatgaagactcatacaggacttaagccctacgagtgcggagtttgtgccaagaagttcatgtggcgagactcattcatgcgacatcggggacattgcgaaagaaggcatcggctgggcggagttggggcagtgccgggaccgggtactccaaccggaccctctctccccagcaagagggagagcccaggggtcggagggggttccggtgacgaggcttccgccgcaactccccctagtagccggagggtttggtcccctcctagagttcataaagtagagatgggtttcggaggtgggggaggtgctaattag

SEQ ID NO: 61243 - DNA, 1905 bp, Artificial Sequence
  Description of Artificial Sequence: Synthetic coding sequence
atggagccgtcccccctgagcccatctggagccgctctgccattgcctctaagtctggcacctccacctttgccacttcccgcagccgctgtggtccacgtgtcattcccagaagtgacaagtgccctgctggagtcattaaaccagcagcgcctgcaaggtcagctgtgcgacgtatcgatacgggtacaggggcgagaatttcgggcacatcgtgccgtgcttgctgcgagcagcccctactttcatgatcaggtgttgcttaaggggatgacatccatctccctgccttctgtcatggatccaggcgctttcgagaccgtgctcgcttccgcttatacaggtcgtctgtcaatggccgctgcagatatagttaacttcctcactgtgggttctgtcctgcagatgtggcatattgtggataagtgtaccgagctactgagggaagggagagcgagcgcgacgaccaccatcactacagcagccgctacaagcgtgacggtgccgggtgctggcgtgccctccggctcaggcggtactgttgccccagcgaccatgggctccgcaagaagccatgccagcagtagagccagtgagaatcagtccccctcaagctccaattacttcagcccaagggagtctacggattttagcagctcatctcaagaggccttcgccgcttccgctgtaggctctggcgaacgcagaggcggtggccctgtgttccctgcacccgtagtaggaagcgggggtgccacctctgggaagttgctgctggaagctgacgagctgtgcgatgacggtggcgacggacgcggagcagtcgttccgggtgccggtctgcgtcgcccaacttatactccaccaagtatcatgccacagaagcactgggtatatgtgaaacgaggtggcaactgccccgcacccgctccgttagttccacaggacccagatcttgaggaagaggaagaggaagaagacctggtgcttacatgcgaggatgacgaggatgaggaacttggcggatcctccagagtaccggtgggcggaggccctgaggcaacgctttcaatctcagacgtgcgtaccctaagtgagcccccagataaaggagaggaacaggttaatttttgtgaatctagcaatgactttggaccctacgagggcggtgggcctgtggcaggattagacgattccggagggccaactccctcttcttatgctccctctcatcctcctcggccacttctgcccctcgatatgcagggaaaccagatcttggtcttccccagttcaagcagctcttcctcatcacaggccccaggccagcccccaggcaatcaggccgaacacggagctgttaccgtgggagggacgtccgtcggctcattgggagtacccggatctgttggaggggtcccaggagggacgggcagcggcgatggcaacaagatcttcctctgtcactgcggtaaggctttttcccacaagtctatgagagatcgccatgtcaatatgcacctgaacctgagaccatttgattgccccgtgtgtaacaagaagtttaaaatgaagcatcacttgactgagcacatgaagacacataccggccttaagccatatgagtgcggcgtctgcgccaaaaagtttatgtggagagactcttttatgagacatcgagggcactgtgagcggaggcacaggctcggaggcgtgggtgccgtgccaggcccaggaacaccaacggggccaagtcttcccagtaaaagagagagccctggggtcgggggtggcagtggagatgaggccagtgccgcaacacctcccagcagcaggcgagtctggtcacctcctcgagtccacaaagttgagatgggttttgggggagggggtggagccaattag

SEQ ID NO: 61244 - DNA, 2019 bp, Artificial Sequence
  Description of Artificial Sequence: Synthetic coding sequence
atggaatcgaggaaacttatcagcgctacggatattcaatattcaggtagcctgttgaatagcctcaatgagcagagaggacacggcctcttctgtgatgtgactgtgatagtggaggacaggaaattccgcgctcataagaacatactgagcgcctcatctacttatttccaccagcttttctccgttgcaggccaggtggtggagttaagttttatccgcgcagagatattcgccgaaatcctgaattatatctattcttctaaaatcgtgcgggtcagaagcgaccttctggacgaactcataaaaagcggacagctgttaggtgtgaagtttatagccgaactgggcgtcccactcagtcaggtaaaatcaatttcaggcacggctcaagatggcaatacagaaccactgcctcctgattcaggcgataagaatcttgttatacagaagagtaaagatgaggcgcaggacaatggagccaccataatgcctataataacggagtcattttccttgagcgcagaagactacgagatgaagaagattatcgtgactgatagtgacgacgacgacgacgacgttatcttctgttccgagatcctgcccaccaaggaaaccctcccctctaacaacaccgtggcccaggtccagtcgaatcccggacctgtggccatcagcgatgtagctccctcggcttccaataatagtcctccactcacaaatataactccaactcagaagctgcccacccctgtcaatcaggcaactttgagccagacgcaggggagcgaaaagcttctcgtgtctagcgctcccactcacttaacacccaacattatcctgctaaatcagacccctctgtcaaccccccctaacgtgagcagctctctgccaaatcatatgcccagctcaattaacctgctcgtgcagaatcaacagaccccaaatagtgctattctgacaggcaataaagcaaacgaggaggaagaggaagagattatcgacgatgacgatgacactatcagctccagccccgatagcgccgtgagtaacacctctcttgtgcctcaggccgacacctcgcagaatacctcatttgatgggagcctcatccagaagatgcagatacccactctgctgcaggagcctctaagcaacagtctgaaaatatcggatattatcacacggaacaccaatgatcctggggtgggatcaaagcacctgatggagggccagaagattattacactggacacagcaactgagattgagggactgagtacggggtgtaaggtctacgccaatatcggcgaagatacgtacgatatcgtgattcctgtgaaagacgaccccgatgagggcgaggccagactggaaaatgaaattcctaaaacctctggctccgagatggccaacaagaggatgaaggtgaaacacgatgatcactacgagctgatagtggatgggcgtgtttactatatctgcattgtctgtaagcgcagttacgtgtgcctgacctcactccgtaggcattttaatattcactcctgggaaaagaaatacccgtgcaggtactgtgagaaagttttcccccttgctgagtatcgtacgaagcacgagatacaccacactggtgagcgtaggtaccagtgtcttgcctgtggaaagtcctttataaactaccagtttatgtccagccatatcaagtcggtccacagtcaggaccccagtggcgactccaaactctatcgtctgcatccctgtaggtccctgcagataagacagtatgcatatctgtctgatagatcttctacgataccagcgatgaaggatgatgggatcggctacaaagttgatacaggtaaagagcccccagtcggtaccactacctccacccagaacaagcctatgacatgggaagacatttttattcagcaggagaatgatagtatctttaagcagaacgtgacagatgggtccactgaatttgaatttatcatccccgagtcctactag

SEQ ID NO: 61245 - DNA, 609 bp, Artificial Sequence
  Description of Artificial Sequence: Synthetic coding sequence
atgctgacagccacgttatctatcaatacagaaaacataattgatgtgttggctgctgcttcttacatgcaaatgttcagtgttgcatccacttgtagcgaattcatgaaaagctccatcttgtggaacacccctaatagccagcctgagaaaggattggatgctggccaggagaataactctaactgcaattttacctcaagggacggaagcatcagtcccgtgagctccgaatgtagtgtggttgagcgcacaatccccgtgtgccgggagtcgaggagaaaaaggaaaagttacatagtcatgtcccccgaaagtccagtcaaatgcggcacacagacttcttccccacaggtgttgaattccagcgccagttatagtgagaatcgcaaccaaccagtagatagcagtcttgctttcccgtggacttttccttttggaatcgatcgcagaatccagcccgaaaaggtaaaacaggcagaaaacactcggactcttgagttgccaggtccgagcgagaccggtcggcgaatggccgattatgtgacctgcgagtctaccaagactaccttgccactgggaactgaggaagatgtgcgatctaagtag

SEQ ID NO: 61246 - DNA, 1713 bp, Artificial Sequence
  Description of Artificial Sequence: Synthetic coding sequence
atgggggtcaagacctttacccacagttctagttctcacagccaagagatgcttggtaagctgaacatgctgagaaacgacggccacttctgcgatatcactatccgagtgcaagacaagatctttcgcgctcataaggttgttctggccgcttgcagcgacttctttcgaaccaagttggtcgggcaagccgaggacgagaacaaaaatgtgctggacctgcaccatgtcactgtgaccggcttcatcccactactggagtatgcctacacagctaccttgtccattaatactgaaaatataattgatgtgctagccgcagccagttatatgcagatgtttagcgtcgccagtacttgtagcgagttcatgaagtctagcatcctttggaacactcccaatagtcaaccagaaaagggcttggatgccggtcaggagaataacagtaactgtaattttacttctcgggacggctctatcagccctgtctccagcgagtgctccgtggtagaaaggacaatcccagtttgtcgagaatctcgaagaaagaggaagagctacatcgtaatgtctcctgaatctcctgtcaagtgcggcacccagacctcgagccctcaagttctcaacagtagtgcctcgtactccgaaaacaggaatcagcctgtcgatagctcgctcgccttcccatggacattcccctttggcatagatcgccgtattcaaccagagaaggtgaaacaggccgagaacacacgcacccttgagctcccaggcccaagcgaaaccgggaggcggatggccgactacgtcacctgcgaaagtaccaagaccacacttccactaggtaccgaggaggatgttagggtgaaggttgagagactgagtgacgaagaggtacatgaagaggtcagtcagccagtgagcgcctcccaaagtagcctttctgaccaacagaccgtacccggttccgaacaggtgcaggaagatctcctcatttctccgcagagcagttcaatcggcagcgtggatgagggtgtaagcgagggcctgcccactttgcagtctacatctagtactaacgctcctcccgacgatgacgaccgcctggaaaatgtccagtatccctatcagctgtatatagctccatcaacctcctctactgagcgccctagccctaacggacccgaccgaccatttcagtgtcccacctgcggagtcaggtttaccagaattcagaacctgaaacagcacatgctcatccattccggcatcaagcctttccaatgtgaccggtgcggcaaaaaattcacacgcgcttattcactgaagatgcacagacttaaacacgaggggaagcgctgctttcggtgccagatctgcagcgcgacttttactagttttggcgaatacaagcaccacatgcgcgtttctcgtcatatcatccggaaacccagaatttatgagtgcaagacatgcggtgccatgttcacaaatagcgggaacttgattgtccatttgaggtctttaaatcacgaagctagtgaacttgcgaactacttccagtcaagtgacttcttggtgccagattaccttaatcaggagcaggaagagaccctggtgcagtacgacttgggcgaacatggattcgagagcaactcctccgtgcagatgcccgttattagccagtaccattccaaaggtaaggagccctag

SEQ ID NO: 61247 - DNA, 1713 bp, Artificial Sequence
  Description of Artificial Sequence: Synthetic coding sequence
atgggagtgaaaacgtttactcactcctcgtcgagccactcccaggagatgctgggcaaactcaacatgctgaggaacgatgggcacttctgcgatatcacaatacgagtgcaggataagatctttagggctcacaaggtggtccttgccgcttgcagcgatttctttcggactaagctcgtcggccaggctgaagacgaaaacaaaaacgtgctcgacttgcaccacgtgacagtgaccggctttattcccctattagaatacgcatacaccgccacattatccatcaatactgaaaacatcattgatgtgctagctgcagcttcatacatgcagatgttttccgtggcttcaacctgttccgagttcatgaagtcatcaattctgtggaatacaccaaactcacagccagaaaagggtttagacgccggacaagagaataactctaactgcaacttcaccagtagagatggttcaatctctccagtgtcctccgagtgctccgtggtggaacgaaccatacccgtttgccgcgagtcccggcgaaaacgtaaaagctatatcgtgatgtcacccgagagccctgtgaagtgtgggacacagacttcaagtcctcaggtgcttaatagcagcgccagttattctgagaaccggaatcagcccgtcgacagtagcctggccttcccatggacctttcccttcggcatcgatcgcagaatacagcccgaaaaggtcaaacaagccgaaaacacaaggacgcttgagctgcccggtccttccgaaacagggcgaaggatggcagattatgtgacttgtgaatccactaaaacaacgctgcctctcggaacagaggaggacgtacgcgtaaaagtggagcgtctaagtgacgaggaagtccacgaggaagtctctcagccagtttccgcttctcagtcctccctgagcgatcagcagaccgtgccaggatctgagcaagtccaggaggacctcctgattagcccacagtctagctcaatagggagcgtggatgagggcgtgtcagaaggcttgcctacccttcagagcactagttccactaacgcgccacccgatgatgacgaccgcctggagaacgttcagtatccttaccagttgtacattgctccatcgacatccagcacagagagaccatcccccaatggccctgaccgcccatttcagtgtcccacatgcggagtgcgctttacacggattcaaaatctcaagcagcacatgctcatacacagcgggatcaaacctttccagtgcgacaggtgcggaaagaagtttactcgtgcttactctctcaagatgcatagactgaaacacgaaggcaagcggtgttttagatgtcaaatctgttccgctacatttaccagcttcggcgagtataagcatcacatgcgcgtgagccggcacatcatccgcaaacccagaatatatgagtgtaaaacttgtggcgcaatgttcactaactctggtaacctcattgtgcacctgaggtctctgaaccacgaagcctccgaactcgcgaattattttcagtcctctgacttcctagtgcccgactacctaaatcaggaacaggaggaaacattggtgcaatacgatttgggcgagcatgggttcgaaagtaatagttccgtccaaatgcccgtcatctctcagtaccatagtaagggcaaggaaccatag

SEQ ID NO: 61248 - DNA, 1404 bp, Artificial Sequence
  Description of Artificial Sequence: Synthetic coding sequence
atgggagtgaaaacattcactcactcatccagctctcacagtcaagagatgttgggtaagctcaatatgctcagaaatgatggccacttttgcgatatcaccatcagggtacaggacaagattttcagagcccataaagttgtgctggcagcctgctccgactttttcagaactaaactggtgggacaggccgaggacgagaacaagaatgttctggacttgcatcatgtcacagtgacgggtttcattccactgttggaatacgcttataccgccaccctaagcatcaatacagagaatattattgacgtactagctgccgcaagctatatgcagatgttcagtgtggcgtccacttgttccgaatttatgaagagtagcatcttatggaacacccctaacagccaacccgaaaagggcctggatgctgggcaggagaataacagcaattgtaattttacctcgcgagatggttctattagccccgtctcatcagagtgctcagtggtggagagaaccatccctgtgtgcagggagtcccgtcgtaaacgaaagtcctatatcgtgatgagccctgaaagcccggtaaagtgtggaactcagactagttctcctcaggttctcaacagttccgcaagttatagcgagaaccggaatcagcccgttgattcctccctcgcttttccctggaccttcccctttggaatagatcggcgaatccagccagagaaggtaaaacaggctgaaaacacccgtactcttgaactacccggtccttcagagacaggtaggcgaatggctgactacgtgacctgtgagtcgactaagactacactgcccctcggaacagaagaggacgtccgcgtgaaggtggagagactgtccgacgaggaggtccacgaagaggtcagtcagcccgtatccgctagtcagtcctctcttagtgaccaacagacagtgcctggttcagagcaggttcaggaagatctcttgatttcccctcaatcctccagcatcggctccgtcgatgaaggagtgtctgaggggctgcccacactgcagagcaccagctctaccaatgcccctccagacgatgacgaccgactggaaaacgtgcaatatccgtaccaattgtatattgccccaagcacctcctctaccgagaggccatccccgaacggtccggacagaccgttccagtgccccacgtgcggcgtgagatttactaggatccagaacctgaagcagcacatgctcattcactccggaatcaaaccattccaatgcgatcgttgtggaaaaaagttcacgcgtgcttactccctgaaaatgcacagactcaagcacgagggccacccccgaaagtcagcatcgcggtcttcctcagctacgaattgttgctag

SEQ ID NO: 61249 - DNA, 1362 bp, Artificial Sequence
  Description of Artificial Sequence: Synthetic coding sequence
atgggagtgaagacgtttacgcattccagtagcagtcacagccaggaaatgctggggaagcttaacatgctgcgcaatgatggtcacttttgtgatataacgatcagagtgcaagataagatcttccgcgctcacaaggtggtcttagctgcctgctccgattttttccggacaaaactggttggacaggccgaggacgagaataagaacgtgctggacttgcatcatgtcaccgtgactggttttattcccctgctggagtatgcatacacagcaaccttatctatcaatacagaaaatattatcgatgtgctggctgccgcttcatacatgcagatgttcagtgtcgcctccacttgctccgagtttatgaaaagttctattttatggaacacccctaactctcaacccgaaaaagggctggacgcgggtcaggagaacaactctaactgtaattttacctcacgggacggctccatttctccggttagctcagagtgtagcgtcgtcgaacgtacgattcccgtatgtagggagagccggcgaaaacggaagagctacatcgttatgagcccagagtcaccagtgaaatgtggaactcagacttcttcgccgcaggtcctcaactcctctgcttcctattctgagaatcggaaccaaccagtcgatagctctcttgcgtttccctggacattcccttttgggatcgatcgccgaattcaacctgagaaggtgaaacaggcggagaacaccagaactctggaactgcctggcccatcagagacagggaggcgaatggccgactacgtgacgtgcgagtccacaaaaactactctgccgcttggaactgaggaagatgtgagagtaaaagttgaaaggctcagtgacgaggaggtgcacgaggaagtctcccaacctgtgtctgcctcacagtcaagcctgtctgatcagcagactgtgccagggtcggagcaggttcaagaagatctgttgataagtcctcagagctcctccatcggaagtgttgatgagggagtgtcagaaggcctgcccacactgcaaagcacaagttctactaatgcaccccctgatgatgacgaccgcctcgaaaatgttcagtacccatatcagttatatatcgcaccatcaacttcaagtaccgaaagaccttcgccgaacggtcccgaccgcccattccagtgtcctacttgtggggtgcggtttacccggatacagaatctaaaacagcacatgttgattcatagcgggatcaaaccctttcagtgcgacagatgcggtaagaagttcacccgggcttacagtcttaagatgcaccgcctgaagcacgaggtaataagctag

SEQ ID NO: 61250 - DNA, 1425 bp, Artificial Sequence
  Description of Artificial Sequence: Synthetic coding sequence
atgggcgtgaaaaccttcacacacagcagctcatcacattctcaggagatgctcgggaagctcaacatgctgcggaatgacggtcacttctgcgatatcaccatcagagttcaggacaagatattccgcgctcataaggtagtgttagctgcttgttcagattttttccggaccaagctagtcggtcaggccgaagacgaaaacaaaaatgtgttagacttacatcacgtgacggttacaggctttataccactgctggagtacgcatataccgccacactgagtatcaataccgagaacatcatagatgtactggccgctgcatcttacatgcagatgttttccgtggcttctacctgctccgaattcatgaagtcttcaatcctctggaacaccccgaattcacagcctgagaagggtctggacgccggacaagaaaataattctaactgtaatttcactagccgagatggaagcatctctcccgtctcttctgagtgtagcgtcgtggaacggacaatccccgtgtgtagagagagcaggcgcaagaggaagagctatattgtcatgagtcctgagagccccgtgaagtgtggtacacagacgtcctccccccaagtcctcaactcctctgcttcttactctgagaatcggaaccagccagtggactcttccctggcatttccttggaccttcccattcggcattgatagaaggatccagccagagaaggtgaagcaggccgagaacaccaggactttggaactgcccggtccttccgagaccggcagaaggatggcggattacgtgacttgcgagtcaactaagaccacgcttcctctcggtacagaggaggatgtgcgggtaaaagtggagagattgagtgatgaggaagtgcacgaggaggtgtctcagcctgtgagcgcctctcaatcttcgttgagcgatcagcagaccgtccctggaagcgagcaagtccaggaagacctactgatctctcctcagagctcatcaatcggctccgtggacgaaggagtctccgaggggctgcctaccttacaatctactagcagcacaaacgcccctccggatgacgatgaccggctggagaatgttcagtatccttaccagctttacatagctccgtccactagttctacggagaggcctagccctaatggccctgaccgcccatttcaatgtccaacctgcggggttcggttcacaaggatccagaacctgaaacagcacatgctcattcactcagggattaaaccttttcagtgcgaccgctgtggaaagaagtttactagagcctactcactcaagatgcaccgattgaaacacgaagtgcctctgcagaggcagggtacgatgatcgacaatagtcaagccgttgatgagatgacacgtaacggtgaatag

SEQ ID NO: 61251 - DNA, 231 bp, Artificial Sequence
  Description of Artificial Sequence: Synthetic coding sequence
atgaaaggaggaagtcgcgtctcaaacccagctgtcatggcccaggaagaggaagacgttagagattacaacctaaccgaagaacagaaagctataaaggctaagtacccacccgtcaacaggaagtatgagtaccatcagacacacctgcttcagagcccccatcggatttattctcacctccactcatccgctatctggaatccctacctgcaccttatgggaacatag

SEQ ID NO: 61252 - DNA, 411 bp, Artificial Sequence
  Description of Artificial Sequence: Synthetic coding sequence
atggctcaggaagaggaggacgttagggattacaacctgaccgaggaacagaaggctattaaggctaagtaccccccagtcaatcgcaagtacgagtatttggaccatacagcagatgtgcagcttcacgcttggggagatacattggaggaagcgtttgagcagtgcgccatggccatgttcggttatatgactgataccggaacggtagagcccttgcaaactgtggaagtggagacacagggcgacgaccttcagtctctgctgttccattttctcgatgaatggctctataaatttagtgcagacgaattcttcatccctcgcgtaggcagacgcatattcattgtgcaagctccctccgggaaccgctcacagtctaacaacatattttcaaacgctggcctctag

SEQ ID NO: 61253 - DNA, 444 bp, Artificial Sequence
  Description of Artificial Sequence: Synthetic coding sequence
tgaggcggatcccgtgtgagtaaccccgcagtgatggcacaggaggaagaagacgttcgggattacaacctgacggaggaacagaaggctattaaggcaaaatacccgccagtgaaccggaaatacgaatacttagaccacacagctgacgtgcaattacatgcttggggtgatactctcgaggaagcctttgagcagtgcgctatggcgatgtttggctacatgaccgacactggtaccgtcgagccactccagactgtggaggtcgaaactcagggagacgacctccagagtctgctgttccactttcttgatgagtggctgtacaagttcagcgccgatgagttctttattccccgagtgggacggaggattttcatcgtccaggccccatcgggaaaccggtcacagtctaacaacatttttagcaatgccggtctatag

SEQ ID NO: 61254 - DNA, 540 bp, Artificial Sequence
  Description of Artificial Sequence: Synthetic coding sequence
atgaagggcggaagcagagtgtcaaaccctgctgtgatggcccaggaggaagaagatgtgcgggactacaaccttactgaggaacaaaaggccattaaggccaagtatcccccagttaaccggaagtatgaatacctggaccatactgccgatgttcaattacacgcctggggggacactctggaagaggcatttgagcagtgcgccatggccatgttcggttatatgacagacacaggtaccgtggaaccactccagaccgtggaggtcgagacacagggtgacgacctccaatctctgctatttcactttttagacgagtggctgtacaagtttagtgcagacgagttcttcatccctagggaggtgaaggtcttgtctatcgatcagaggaatttcaagctgcgctccatcggctggggtgaggagtttagcctcagtaagcatccccagggcaccgaggtcaaagccatcacttacagcgccatgcaagtgtacaacgaagagaatcctgaagtattcgttataattgatatctag

SEQ ID NO: 61255 - DNA, 1488 bp, Artificial Sequence
  Description of Artificial Sequence: Synthetic coding sequence
atggccgcaaactggacactgagctggggccagggtggcccatgcaattcccccggaagtgatacccctagaagtgttgccagccctgagacccagctgggaaaccatgaccgaaatccagaaacatggcacatgaacttcaggatgttctcctgccccgaggaatcagatcccatacaggccctgagaaagttgacagaactgtgtcatctctggctgaggcctgacctccacactaaggagcaaattctggatatgctggtgatggagcaatttatgatttccatgccgcaggaactccaggtgctcgtgaaagtcaatggagtgcagtcgtgtaaagacctggaggatctcttaagaaataatcggagacctaagaagtggagcatagtgaatctgctgggtaaggagtatttgatgcttaattcagacgtagaaatggcggaggccccagcttcggtgcgagatgaccccagagatgtgtcttcccagtgggcgtctagcgttaaccagatgcatccaggtacaggccaagctcggagggaacagcagatcttacctcgtgttgctgcactttctcggagacaaggagaagatttcctgctgcacaagtcaatcgatgtcactggcgaccccaattcaccgagacccaaacaaaccctggagaaggatctgaaggaaaacagggaggaaaaccctggtctgagtagccccgaacctcagcttccaaaaagccccaacctggtacgggctaaggaggggaaagaaccccagaaaagagcctctgttgagaacgtagatgccgatacaccctccgcctgtgtcgtggaaagggaggctcttacccactccggcaacaggggggatgcccttaacctctcttcacctaagcgcagcaagccagacgcttcttcaatctctcaggaagagccccagggtgaggctaccccggtggggaatagagaatctcctggccaggctgagataaaccctgtgcactcccccggaccagccggaccagtttctcaccctgatggccaggaagctaaggccctccctccatttgcatgtgacgtctgtaataaatcatttaaatactttagccaactttctatacaccgaagatcccatacaggcgatcgaccctttcagtgcgacctgtgccgcaagaggttccttcagccatcagatctgagggttcatcagagagtacatactggcgagagaccatatatgtgcgacgtctgtcaaaaacgcttcgcccatgagtccacattgcaagggcacaagcgaattcacactggcgagagaccttttaaatgcaagtattgctccaaggtgtttagccacaagggcaatttgaacgtgcatcagaggactcacagcggcgaaaagccctacaagtgccctacatgtcagaaggcatttagacaactcggcaccttcaagagacatttgaaaacccatagagaaactacgtctcagtag

SEQ ID NO: 61256 - DNA, 1491 bp, Artificial Sequence
  Description of Artificial Sequence: Synthetic coding sequence
atggctgcaaattgcacctccagctggtcactgggagaatcatgcaactccccaggatccgagccacctcagtcaatgcctagcccggcaacgcagctaggaaaccacgactccgacccagaaacttgtcatgtgaatttcagaatgttctcttgtcctaaagaaagcgaccccatacaagcccttcgcaagcttactgagttatgccacttatggttgcgacctgatctacatactaaggaacagatactggatatgctcgtcatggagcagtttatgatctcaatgccacaggagctccaggtgcttgtgatgatgaacggtgtacagagttgcaaggacctggaggatctgctccgtaataacaggcgtccaaagaagtggagtgtcgtgtcgttcctgggtaaggagtacctgatgcaggagtctgacgttgagatggcagaagcaccggcttccgtcagggacgacccacgccacgtctcttcccagcggacctcctcagttaaccagatgtgcccggaagagggacaggcgagccaggagctgcagacattgccccgagtaccagctttgtttcggaggcaagaagaagactttctacttccggagacaacagtgatgaaaggggatcctaaggccctccggccaaagcctacgcttgagaaggatttggaagaagatcgggaggaaaatcccggtctgaccagccccgaaccacaacttccgaatagccccaccggggtagtgggggcaaaggaggggaaggaaccccaaaagcgggcttcagtcgaaaacgtcgacgctgataccccaagcgcgtgtgtcgtcgaaagagaagctagtactcactctggttccaggggcgacgcactgaacctcagggggctaaagaggtctaagccagatgccacttccatttcccaagaggagccacagggagaggccacaccagtgggcaaccgggaatcacccggacaggccgagattaatccagtccactcccctggaccagcaggcccagtgtctcacccttccggccaggaagtcaaggagctcctgccgtttgcatgtgaggtgtgtgggaaacggttcaaataccgcggtaagttggctgtccacacccggagtcatactggcgaaagactgttccagtgcaatctgtgcggtaaacggttcatgcagcgaataggcctccagtttcaccagcgaacccacacaggtgaacgaccttacacatgcgacatctgtcaaaaacagttcacacaaaagagttacttaaagtgccataaaagatcgcacacgggggagaaaccattcgagtgtaaggactgcaagaaagtatttacctacaaagcaaacctgaaagaacatcagcgtatccactcgggcgaaaaaccacacaagtgttctaaatgtccaagagcctttggcaggcctgctaccctgaggaggcaccagaaaacccatcgggaagctaccagccaatag

SEQ ID NO: 61257 - DNA, 1491 bp, Artificial Sequence
  Description of Artificial Sequence: Synthetic coding sequence
atggctgccaactgtacctcatcttggtcattaggcgagagttgcaactcgcccggatccgagccaccccagagcatgccctccccggctacacagctgggaaatcacgattctgaccccgagacatgccatgtgaattttaggatgttcagttgcccgaaggaaagcgacccgatccaagctcttcgaaagctcacagagttgtgtcatctctggctccggcctgatctccataccaaagaacaaatacttgatatgctggttatggagcagtttatgatatccatgccgcaggaactgcaagtgctagtgatgatgaatggcgtacagagttgcaaagatctggaagatctcctcaggaataataggcgacctaagaaatggtccgtggtgtcttttctgggcaaggagtatctcatgcaagaaagtgacgtggagatggccgaagccccagccagcgtgcgggacgatcctaggcatgtgtctagtcagagaacttcatcggttaaccagatgtgtccagaggaagggcaggcttctcaggaacttcaaaccttacctagggtcccagctttgtttcgacgacaagaggaggacttcctcttgcctgagacaaccgtcatgaagggagatccaaaggcccttcgacccaagcctacgcttgaaaaagacttggaggaagacagagaggagaaccctggcctgacctctcctgaaccccagctgccaaatagtcctactggtgtcgttggtgcaaaggagggtaaggagccccaaaagcgggctagcgtggagaatgttgacgccgatacccctagtgcctgtgtggtcgagcgggaagcctccactcatagcgggtcccggggtgacgccctgaacctcaggggcctcaagagatccaaaccagatgctacctcaatctcacaggaagagccacagggggaggccactcctgtgggcaatcgggagagcccaggccaggcagagataaaccccgtgcattcccctgggcctgctggtcccgtgtcccatccctctggccaggaagtgaaggagctcttaccctttgcctgcgaggtttgtggcaagagattcaaataccgcggaaagcttgctgtgcacacccgaagccatacaggggagagactctttcagtgtaacctatgtggtaaaagattcatgcagaggatcggactgcagtttcatcagcggactcatactggggagcggccatatacatgtgacatttgccagaaacaattcacgcagaagtcgtaccttaaatgccataagcgatcacacacaggcgagaaaccattcgagtgtaaggattgtaaaaaagtctttacttacaaggccaacctcaaggagcaccagcgcatccactctggcgaaaaaccacataagtgttccaagtgtccacgggcttttggacggcctgcaacattacgcaggcaccagaaaacacaccgcgaggccacaagtcagtag

SEQ ID NO: 61258 - DNA, 2316 bp, Artificial Sequence
  Description of Artificial Sequence: Synthetic coding sequence
atggagaaggtccagctcgagtttgaaaatcaagagatggagaaaaaacttcaggagttccgatcaaccaggaataaggagaaggaggaccgtgaatcaagtgagtactactggaaatctggtaaagtcggaaagctcgtaaaccagtcttatatgatgagtcagaataaaggaaatgtcgtgaaattctctgccggtaaggttaagctcaagttacttaaggaacaaattcaagagcctgtgaagcctaccgtcaactacaaaatggcaaattcttctgaatgcgaaaagccaaaaattaatgggaaggtttgtgggcagtgcgagaataaggcagcactattggtgtgtctcgagtgcggggaagactactgttccgggtgcttcgctaaagtacaccaaaaaggtgcgctcaagctgcaccgcacaacattgctccaagctaagtcccagatcctattcaacgtccttgatgtagcccaccagtttatcaaggatgtaaaccctgatgaacctaaagaggagaacaattctacgaaggagacaagcaagatacaacataagccgaaatcggtattgcttcagcgatccagcagcgaggtggagataactaccatgaagcgagctcagagaactaagcctcggaagtctttgctatgtgaaggtagcttcgatgaagaggctagtgcacaatcattccaagaagtccttagtcagtggcggacaggcaatcatgacgataataagaaacagaaccttcatgccgcagtgaaggacagcttggaggaatgcgaggtccagactaacctgaaaatctggcgagaaccacttaacatagaactgaaggaagatatcctcagttatatggaaaaactatggctcaagaaacataggaggacgccgcaggagcagctgttcaagatgctgccagatacttttcctcacccacacgagactaccggcgatgcccaatgctcacagaatgagaatgatgaagattcggacggcgaagagacaaaggtacagcacacggctttgctcttacctgtggaaactctcaacattgaacggccagagcccagtctgaaaatcgtggaactggatgatacctatgaagaagaatttgaggaggccgaaaacattgtaccttacaaggtcaaactagctgacgctgattcacagcgatcttgcgcatttcatgactgccagaagaacagctttccatacgagaacggcattcatcagcaccacgtgttcgataagggaaagcgcgattttctgaacctctgtctgcgtaactcatcgacttactataaagataactccaaagcagagactagtaacacagacttcgacaatatcgtcgacccagacgtctactccagcgatatcgagaagattgaagagtcaacgtcattcgaacgcaacctcaaggagaagaatataggcctggaatccaaccagaagtccgacgacagctgcgtgagtctggagtctaaagacacactgctcggacgcgatcttgagaaagcccctatcgaagagaaactgtcacaagacatcaaagagtctctggaattgagcaacttatataaaagaccgtcctttgaggagtccaaaaccacaaagagttctctgctgctccaggaaatcgcatgccgctcaaagcctataaccaaacaatatcagggcttggaaaggttcttcatcttcgacacaaacgagcggctgaacctgctgccctcgcacaggctggagtgtaacaactcttctacaaggataacactggccggtcagaaatcccagcgcccaagcaccgcaaacttccctctgagcaatagtgtcaaggagtccagttcgtgtttaagctcttcccaccccagatccagatccgctgccgcacagagcagctcccgagccgcttctgaaataagtgaaattgagtacattgatattacagaccagaatgaactgtctctggacgacacgactgatcagcacacacttgacaatcttgagaaagaattgcaagtgctgaggtccctggctgacacttccgagaagctgtatagtctcacatccgaagaattcccggatttcagctcccagtcactgaacatctcccaaatatcgactgatttcctgaagaccagccatgttcgtggcccttgcggcgtggaggagttgagttgttcaggccgagacacaaagattcagtccctgctcagcctaagcgaaagcagcaccgacgaagaggaggaggactttctgaacaagcaacacgtgattacgctgccatggtcgaagtctacctag

SEQ ID NO: 61259 - DNA, 2082 bp, Artificial Sequence
  Description of Artificial Sequence: Synthetic coding sequence
atgatcgctccattgctgtgtatccttagctacaacttcaatacttttgcaatcctcaatgtctacagtaaactcactatgttttgtacaacgaacagcctgccaatggatctgttgctgaagcagggcagccttaaacaggaggtggaatcattttgttaccaaatcgtcagtgagagcaatgatcagaaggtcgggattcttcagagtgaggataagcagttgcagccgtcggtgtcaaagaaatccgagggcgagttgagcagagttaaattcatcagcaacagcaacaaaatcactttcagcaaaaagcctaaacggaggaaatacgacgagtcatacctgagttttggttttacttattttggaaaccgggatgccccacacgctcagtgtgttctctgcaaaaagatcctctcgaacagctccctggctccatccaagttaagaaggcacctggaaaccaagcatgccgcttataaagacaaggatatatcgttcttcaaacaacatctggacagcccagagaacaataagccaccgacacccaaaatcgtcaatactgataatgagagtgctacagaggcgagctacaacgtgtcataccacatcgcattaagcggggaagctcatactataggggagctcttaatcaaaccatgtgccaaggacgtagtgatgcggatgttcgacgaacaatatagcaaaaagatcgatgctgttcagttatccaactcaaccgtggcaagacggataaaggacctggctgcagacattgaggaggagcttgtgtgtcgtttgaaaatttgcgacgggttttctctgcagctggatgagagcgccgacgtgtcaggcttagctgtgcttttggttttcgtgagataccgtttcaataagagcatcgaggaagacctactgctttgcgaatcacttcagtccaacgccactggtgaagagatctttaactgcatcaactctttcatgcaaaagcacgagatcgaatgggaaaagtgtgtggatgtgtgttccgacgcatcaagggccgtcgatggaaaaatcgcagaggcagtgacactgatcaagtatgttgcacctgagtcaacttcttcacactgcctgttataccgccacgccctagcagttaagatcatgcccacgtcgctgaagaatgtactggatcaggccgtacagattatcaattatatcaaggcacgccctcatcagtcaagactgctgaaaattctgtgtgaggagatgggggctcaacacacagcattattactgaacacggaagttaggtggctctcccggggaaaagtcctggtgcgcctgttcgagctgcggagagagcttttggtgttcatggactccgcctttcggctttctgactgcctcacaaactcttcctggctgctgcgcctggcctatttggccgatatatttacaaagctgaatgaggttaacctgagcatgcagggcaagaatgtgaccgtgttcaccgtcttcgataagatgtcttccctcctgcgaaagctcgaattctgggcttcttccgtcgaggaagagaactttgattgtttccctactctttctgactttcttactgagattaattcaacagtcgacaaggacatatgtagtgcgatcgtgcagcatctgcgtggcctccgagctacactgctaaagtacttcccagtgacaaacgacaataacgcctgggtgagaaatcctttcacagtcacagtgaaaccagcttcactggtggcccgagattacgaatcattaatcgacttaacctctgactctcaggtcaaacagaatttctccgagctttctttgaacgacttctggtccagcctcattcaggaatatcctagcattgctcgacgagccgttcgcgtattactgcccttcgcaacaatgcacctttgtgaaactggcttttcatactacgctgccacgaagaccaaataccgcaagcgacttgatgcagccccacacatgaggatccgactgtccaacatcacccctaacatcaagaggatctgcgataaaaaaacccagaaacactgctcacactag

SEQ ID NO: 61260 - DNA, 2082 bp, Artificial Sequence
  Description of Artificial Sequence: Synthetic coding sequence
atgatcgctccgctgctgtgtattcttagttacaactttaatacattcgcaattctcaatgtttactcaaaacttacgatgttctgcacaacaaattctctcccaatggacttgttgctgaaacagggtagtctgaagcaagaggtggaaagtttctgttatcaaatagtgtcagagtctaacgaccaaaaagtgggcattctgcagtccgaagacaagcagcttcagccgtcagtctcaaaaaaaagtgaaggggagctatcccgtgtcaaatttatcagtaattctaataaaattacattctctaaaaagcctaaacgcaggaagtacgatgaatcatatttgagtttcggctttacatactttggtaacagggacgcaccccatgcccagtgtgtactctgcaaaaagattctgtctaatagctctctggcgccttccaagcttaggagacacctcgagaccaagcatgccgcttacaaggacaaggatatctctttctttaagcagcatctggactctccagaaaacaataaaccaccgacccctaaaatcgtgaacacagataacgagagtgcaactgaagcctcatataatgtctcctatcacatagctctgagcggagaagcacatacaattggggagctcttaatcaaaccatgtgctaaagatgtcgtcatgcgaatgtttgacgagcaatatagtaaaaagatcgacgccgtccagttaagtaatagcaccgtggcacgcaggatcaaggatctggctgccgacatagaggaagaactggtctgccgactcaagatctgcgacggattcagccttcagttagatgagtccgccgatgtaagcggtttggcagtgttactcgtgtttgtgcgatatagatttaataaatctattgaggaagatttattactatgcgaatctctacagtccaatgccaccggagaggaaatttttaattgcattaactccttcatgcaaaaacacgagattgaatgggagaagtgtgtcgatgtgtgtagcgacgcatcccgcgcagtcgatggcaagatcgcagaagccgtaaccctgattaagtacgtagcaccagagagtactagcagccattgcctgctgtacagacacgccttggctgtgaagatcatgccaacaagcctcaagaatgtgctggatcaggctgtccagatcattaactatatcaaggctcggcctcatcaatccaggctgttgaagatcctatgcgaagagatgggtgcccagcataccgctctgcttctcaataccgaagtgaggtggctgtccaggggaaaggtactggtgcggctatttgagctgaggagggaactccttgtgtttatggacagcgcttttagactatcggattgcctgacaaactcctcatggttgctacggcttgcctatttggcagacatcttcaccaaactgaatgaagtcaacctgtccatgcagggaaagaacgtaacagtattcaccgtcttcgataaaatgagctccctgcttcggaagctggagttttgggcttcaagtgtggaagaggaaaattttgactgtttcccaaccttgagcgactttttgaccgagatcaatagtacagtggacaaagacatctgttctgccattgtccaacacctgcggggattgagggcaaccctcctaaaatacttcccggttacaaatgacaataatgcttgggtccgcaatcccttcactgtgacagtgaagcctgcatccctggtggctagagactacgagtcactcatcgatctcacaagcgactcccaggtgaagcagaattttagcgagctttccttaaatgacttttggtcatccctgattcaggaatacccttctattgccagacgggctgtgagagtgctgttgccatttgctactatgcacctgtgtgagaccggttttagctattatgcggctaccaagaccaaataccggaaacggctggatgctgcccctcacatgaggattaggttgtctaacattactcctaatattaagcggatctgcgacaagaagactcagaagcattgttcgcactag

SEQ ID NO: 61261 - DNA, 1305 bp, Artificial Sequence
  Description of Artificial Sequence: Synthetic coding sequence
atgcctgatagagacagctatgctaacgggaccgggtcaagtggagggggacccggtggcggaggctccgaggaggcttccggcgctggcgtgggttccggaggggcatccagcgatgcaatctgccgtgacttcctccgcaatgtgtgtaaacggggaaagcggtgtcggtatagacaccctgacatgagtgaggtctctaatctgggcgtatccaaaaatgagtttatcttctgtcatgacttccagaacaaggaatgcagccgccctaactgccgctttattcacggaagtaaagaagacgaggatggatacaagaaaaccggggaacttccccctcggctcagacagaaagtggccgctgggcttggtctgtccccagcggacctgccaaacggtaaagaggaagtgcctatctgcagagatttcctgaaaggggactgccagcgcggagcaaagtgcaagttcaggcacctccagagggactttgagttcgacgcgagaggaggcggaggaaccggaggtggctctacaggaagcgttctccctgggcgacgtcacgacctatacgacatctatgacctaccagaccggggttttgaggaccatgagccaggcccaaagaggcggagggggggatgctgtccgcctgatggccctcacttcgagagttacgaatatagcctggcccctccaagaggagttgagtgtcgcctgttggaggaagagaacgccatgcttaggaagcgcgtggaagaactgaaaaagcaagtgtcaaaccttcttgcaaccaacgaggtgctgctggagcaaaacgctcagttccggaatcaggcaaaggttattacattgagctctacggcaccagccaccgaacaaacccttgctcctacggttggcacagtcgccaccttcaaccacggcatcgcacagacgcacactacgttgagctcccaagcgctgcagcctaggcctgtatcccaacaggaactggtcgcccctgcaggggctccggctgcccctccaaccaacgcagctccacctgccgcaccccctccgcctcctccacatctgaccccggagatcacacccctgtccgcggctctggcccaaaccattgctcagggaatggccccaccacctgtctctatggcacccgtagccgtgtccgtcgcccctgtggcacccgtggcagtgagcatggcccagcctctggcgggaattactatgtctcacaccacgactcctatggtgacttacccaatcgcgagccagtctatgaggatcacagcaatgccacactag

SEQ ID NO: 61262 - DNA, 270 bp, Artificial Sequence
  Description of Artificial Sequence: Synthetic coding sequence
atgcccgatagagactcttacgcaaatggtactggctcaagtggcggaggccctggagggggtggcagcgaggaggccagcggggctggcgtggggtcaggtggagccagtagtgacgccatttgccgtgattttttgcgcaatgtctgcaagagaggtaaaaggtgtcgctacagacatcccgacatgtcagaggtctccaacctcggagtgtctaagaatgaatttatcttctgtcacgacttccagaacaaagagtgttctcggtag

SEQ ID NO: 61263 - DNA, 138 bp, Artificial Sequence
  Description of Artificial Sequence: Synthetic coding sequence
atgcccgatcgagactcttacgctaacggcacaggaagctctgggggtggtcccggtggtggagggagcgaagaagcgagtggggcaggagtggggtcaggaggcgcaagttccgacgccatctgccgcgacttctag

SEQ ID NO: 61264 - DNA, 240 bp, Artificial Sequence
  Description of Artificial Sequence: Synthetic coding sequence
atgcccgatcgtgattcatacgctaacggaacgggcagttccggaggaggcccagggggaggaggctctgaggaagctagcggagcaggggtggggtccggcggagccagtagcgatgcgatctgccgggattttcttagaaatgtgtgcaagcgcggaaaaaggtgccgttacagacatccggatatgtcagaagtctccaacctgggagtgtctaagaatgaattcattttttgttag

SEQ ID NO: 61265 - DNA, 5136 bp, Artificial Sequence
  Description of Artificial Sequence: Synthetic coding sequence
atgataagtacagccccactgtattctggggtgcacaattggacatcaagcgacaggattagaatgtgtggtatcaatgaggagcgcagagctcccctctcagatgaagagtccacgacaggcgattgtcagcactttggctctcaggagttctgcgttagcagctccttctctaaagttgagctgaccgccgtgggaagtggatccaacgccagaggggctgatccagatggctccgctaccgagaaattgggccataagtccgaggacaagcctgacgaccctcagcccaagatggattacgccggaaacgtggcagaagctgagggatttcttgttccgttgtctagtccaggggatggtctcaagctgccagcctcagattccgctgaagctagtaactcgagggccgattgctcatggacaccactgaacacccagatgagcaagcaggtcgactgcagtcccgctggtgtgaaggccctggacagcaggcagggggtgggtgagaagaataccttcatcctggctacgttggggacaggtgtccccgtggaaggtaccttgcctctcgtcaccacgaatttttctcctttgcccgctcccatttgtcctcctgcccctggctcagccagtgtcccgcattccgttcctgacgctttccaggtgccactctccgtaccggcacccgtgcctcactcaggactggtgcctgttcaggtggctacttccgtgcccgctccgagcccaccgcttgccccagtgccagctctggcccctgcccctcctagtgtccctacccttattagtgatagcaaccctttgtcagtctcggccagcgtcctagttcccgtgccagccagcgctcctcctagcgggccagtacctctctccgcccctgctccggctccgctgtccgtgcccgttagtgccccacccctggccctgatccaggcacctgtgcccccatccgccccaaccctcgtgctggcccctgtccccacgcctgttctggccccaatgcccgcaagcactccacccgcagcgccagctcctccctctgtgcccatgccaacaccgacgccttcatccggacctccgtccacaccaactctgattcccgcattcgcgcctacacctgtcccagctcctacccccgctcctatcttcacccctgcccctacccccatgcctgcggctacacccgctgccatccccacctcggctcccattcctgcaagcttctctttgagtagggtgtgcttcccagcagcacaggcccctgcaatgcaaaaggtgccactgtcatttcagccgggaactgtactgactccatcacaaccactagtctacattcctcctccttcatgcgggcagcctctttctgtcgctactttgcctaccaccctgggtgtgagctcaacacttactctgcccgtcctaccatcgtacctgcaggaccggtgtctgcccggagtgttggctagcccagagctacgctcttacccctatgcattctctgtggctcgccctttgaccagcgactcaaagctagtgagcctggaggtcaaccgacttccgtgtacctctccttctgggagcaccaccacccagcccgcacctgacggggttcccggtccattggccgacacatctctggtcactgcctcggctaaagttctccccaccccccagcctttgttgccggcaccatcagggagcagtgccccaccccaccctgcgaagatgccctccggcaccgagcagcagacagaaggcacatccgtcactttcagccccctgaagagtccaccccagcttgaacgggaaatggcctcaccgcctgagtgctcagaaatgccactggatctgtcctctaagtctaaccgtcagaaactccccctgcctaaccagaggaaaactcctcccatgccagttcttacccctgtgcatacatcgtctaaggcactgctctccacggtcctgagcaggtcacaacgcacaacacaggctgctggcggtaatgtgacatcctgcctaggatctacttcttctcccttcgtgatttttcccgagattgtaaggaacggcgatccttctacctgggttaaaaattcaactgccctgataagcaccatccccggaacgtacgtcggggtcgctaatccagtgcccgcatcattactacttaataaggacccaaatctcggcctgaacagagaccccaggcatcttcctaaacaggagcccatttctatcattgatcagggagaacccaagggaactggagctacctgcggcaagaaggggagtcaggctggcgcagaaggacagcccagcacagtcaagcggtataccccagctcggatagccccaggacttccaggctgtcagaccaaagaactgagtctgtggaagcctaccgggccagccaatatctatccgaggtgtagtgtgaacggaaagcccacatcaacgcaagtgctgccagtgggctggtcaccttaccaccaggcgtctctcctgtctatcggaatctccagcgccggtcagctcactccctcccagggagcgccaattcgtccaacatcagttgtgagtgaattttctggggtgccctcactctcttccagcgaagctgtgcatgggttgcctgaaggtcaacctagacccggtgggtccttcgtcccagagcaggatccggttactaagaacaaaacttgtcgcatagccgctaagccctacgaggaacaggtgaatccagttcttctcactctgagcccacagacaggaacgcttgccctgagtgtccagccaagcggcggagatataagaatgaaccaaggacccgaagaaagcgagtcccacctctgctccgactctacccctaagatggaaggtccccaaggggcatgcgggttaaagctggccggtgacaccaagccgaaaaatcaagtgctggccacctatatgtcccatgaactggtgttggccactccccagaacctgcccaaaatgcccgagctacccctgctgccacacgacagtcaccccaaagagttgatcctggatgttgttccaagcagcaggaggggctccagtactgagcggccacagcttgggtcacaggtggatttgggacgcgtgaagatggagaaggtagacggagacgtggttttcaatcttgccacctgctttcgcgctgatggccttccagtcgcaccccagcgtggccaggctgaagtaagagccaaagcaggccaagcccgagtaaagcaggagtctgtcggcgttttcgcctgtaaaaataaatggcagcccgatgacgtgaccgagtcattgccccctaaaaaaatgaaatgcgggaaagaaaaggactctgaagagcagcaacttcagcctcaggccaaggctgtcgtcagaagttcccaccgaccaaagtgcaggaagctgccttccgatccacaggaatccactaaaaagtctccgcgaggagcctctgattctgggaaagaacacaatggcgtacgtgggaagcataagcatcgaaaacccaccaagccagagtcacagtcgcctgggaaaagggccgatagccatgaggagggttccttagagaagaaagccaagtcgtcatttagggacttcatccccgtcgtacttagcacacggactaggtctcagagcggcagtatctgcagtagcttcgcagggatggccgattcagacatgggcagccaggaggttttccccaccgaagaggaagaagaggtcacgccaacgcccgcaaagaggagaaaggttcgcaaaacgcagagggacacccagtataggtcgcatcacgcacaagataaatcgcttctatcccaggggaggcgacacttgtggagagcccgtgaaatgccgtggaggactgaggcagctagacagatgtgggacacaaatgaggaggaagaggaggaggaggaggagggcctgctgaagagaaagaagagacggagacaaaagtctcgcaaataccagaccggagagtatctaacggagcaggaggatgaacagcggaggaaaggtcgggcagacttgaaggcaagaaagcagaagacatccagctcccagtcactggaacatcgcctgcggaatagaaacctgcttttgcccaacaaagtgcaaggtattagcgacagccccaacggattcctccctaataacctggaggaaccagcttgcctggagaactccgaaaaaccaagtggcaaacgcaaatgcaaaacaaagcacatggcaacagtcagcgaggaggcaaaggatgtggtgctttattgcctccagaaagatagcgaggatgtcaatcatagagataatgctggctataccgcgctgcacgaagcctgcagcaggggctggacagacattttaaacatacttctggaacacggtgccaatgttaattgttccgcccaggacggtacacgaccggtgcacgacgccgttgtcaacgacaacctggagacaatttggctcttgctgtcctatggggcagaccccaccctggctacctatagcggtcaaaccgcaatgaagctcgcctcatctgatactatgaagagatttctcagcgatcacctctcagatctccagggaagggccgaaggcgaccctggagtttcttgggacttctacagttccagtgtgctagaagaaaaagatggcttcgcttgtgacctactccacaatccacctgggtcttccgatcaggaaggagatgacccaatggaggaggatgacttcatgtttgagttgtccgacaaacccctgttgccctgttataatctgcaggtaagcgtgagtcgcggaccttgcaattggttcctgttctccgacgtgcttaaaaggctaaaattgtcctcacgaatattccaagccaggttcccacatttcgaaattactacaatgcccaaggccgaattttaccgacaagtagcctcctctcagctgctgacaccagcagaacgtcctggaggactggatgatagatcacctccaggaagcagcgagaccgtggagttggtgcgatatgagcctgatctgcttcgcttactcggttctgaggtggaattccagtcatgcaactcataa

SEQ ID NO: 61266 - DNA, 2511 bp, Artificial Sequence
  Description of Artificial Sequence: Synthetic coding sequence
atgacagcaaccgccgaagtagaaacacccaagatggagaaaagcgcctccaaggaggaaaagcagcagcccaaacaggacagcacagagcaagggaatgcggactctgaagaatggatgtcatcagaatccgatccggaacagatctccctgaaaagctctgacaactcgaagtcctgccagcccagagacggccagctaaagaagaaagaaatgcactccaagccccaccgacagctgtgtagaagtccctgcctcgatcgcccatccttctctcagtctagtattctccaagatggtaaactcgacctggagaaagagtatcaagcgaagatggagttcgcactgaaactcgggtacgccgaagagcagatccagtccgtgctgaataagctggggccagaatcactgattaacgacgtgttggccgaactggtacggctaggtaataaaggggatagcgagggacagattaatttatccctgctcgtgccgaggggcccatccagtagggaaatagcctccccggaactctctttggaggatgagattgataattccgataatctgcggcctgtggtcattgacggcagtaacgtggcaatgagccatgggaataaggaagagttcagttgccggggaatccagttggcagtggattggttcctggataagggtcacaaggacataacggtcttcgtcccagcctggagaaaagagcagagtcggcctgacgcgcctatcacagaccaggatatcctacggaaactggaaaaagagaaaatcctggtgttcacaccgagcagaagagtgcaaggtagaagagtggtctgctatgacgacagatttattgtgaagctggcattcgacagtgacggcattatagtttctaacgacaattaccgggacctccaggtggagaagccggagtggaaaaagtttattgaggaacgtctgctcatgtattcctttgtgaacgataaatttatgccaccagacgatcccctgggccgtcatggcccaagcctagagaacttcctcaggaagcgccctatcgtgcctgagcataaaaaacaaccttgcccctacggcaaaaagtgcacgtatggccataagtgcaaatactaccaccccgaacgggctaatcaaccccaacgctctgttgccgatgagctgagaatatcagcaaaactaagcacagttaaaactatgtccgaaggcacacttgcaaagtgcggcacaggaatgagctccgctaagggcgagatcacttccgaagtgaaacgtgttgccccaaagcgacaaagcgatccaagcatcagatctgtggccatggagcccgaagagtggctctcaattgcgaggaaaccagaggcgtcttcagtaccgagcctggtgaccgctctctccgtgccgaccatcccacctccgaagagccacgctgtcggagcattaaataccagatctgcttcgagcccagtgcctggcagttcacacttccctcatcaaaaggcaagcctggaacacatggcatcgatgcaatatcccccaattctggtcactaatagccatggcactcccatttcttatgcagagcagtaccccaaatttgaatccatgggagaccacggctactattctatgctgggggacttttcaaaactgaatataaactccatgcacaatcgagagtattacatggccgaagtggatcggggagtgtatgccagaaaccctaacctgtgcagcgattctcgggtctctcatactcgcaacgacaactactcctcttataacaacgtctacctggcggtcgcagacactcaccccgaaggcaaccttaagctccacaggagtgcttcccagaataggctgcagcctttcccccatggctaccacgaagccctgaccagggtgcagtcatatggaccggaggactccaaacagggccctcataagcagagtgtgccccacctcgccctccacgcacaacacccatctacaggtactcgctcttcatgccccgcagattacccaatgccaccgaacatccacccgggagcaactcctcagcctggtcgtgcactggtaatgacccggatggactctatatcagatagtagactgtacgagtcaaaccctgttagacagagaaggcccccactgtgtagagaacagcacgccagctgggacccattgccatgcactaccgatagctatggctatcactcatatccgctgagcaacagtttgatgcagccatgctacgagcccgtcatggtgaggtccgttcccgagaaaatggagcagctctggcgcaacccctgggtcggtatgtgcaacgattctcgcgaacacatgattcccgaacaccaataccagacttataagaacctctgcaatattttcccaagcaatatagtcctggctgtgatggaaaagaatccccacactgcggacgcacaacagctggcagcacttattgtggccaagctgcgggctgctaggtag

SEQ ID NO: 61267 - DNA, 2478 bp, Artificial Sequence
  Description of Artificial Sequence: Synthetic coding sequence
atggagaagagcgcgagcaaggaagaaaagcagcagcctaagcaggattctaccgagcagggcaacgccgactcagaagaatggatgtcaagcgaatccgaccctgaacagatttccctcaaaagcagtgacaactccaagtcctgccagcccagagatggccagctgaaaaagaaagaaatgcacagcaaaccacatcgccagctctgtaggagcccatgcttagaccgacccagtttctcgcagtcctccatcctgcaggacggtaagttggacctcgaaaaggaatatcaggcaaaaatggaatttgccttgaagctaggctacgcggaggaacaaatccagtctgtactcaacaaactagggcctgagtcactgatcaatgatgtcctcgccgagctggtacgcctcggtaacaagggcgatagcgaaggacagatcaacctgtccctccttgtgccacggggtccctcttcgcgagagatagcctccccagaactgtcattggaagacgagatcgataacagcgataacctgaggcccgtggtaattgatggaagtaacgtagccatgagtcacggcaataaagaggagtttagttgccgcggaatccagctggccgtagactggttcctggataagggccataaggacattacagtgttcgtgccagcctggcggaaggaacagtcccgacctgacgctccaattaccgaccaggatattttgagaaagttggaaaaggaaaagatcctggtgttcacgccaagcaggcgcgtacagggccgaagggtcgtttgttatgatgaccgctttatcgttaagctggctttcgattctgacggtatcatcgtttcaaacgacaactaccgcgatctgcaggtggaaaagccggaatggaaaaagtttattgaagaacgccttttaatgtattcttttgtgaacgacaaattcatgccgccagatgatcctttggggaggcatggccctagcctggaaaatttcctgcgtaagcgacccatcgtgcccgagcacaagaagcagccttgcccctacgggaagaaatgtacatacggtcataagtgcaaatactaccaccccgaaagagccaatcaacctcagcgctcggttgctgacgaactccgaattagcgccaagttatccaccgtgaagaccatgtccgaggggacgctggccaaatgcggcaccggcatgtccagcgcgaaaggagagatcacgtcagaggtaaagagggtagccccaaagcgccaaagcgaccctagcatccggtctgtcgccatggagccggaggagtggctttccatcgcgaggaagcccgaagcgagcagcgtgccttcgctggtgacagctctctctgtccccaccataccaccaccgaaatcacacgcggttggagctctgaatacaagaagtgcaagcagtccagtgccaggatcttctcattttcctcatcagaaggcgtcgctggaacacatggcttccatgcaatatcctccaatcctcgtgaccaatagccatggcactccaatttcctacgcggagcagtatccaaaattcgaatcaatgggggatcacggctattacagcatgctaggagacttcagtaaactgaatatcaacagcatgcataatagggaatactatatggccgaggtggatcggggagtgtacgccaggaatcctaacctgtgctccgactcccgcgtatcacatacacggaatgataactactcatcctataataacgtctatttggcagtggccgacactcaccctgaagggaacctgaagctgcacaggagcgcctcccaaaaccgactacagccattcccccatgggtatcatgaggcccttacccgggtccaatcttatggtcctgaggactctaaacagggccctcacaagcaatcagttccccatctcgcattgcacgcccagcatccctccaccggcacgcgatcatcttgtcctgcagactaccccatgccccctaacatacaccccggagctactcctcaaccagggcgagcgctggtaatgacccgaatggattctatcagcgactcacgcctgtacgagtccaaccccgtgcggcagcgtcgcccaccactgtgccgcgagcaacatgcctcttgggatcctctgccttgcactaccgatagctacgggtaccattcgtatcctttgtctaacagtttaatgcagccttgttacgagcctgtcatggtgagatcggtgcccgagaagatggaacagctgtggagaaacccctgggtcggaatgtgtaacgatagccgcgaacacatgattcccgagcaccagtaccagacctataaaaatctttgcaacatatttcctagtaacatcgttctcgctgtgatggaaaagaatccacatacagccgacgctcagcaactggccgctctcatcgttgccaagctgcgcgctgctagatag

SEQ ID NO: 61268 - DNA, 2652 bp, Artificial Sequence
  Description of Artificial Sequence: Synthetic coding sequence
atgccaggaggtgggagccaggagtacggcgtgttgtgtatccaagaatacaggaagaactccaaggtggaaagttctacacgaaacaacttcatggggctgaaagaccacctcggccatgacctgggacacttgtatgtcgagtcgactgacccacagctgagcccggcagttccttggtcaacagttgagaaccccagcatggatactgtgaacgtgggaaaggatgagaaggaggcatcagaggagaacgcctcctcaggcgattccgaggaaaataccaacagcgaccatgagagcgaacagctcgggagcatttctgtggaacctggtctcatcaccaagacccatcgccagctgtgccggtctccttgcctggagccacacatcctgaaacgaaatgaaatcctccaggacttcaagccagaggagagccagactacctcaaaggaggccaagaagcccccagacgtcgtccgcgagtatcagacaaagcttgaatttgcgctaaagctggggtattccgaggaacaagtgcaacttgtgctgaacaaactgggcactgatgcattgatcaacgatatcctcggtgagctcgttaagctcgggaataagagtgaagctgaccagaccgtgtctactatcaatacgatcacccgggaaaccagctcactagagtcccaaaggtcggaaagccctatgcaggagatcgtaaccgatgacggggaaaatttgaggcctatcgtcatagatggcagcaatgtggcgatgagccacgggaataaggaggtgttttcctgtcgcggaattaagctagccgttgactggtttctggaacggggacataaggacattaccgtgtttgtccccgcatggagaaaggagcagtcccgtcctgacgccctgatcaccgaccaggaaatcctgaggaagctggagaaagagaaaatcttggttttcaccccatccaggcgggtgcagggcaggcgtgtagtgtgctatgatgataggtttattgtcaaactggcattcgagagtgatggcattattgtttcgaacgataactacagagacctggccaatgaaaagcctgaatggaagaagttcatcgacgaacgccttctgatgtacagcttcgtgaacgataagttcatgcccccagatgaccctcttggtagacatggtccgtccctcgacaactttttgagaaagaaacctatcgtgcccgagcacaaaaaacagccatgtccctatggcaagaaatgcacatatgggcataagtgcaagtattaccaccctgaacgtggaagccaacctcaacgtagcgtcgcggatgaattacgggctatgtctaggaacacagcggctaagactgcaaatgaaggagggctggtgaaaagcaacagcgttccttgcagcactaaggccgattctacgagtgatgtgaagcgcggagctcccaaacgccagagtgacccttcaatacgcacccaggtctaccaggacctcgaagaaaaactgccaacaaagaacaagctcgagacccggagcgtcccttccctggtatccattccagccactagcacagctaagccccagagtaccaccagcttgagcaacgggctgccctccggggtgcactttccaccccaggaccagaggccgcagggtcagtacccctcaatgatgatggcaacaaagaaccacgggaccccaatgccttacgaacagtacccaaaatgtgatagtcccgtcgatattggctactattctatgctcaacgcctactctaacctgtccttatcaggccctaggtcccctgaacgtaggttctccctggatacagactaccgaataagctctgttgcatcagactgctcctccgaagggtccatgagttgtggctcctctgacagttatgtgggctacaatgataggagctatgtgagcagccccgatccccaattggaggagaatctgaagtgtcagcacatgcatccgcacagccggctcaacccgcagccatttctgcaaaacttccacgatcctctgacccggggtcagtcttactcccacgaagagcctaaatttcatcacaaaccccctctgccccatttagccctacacctgccgcacagcgctgtgggagccagatccagttgcccaggagattatccgagccctccctcatcagctcactcaaaggccccacatctgggcaggtccctggtagctaccaggattgacagcattagtgatagcagattatacgattcaagccccagcaggcaaagaaagccttactctcgacaggaagggctgggcagctgggaaaggccagggtacggcatcgacgcttatggatacaggcagacgtacagcctgccagacaactctacgcagccttgctatgaacagtttacatttcagagcctgcccgagcaacaggaaccagcatggcggatcccttattgcggaatgccacaggacccgcctagataccaagacaatagggagaagatctatattaacctgtgcaatatcttccctccagacctcgtccgtatcgtcatgaaaaggaaccctcacatgaccgatgcacagcagttagctgccgctatcttagtcgagaaaagtcaattaggttattag

SEQ ID NO: 61269 - DNA, 5007 bp, Artificial Sequence
  Description of Artificial Sequence: Synthetic coding sequence
atgagtaaaattcggagaaaagtgacagttgagaacaccaaaaccatatcagactccacctcccgcaggccgtcagtgttcgaacggttgggtcctagcactggatccaccgcagagactcagtgtcggaactggctgaagacggggaattgtctctatggaaatacttgcagatttgtgcacggcccatctcctcgaggcaagggttattccagtaattacagaagaagtcctgaaagacccacaggtgatctcagagagaggatgaagaacaaaagacaggacgtcgatacggagcctcagaaaaggaacaccgaggaatcgagctcacccgttcgaaaagaaagctctcggggaaggcaccgcgaaaaggaagatatcaaaattacaaaggaaagaacccctgagtcagaagaggaaaatgtcgaatgggaaaccaaccgggacgattctgacaatggagatattaactatgattatgtccatgaattgtccctggagatgaagaggcagaaaatacagcgcgaactcatgaagttggaacaggaaaacatggaaaaacgcgaggagataataatcaaaaaggaagtgtctcctgaggtcgttcggtccaagttgtctccatcgccctctttgcgtaagagttctaagagtccaaaaagaaagtcctcccctaagtcttccagcgccagcaaaaaggaccggaagacatctgctgtgagtagtcccttgctggatcagcaacgaaactccaagaccaaccaatctaagaagaaaggccctcggaccccctctccacctccgcctatccccgaggacatcgcgttaggaaagaagtataaggaaaaatacaaggtcaaagacagaatcgaggaaaagacccgggacggcaaggatcgcggtagagacttcgagaggcaaagagagaaacgggataagccacggagtacctcccctgcgggacagcatcactccccaatctccagtcgccaccactcaagtagctcacagtccggttcaagcatccagcgacatagcccctcgcctagacgcaaacgcaccccctccccgtcgtaccagcgaacccttacgcctcctttacgacgctccgcttccccttatccatcacactctctgagttcacctcagcgtaagcagtcaccaccccgacaccgctccccaatgagagaaaaaggacgacacgaccacgagcgcacttcccagtcacacgacagaaggcacgagcggagagaggacacaagggggaagcgggaccgcgagaaggactctagagaggagagggaatacgaacaggatcagtcatcaagcagagatcacagagacgatagagaacctagggacgggagagaccgtagagacgcaagggacacacgcgaccgaagggagttacgtgactctagggacatgcgggactcgagggagatgagggattattctcgggacacaaaagagagtagagaccccagggactcacggagcactcgcgatgcccacgactacagagatcgggagggaagggacactcacagaaaggaagacacttacccagaggagtcacgatcatatggccgaaatcatttgagagaagagagttcaaggactgagattcgcaacgagtctcgcaacgaatcacggtccgagattcggaatgatcggatgggacgcagccgaggccgtgtgccagaactgccagagaaggggtctcgaggatccagaggttctcagatcgatagtcattcaagcaacagtaactatcacgactcatgggagacccgttcttcctacccggagagggatcgctacccagaaagagacaatagggatcaggctcgcgactccagctttgagcggagacatggcgagcgggatcggagggacaaccgagagcgagaccagagaccttcatccccgatccggcaccagggccgaaatgacgagttagaaagagatgagagaagggaagaacgtagagtggaccgcgtggacgatcgtcgcgacgagcgtgcacgggagagagatagagagcgcgaacgcgaccgcgaaagagagcgagagagggagcgcgaacgggaccgtgagcgggaaaaggagcgcgagcttgagcgggaaagagcacgtgaaagggagcgcgaacgtgaaaaagagagggatagagagagagatcgcgatcgcgatcacgaccgcgagcgggaacgtgagcgggaacgcgaccgggagaaggagcgcgaacgtgaaagggaggaacgagagcgggaacgggaaagagaacgggagcgggagagggagcgagagcgcgagcgggagcgggcacgggaacgagacaaggaaagagaacgacagagagattgggaggacaaggacaagggaagggacgatcgcagggaaaagcgggaggagatccgtgaagataggaacccgcgagatggccacgacgaaagaaaatccaagaaacgctaccgtaatgaaggaagcccttcgcctaggcagtcgcctaaacggaggcgagagcatagtcccgattctgatgcctataatagcggcgacgacaaaaacgaaaagcatcgcttactctcccaagtcgtcaggcctcaagagagcaggtctttgtccccaagtcatcttaccgaggatagacagggaagatggaaggaggaagatagaaagcccgaaaggaaggaatccagtcgcagatatgaagagcaggagctcaaggagaaagtgtcttctgtggataaacagagagagcagacagagattcttgaaagctccagaatgagggcccaggatatcataggccaccatcagtccgaggaccgggagacaagcgatcgcgctcatgacgaaaacaagaaaaaggctaagattcagaagaagcctattaagaaaaaaaaggaggatgatgttggcattgaaaggggaaatattgaaacaacttcggaggacggacaggtctttagcccaaaaaaagggcagaaaaagaagagtatagagaagaagcggaagaaaagtaaaggagattccgatatttccgatgaagaagccgcacaacaaagtaaaaagaagaggggaccaaggacgccacccatcaccacaaaggaggagctggtggaaatgtgtaatgggaaaaatggcattttggaagattcacaaaagaaggaggacactgctttttctgattggtcggacgaagatgttcctgataggactgaggtgacagaggctgagcataccgccactgccactacaccaggcagcacgcctagtccattgtcttcactactacccccaccgccacctgtggccactgcaaccgctacaaccgtgcctgctaccctggccgcaactaccgcggctgcagccacctcgttttctacctcggcaatcacaatttcaacctccgccactcctacaaatactactaacaatacatttgcaaacgaggactcccacagaaagtgtcatcggaccagagtggaaaaagtggaaacaccacacgtgacgattgaggatgcccagcacaggaagcctatggaccaaaaacgctcttcaagtctaggttccaacagatccaatagaagccatacgtctggcaggctcaggtcccctagcaatgactctgcccaccgttcaggggatgatcagtctggaagaaagagggtccttcactccgggtctagggatagagaaaaaaccaaatctttagagatcacaggcgagcgtaagagccggatcgaccagctgaaacggggagaacccagtcgaagtacctcaagcgaccgacaggatagcagaagtcattcatctcggcgatcttctccagaatcagaccgacaggtgcactcccgctccggctccttcgattctcgggatagactgcaggagcgggatcgatacgaacatgaccgcgagagagaacgcgagaggcgtgacaccaggcaacgtgaatgggatagagatgcagacaaagattggccacgaaacagagaccgcgacagacttcgggagcgggaacgagagagagagcgtgacaagcggagagatctcgatcgtgagagagagagactcatcagcgattccgtcgagagagacagggatcgcgacagggatcggacatttgagtcatcccagatcgaaagtgtcaaaagatgtgaagctaagttggaaggtgagcatgagcgggacttggagagcaccagcagagattctctggctcttgacaaggagagaatggacaaagacttggggtctgttcagggatttgaagaaaccaataagagtgagagaacggaaagcttggagggcgatgatgaaagtaagttggacgatgcccattcgctgggaagcggcgctggagagggttacgaacccatctccgacgatgaactagacgaaatcctggcaggcgacgctgagaaacgcgaggaccagcaagatgaagagaaaatgcctgaccctctcgatgtcattgacgtggactggtccggactgatgcctaagcatccaaaggagcccagagagcctggcgcagcgctcctgaagttcacccccggagcagtgatgcttcgggtcgggataagtaaaaagctcgccggatctgagctgttcgccaaagttaaagagacatgtcagcgcctactggaaaagcccaaagatgctgacaacctcttcgagcacgaactcggagcattgaacatggccgcactgttacggaaagaagagcgagcgagcttactctcaaaccttggcccttgctgtaaagctctctgttttcgtcgggactctgccatccgcaagcagctggtgaaaaatgaaaaggggacgattaagcaggcctatacctccgcccctatggtggacaatgagctcctcaggctctctctgagactctttaagaggaagactacctgtcatgctcctggacatgagaagacagaggacaacaagctgagccagagctccatacaacaggaactgtgcgtgtcgtat

SEQ ID NO: 61270 - DNA, 4695 bp, Artificial Sequence
  Description of Artificial Sequence: Synthetic coding sequence
atgtctaaaatccggcgaaaagtgacagttgaaaataccaaaaccatttctgatagcacatctaggagaccttcagtattcgaacgactcggcccaagcacaggctctacagccgagacacagtgccgaaactggctgaaaacgggcaattgcctttatggtaacacgtgccggttcgtgcacggtccctccccccgaggcaaggggtattcatcaaactatcgcaggtcacctgagcgaccaaccggagatctgagagaaagaatgaagaataagcggcaggatgtggacactgagccgcagaagaggaacaccgaagaaagctcatcaccggttcgaaaagagagctcgagagggaggcacagagagaaagaagacatcaaaattaccaaagagcgaacacctgaaagcgaagaagaaaacgtggagtgggagaccaaccgtgatgacagcgataacggcgacattaactacgactatgtgcacgaactatctctcgagatgaagcgccagaaaatacaacgtgagctgatgaagctggagcaggagaacatggaaaaaagggaggagataataatcaaaaaagaggtgagcccagaggtggtcaggtccaagctgagcccctcaccatccctgcggaaatcctccaaatcacccaagcgaaagtcctccccaaagagctcctccgcctcaaagaaagatagaaagacaagcgccgtcagctcacctttactggatcagcagagaaatagcaagacaaaccaaagcaagaagaaaggcccaaggacacctagtccacctcctccaattccagaggatatcgcacttgggaagaaatacaaagagaaatacaaggtcaaggatcgtattgaggagaagaccagggatggcaaggataggggccgagatttcgagcgacagagggagaaacgggacaagccaagatctacctctcctgcaggccaacaccattccccaatcagcagcagacaccactcaagctcttcccagagtggttcatctatacagcgccacagcccctccccacggagaaagcgcacacctagcccatcctaccagaggaccctgacccccccattaaggcgaagcgccagcccctacccgagccactcactcagttctccgcagaggaaacagagccctcccaggcatcgaagccccatgcgagagaagggaagacacgatcacgagcgcacctcccaaagccacgacagaagacacgaacgcagagaggacacaagggggaaaagagacagggaaaaagattcgagagaggaacgggaatatgagcaagatcagagtagctctcgggatcatagggacgatcgagaacctcgcgacggaagggatcggcgtgatgccagagatacccgggatcgccgagaactccgcgacagtcgggacatgcgagactctcgtgagatgcgtgattacagtcgggacacgaaggagagcagggatcccagggactccaggagtacgcgcgatgctcacgactaccgggacagagaaggcagagacacgcaccgaaaagaagatacatacccagaagaatcgcggtcttacggcaggaaccatctgcgagaggagagctccagaaccgaaattaggaacgagagcagaaacgagagtaggagtgaaattaggaatgatcggatgggcagaagccgtggcagagttccagagctgccagaaaagggaagtcgcggtagccgagggtctcaaattgactcccactccagcaatagcaactaccacgatagctgggagactcgctcctcctaccccgagagggataggtatcctgagcgagacaacagagaccaggcaagagattcatcgtttgaacgcaggcacggagaacgagatcgtcgtgacaaccgggagcgcgatcaacgcccaagcagccccatcagacaccagggtcgtaacgacgaacttgaacgggatgagagaagggaagaacgccgagtggatcgcgtggacgataggagggatgagcgagcccgtgaaagagacagagagagagagagagacagagaacgtgagcgggaaagagagcgggaacgagaccgcgagcgtgagaaggaaagagaactagagagagagagggctcgagagagggaacgggagagagagaaggaaagagaccgcgaacgggacagagaccgagaccacgacagagaacgcgagagagagagggagcgcgatcgagagaaggaacgggagcgggagagggaagagcgggagcgcgagcgggagagggagcgagaacgtgaacgcgaaagagagcgcgagcgcgaacgcgctagggaacgcgataaggagcgggagcgccaacgcgattgggaggataaagataagggtcgcgacgaccgaagagagaagagggaggaaattagggaagaccgcaacccacgcgacgggcatgacgagaggaagtccaaaaaaaggtaccgtaatgagggttccccctccccaagacagtcgcccaaaaggcgacgcgagcacagtcctgactctgatgcgtacaactcaggcgacgacaagaacgaaaagcaccgcctgctcagccaagtcgtaagaccacaggaatcacgctccctttcccccagtcacttaacagaggacaggcaaggtagatggaaggaggaagatcggaaacccgaacgtaaggaatcatctaggagatatgaggagcaggagctaaaggagaaggtaagttctgtagataaacagcgcgaacagacagagatcctcgagagctctagaatgcgggcacaggacatcattggccaccaccaaagcgaggacagagaaacatctgaccgcgcacatgacgaaaacaagaagaaggccaagattcagaaaaaacccataaaaaagaagaaagaagatgatgtaggaattgagcgaggcaatatcgagactacttctgaggatggccaggtgttttcacctaagaaaggtcaaaagaaaaaatctatcgagaagaaaagaaagaaatccaaaggggacagtgatatctccgacgaagaagccgcacagcaatcaaagaaaaagagaggtccaagaacgccaccaatcaccactaaagaggaacttgtggagatgtgtaacggcaagaatggaatcctggaggattcccagaaaaaagaagataccgcattcagtgattggtccgacgaagacgtccccgacaggactgaagtgacagaggcagagcataccgccaccgccactacccctggtagtactccttcacccttgagctctcttcttccaccacctccgccagttgctactgcaaccgccacaaccgtccccgctactttggcagccaccacagcagccgctgctacaagtttcagcacttccgccattaccatctcaacaagtgccacaccgacaaacacaacaaataacacctttgccaacgaggactctcaccgaaagtgtcacagaacccgcgtggaaaaagtggagaccccccatgtcaccattgaggacgcccagcatagaaaaccaatggaccagaaaagatcatctagcctcggttccaatagatccaaccgatcccacaccagcgggcgactcaggagcccatccaatgactccgctcaccgcagtggcgacgatcaaagcggaaggaagcgcgtgctgcattccggttcccgggatcgggagaagacaaagtccttagaaataacaggagaacgcaagtcccgcatcgaccaactgaaaagaggtgagccgagccggtctacatcgtccgaccgacaggactcccgctcccactcctctcgcaggtcttccccagaatctgatcgccaggtacactctagatctggaagtttcgactctcgagataggctgcaggaacgggacaggtacgagcacgaccgagagcgcgagcgggaaagacgggacacacggcagcgcgaatgggatagggacgctgataaagattggccgagaaaccgcgatcgagatcgtctgagggagcgagaaagagagagggaacgcgataagcgcagggacctggacagggaaagagagcgtctgatctcagactctgtggaaagagatagggatcgtgacagagataggaccttcgaatcctctcagatcgagtccgtgaagagatgcgaagccaagctggagggcgaacacgaaagggatttagaaagcactagtcgggactcattggccctcgataaggagcggatggataaggatctcggttcagtccagggcttcgaagaaacaaataagagcgagcggactgaaagtttggaagccggtgatgatgaatcaaagctggacgacgcccacagcttggggagcggtgctggggaaggctacgagccgatctctgatgatgagctggatgaaattcttgccggtgacgcagaaaagagagaggaccagcaggatgaggagaaaatgcccgatccactggacgtgatagatgtcgattggagcggtctgatgcccaaacacccaaaagagcccagggagccaggcgctgctctgctgaagtttaccccaggagccgttatgctgcgtgtgggcatcagcaagaagctcgcgggtagcgagctcttcgcaaaagtgaaggagacctgtcagcgtttactcgagaagcctaagggatccttcatcctcctctag

SEQ ID NO: 61271 - DNA, 1875 bp, Artificial Sequence
  Description of Artificial Sequence: Synthetic coding sequence
atgtgcaacggaaagaacgggattctggaggatagccagaagaaagaggataccgccttttctgactggtccgacgaggatgtccccgaccgcactgaggtcaccgaggctgaacatactgcaacggccactacccctggttctacccccagccccttgtcgtcactcctcccccctccaccgcctgtggcaacagctacggctacaacggtgcccgctaccttagctgctaccaccgccgctgccgctacctcttttagtacctccgccataaccatttcaacaagtgccacgccaaccaataccaccaacaacacatttgcaaacgaggatagtcatcgcaaatgccacaggacaagagtggagaaagttgagacaccacacgttaccatcgaggatgcccagcacaggaaaccaatggaccagaaacgtagctcctcactgggttcaaaccggagcaatcggagccataccagcgggcgattgagatcaccatccaacgattctgcccatcgctctggggatgaccagtctggtagaaagagggtgctccactctggatcaagggaccgggaaaaaaccaagtcactggaaatcacgggggagagaaagagccgaatcgatcagctgaagagaggcgaaccgtcaaggagcacctcctccgaccgacaggattcccgttcacactccagccgtcggtcctcacccgaatctgaccgccaggtgcacagccggtccggttctttcgattctagagacagactgcaggaacgcgataggtacgaacatgaccgcgaacgcgaacgtgaaagacgggatactcgtcaaagggagtgggatagagacgccgacaaagactggccacgtaatcgggaccgagaccggctgcgcgagcgggagagagagagagaacgcgataaaagaagggatttggacagggaaagagagagactcatctccgatagcgtcgagcgggaccgcgaccgcgatcgtgacaggacattcgaatccagccaaattgaaagcgtgaagcgctgcgaggcgaagctcgaaggcgagcacgaaagggacctcgagagtacgagccgtgactcactggccttggacaaggagcggatggataaagacctgggaagcgtccagggctttgaggaaacaaacaagagtgaacgcacggaaagtctggaaggtgatgacgagtccaaacttgacgacgcacacagtctcggatctggtgccggtgaaggatacgagcccatttcagacgatgaactcgatgagatcctcgccggagacgcagagaaaagggaagaccagcaagacgaggagaaaatgccagatccactggacgtcatcgacgttgattggagcggactcatgcctaagcatcctaaagagcctagggaaccaggcgctgccctgctgaaatttacccctggggcagtgatgctccgagtaggcatttccaaaaagctcgcaggtagcgagttattcgctaaggtcaaagagacctgccagcggctgctggagaagccgaaagacgctgacaacttatttgaacatgagttaggtgccctgaacatggccgcactgcttcgtaaagaggaacgcgcttctctgctttcaaatcttgggccatgctgtaaggcattatgcttccgccgtgattcagccatcagaaaacaattagtcaagaatgaaaagggaactattaagcaggcttatacatccgccccaatggttgataacgaactcctccgcttgtcactccgcctttttaagaggaagactacctgccatgcaccgggtcacgagaagactgaggataataaactgagccagtcctcgatacagcaggaactgtgcgtgtcctag

SEQ ID NO: 61272 - DNA, 348 bp, Artificial Sequence
  Description of Artificial Sequence: Synthetic coding sequence
atgtccaagattaggagaaaagtgactgtggaaaacacaaagaccataagcgattcaaccagtcgcagaccttctgtgttcgaaaggctcggacccagcaccggttctacagccgaaacccagtgcaggaactggctgaagaccggaaactgcctgtacgggaatacttgtcgattcgtgcacgggccatcacctaggggaaagggctacagttcaaactaccgacgcagccctgaacgtcccactggagacctccgagagcggatgaagaacaaaagacaagacgtcgatacggagccacaaaagagaaacactgaggagagctccagcccagtgcgagtggggtag

SEQ ID NO: 61273 - DNA, 1455 bp, Artificial Sequence
  Description of Artificial Sequence: Synthetic coding sequence
atggagaaaagagaggaaattatcattaagaaggaagtgagtcccgaagtggtccggtccaaactatcgccctccccctccttaagaaaaagttccaagtctcctaagaggaagtctagtccaaagtcttccagcgcttccaagaaagatcggaaaacgagcgcggtcagttctcccctgctggaccaacagaggaactccaagaccaaccagagcaaaaagaaggggcctaggactccttcacctccccctcccatacctgaagacattgccctgggcaaaaaatacaaggaaaaatacaaggtgaaagaccggattgaggagaagactcgcgatggtaaggacagaggcagggattttgaacggcagcgggagaagcgcgataagcccagaagcacctccccagctggacagcaccactcacccatctcttccaggcaccatagtagcagctcccagagtggtagctctatccagcgtcattcaccctctcctaggcgcaaacggactcctagtccttcataccaacgcacccttactccgccactaagaaggagcgcctcaccatatccttctcactccctgtcttcaccgcagagaaaacagtcaccacccaggcaccgtagtccaatgcgggagaaaggaagacacgatcacgagcgaacttctcagagtcacgacaggcgccacgaaagacgggaagatactcgaggtaaacgagatagggagaaagattctagagaggaacgtgagtacgagcaggatcagagctccagtcgcgatcatagagacgaccgagaaccccgagacggtcgcgaccgcagagacgccagggatactagagaccggagggaattgagagattccagggacatgcgggactcaagagagatgcgagactactctagggacactaaagagtctcgggacccgagggactcacgatctaccagggacgctcacgattatcgggaccgggagggtcgggacacacaccggaaagaggacacgtatcctgaggaatccagaagctacggacgaaatcacttgagagaagagagctcccgcaccgagattaggaacgaaagtcggaatgaatcgcgcagtgagattaggaacgacaggatgggtcggtcccgcggtagggtgcctgagctgccggagaaaggcagccggggatctcgaggatcccagattgactcccactcttctaattctaattaccatgacagctgggagacgaggagcagctatcccgagagagatcgataccccgaaagggacaatcgggaccaggctcgggactcttcttttgagcgcagacatggggagcgcgatcggagagataatagggaacgagatcaacggcctagcagtcccatacggcatcagggccgtaatgacgagctcgaacgcgatgagcggagagaggagcgccgtaaggaaaaaaagtag

SEQ ID NO: 61274 - DNA, 3912 bp, Artificial Sequence
  Description of Artificial Sequence: Synthetic coding sequence
atggaggctgcccctgggacaccacctccccctcctagcgagtctccccctccacctagtcccccacctcctagcaccccaagcccacccccatgctcccctgatgcccgtccggctaccccccatctcctccatcacagactgcccctgcccgacgaccgcgaggacggcgagttggaagagggagaactggaggacgatggggctgaagagacccaggataccagcggaggccctgagaggagccgcaaagagaagggtgaaaagcaccacagtgacagtgacgaggagaagtcacaccggcgattaaaaaggaaacgtaagaaagagcgcgaaaaggagaagagacgtagcaagaagcggaggaaaagcaagcacaaaaggcacgcttcaagcagtgacgatttttcggacttttctgatgactctgacttctctccatcggagaaagggcaccgcaagtaccgggagtattcaccaccctatgcacctagccaccaacagtatccaccatcccacgcaacaccactgcccaaaaaggcctactcaaagatggactcaaagtcttacggtatgtacgaggattatgagaacgagcagtacggggaatacgagggggatgaagaagaggatatgggaaaggaagattatgatgatttcacaaaggagctcaatcagtaccggagggcgaaagagggatccagccgcggtagggggagccgaggccgaggccgaggctatcggggtaggggatcacgaggtgggagcagaggcagaggcatgggtaggggaagccgcggtagaggaagggggagtatgggaggcgaccacccggaggatgaagaggatttttacgaagaagagatggactatggcgagagcgaggagccaatgggcgacgatgattacgatgaatatagcaaagaactgaatcagtatcgccgaagcaaagatagtcgaggccgaggactgtcaagggggcgtggacgcggatcacgtggcagagggaaagggatggggaggggaaggggcagaggtggatctcggggaggcatgaacaagggaggcatgaacgacgatgaagatttttacgatgaggacatgggcgatgggggaggaggctcctacagatcccgagaccacgataagccgcaccagcagagtgataaaaaagggaaagtgatctgtaaatacttcgtggaggggaggtgtacttggggagatcattgtaacttttcccacgatatcgagctgcctaagaagcgggagctgtgtaagttctacataaccggtttctgcgccagagctgaaaattgcccttacatgcacggtgatttcccatgcaagttgtatcatacgactggtaactgtatcaacggtgacgactgcatgtttagtcatgatcccctgaccgaagaaacccgggagctgctggacaagatgctcgctgatgacgcagaagcaggagcagaggatgaaaaggaggttgaggaactgaagaagcagggtatcaatccgctgccgaaacccccaccgggagtagggttgcttccaacacctccccgacccccaggcccacaggccccaacttccccaaatgggagacccatgcagggcggtcctcctcccccacctccgccaccaccgccacctcctggccctccacagatgcctatgcctgttcacgaacccctctcccctcagcagttacagcagcaggacatgtacaacaagaagatccctagtctatttgaaatcgtggttcgtcccacagggcagctggccgagaaattgggtgtgaggtttccaggaccgggaggaccacctggacccatgggtcccggacccaatatgggccctccaggacccatggggggaccaatgcaccccgacatgcacccagacatgcaccccgacatgcaccctgatatgcatgccgacatgcatgcggacatgccaatgggtccgggtatgaatccgggacctccgatgggccctggcggtccacctatgatgccctacggcccaggcgacagcccccatagtggaatgatgccacccattccacctgcacagaacttttacgagaatttctaccaacaacaggaggggatggagatggaaccaggactgttaggtgatgctgaagactacggccattacgaagaactgccgggagaacctggtgagcacctgttccccgaacatccgctggagcctgattctttttcagaaggtggccctccaggtcggcctaagccaggggcaggggtacctgatttcctcccttcagcccagcgcgctttgtatctccgaattcagcagaagcagcaggaggaagaggaaagagctcggcgtctcgctgagtcaagcaagcaagatagggaaaacgaggaaggagatacaggaaactggtacagctccgacgaggatgagggaggctcatccgtcactagcattttgaagactcttcggcaacaaacatccagtcgccctcccgcttccgtgggagaattgagcagctcaggtctgggtgaccctcgcctccagaaaggtcaccctaccggatctcgcttggcggaccctcggctttctcgagaccctcggctcacccggcatgtcgaagcctccggagggtctggacctggtgattccggtcccagtgatcctaggcttgccagagccctgcctacctcaaagccagagggaagcctgcattcctcccccgtgggaccatccagtagtaaaggatccggtccaccaccaacagaggaggaggaaggcgaacgcgcactgagagaaaaggcggtcaacatcccactggatcccctcccaggacaccctctcagggaccccaggagccagctgcagcagtttagccacatcaagaaagatgttactctgagcaagcctagctttgcacggactgtgctttggaatccagaagaccttatccctctcccgatacccaagcaggacgccgttccaccagtacccgctgctctgcagagcatgccaacactcgacccaagacttcatagagcggctacagcgggaccacccaacgcccgtcagcgcccaggcgcttctacagattcatcgacccagggagccaacctgccagacttcgaactcttgtccaggatcctgaaaaccgtcaatgcaaccggctcctctgccgctcctgggagcagtgataagccctcggaccctcgcgtgcggaaggcccctaccgatccccgtctgcaaaagcccactgactcaactgcgtctagccgggctgctaaaccaggccctgccgaagcaccgtctcccactgctagtccttcaggagatgccagccccccagcaacagccccttatgatcccagagttcttgccgcaggagggttgggccaaggcggaggcggtggacagtcaagtgtgctgtccgggatctccctgtacgatcctcgcacacctaacgctggcggtaaagcgaccgagccggctgcagatactggggctcagcccaagggcgcagaagggaacgggaagtctagcgcttctaaagcaaaggagccacctttcgtgcggaaatccgctctcgagcagcccgaaacggggaaggctggggctgacgggggaactccaacagataggtacaactcctacaacagacccaggcccaaagccgcagcagcccctgcggctacaacggccacacccccacccgaaggagcacccccacagcctggagttcacaatttacctgttcccaccctgttcggaactgtgaagcagaccccaaagacagggtcgggatccccatttgccggaaactcacccgcaagagagggtgagcaggacgcagcctcactgaaagatgtgttcaaaggatttgaccccacagctagccctttttgtcagtag

SEQ ID NO: 61275 - DNA, 3570 bp, Artificial Sequence
  Description of Artificial Sequence: Synthetic coding sequence
atgaccgattccgaacatgcagggcatgaccgcgaggatggcgaactggaagatggcgaaatagatgacgcgggatttgaggaaatacaagagaaagaggcaaaagagaatgaaaaacagaaaagcgagaaggcctatagaaagtcgcgcaagaagcacaagaaagagcgagaaaagaagaagtctaaaagacggaaaagggagaaacacaagcataacagcccatccagtgacgacagtagcgactacagcctggactccgatgtcgagcacaccgaaagcagtcacaagaagagaaccggattttatcgcgactacgatattccttttactcagcgaggccacatttccggtagctatataaccagtaagaagggacagcataacaagaaatttaagtcaaaagagtatgatgagtactcaacttacagcgatgacaacttcggaaactactctgatgacaacttcggaaactacggacaggagaccgaggaggattttgctaaccaactgaaacagtaccgccaagcaaaggagacatcgaatatcgcactgggttcatccttctctaaggagtcgggaaagaagcagcgtatgaagggggttcagcaaggaattgagcaacgagtaaagagttttaatgtgggtaggggcaggggacttcctaaaaaaatcaaaaggaaggagcgaggcggaagaacaaataaaggcccaaacgtgttttctgtgtctgatgacttccaggaatataacaagcctgggaaaaagtggaaggttatgacacaggaattcattaaccaacacactgtagagcataaaggaaagcagatatgtaaatacttcctggaaggacggtgcattaagggagaccaatgcaaatttgaccacgacgccgagctcgagaaacggaaggagatatgcaagttctaccttcagggatattgcacaaaaggcgagaattgcatctatatgcataacgaatttccgtgtaagttctatcactcaggcgcaaaatgctatcaaggagacaactgtaagtttagtcacgacgacctaaccaaagaaaccaaaaaactcctggataaggtcttgaataccgatgaagaactgattaatgaggatgagagggaattagaggaacttcgtaagagagggataacccctttgcccaagcctcctccaggagtgggcctgctgcctacacctcctgagcatttcccatttagcgatcccgaggacgatttccagactgatttcagcgatgatttccgaaagatccccagcctgtttgaaatcgtggtgaaacctacggtggatctggcccacaagattggtaggaaacccccagcattctacacctccgcctcacctccaggcccacagttccaagggagcagtccccacccccagcacatttattctagcggatctagccccggacctgggcctaacatgagccagggccatagttcacctgtgatgcaccccggatcccccggacaccacccctgcgccggaccaccaggcctcccagtgcctcagtctccacccctgcccccaggacccccagaaattgtcggaccacagaatcaggctggagtgcttgtgcagccggatacctcgctgactccaccatccatgggtggggcttaccacagcccaggctttcctggacacgtaatgaaggtcccacgggagaaccattgcagtccaggtagcagctaccagcagagtcccggtgaaatgcagctgaatacaaattatgaatcccttcagaatccggctgagttctacgacaattattatgcgcagcattctatccataatttccagccccctaacaacagcggagacggtatgtggcacggggaatttgctcaacagcaacccccagttgtccaggattcccccaaccacggatctgggtccgatggctcgtcgaccagaactggacatgggcctttaccagtcccaggattactgcctgcggtacaacgagccttgtttgtgaggttgactcagcgctaccaggaagatgaggaacagacctctacgcaaccccaccgagcccctagtaaggaagaggacgacaccgtcaattggtatagctcgtcagaggaagaggaaggaagcagcgtgaaatccatcctgaaaaccttacagaaacagaccgaaacacttcggaaccaacagcaaccctccactgagctgtcaacccccacagatcccagattggctaaggaaaaatccaaaggaaaccaagtcgttgatccaagattgcgcactattcctcgccaggacatccgaaagccaagcgaaagtgcacctttagacctgcgactcgcctgggatccaaggaaattgcgcggaaatggaagcgggcacatcggtagctctgtcggcggtgccaaattcgacctgcatcacgcgaatgctgggacaaacgtcaagcataagaggggcgacgacgacgacgaggacactgaaagagaattaagggagaaggctttcctaatcccgctggatgcctctccagggatcatgttacaagatccccgttcccagcttagacagttctcccacattaaaatggacatcacgctgacaaagccgaattttgctaagcacatcgtgtgggcgcctgaggatctgttgccagttcctcttccaaagcccgatcctgtgtcctccatcaatttacccctacccccactcatagcagaccagcgcctcaatagactgtggaatactaagtccgatctgcatcagaacaccgtttctattgatcctaagctggccgcaaaagcaaagattaacacaactaatcgcgaaggctacctggaacagtttggcgattcccatggctccggagccaagctgggggatcctagacttcagaaaaatttcgaccccagacttcacagacttccaaataccgaatcccaccaggtagttatgaaggactcacacgcctccaagggtgctccccatctgccacggtccaacccagggagctcccagcctagcggcgctggaacctcaaactcagggagcggtgccctgccaccttacgctcctaagctcagcagtagtgccggattaccactcggtacatctacctccgttctgagcggaatctctctgtacgaccctcgagatcatgggtcgagtagcacctctgaattagccacagcatcttctggggagaactctaaaaatcagaagaaatccgggggtctgaagtcctctgataagacggaacctagccctggggaagcaattttaccccagaaacctagtcctaatgtgggggtaaccctggaagggcctgcggatccccaggctgacgtgcctagaagttcagggaaagttcaagtccccgctgtccattcattacccgtgcaggcactgacagggctcattaggccacagtactccgaccctagacaggccagacagcctgggcagggttctcctacccctgacaatgacccaggcagagagactgacgataaatctttgaaggaggtcttcaagacattcgacccaactgcatctccattttgctag

SEQ ID NO: 61276 - DNA, 3570 bp, Artificial Sequence
  Description of Artificial Sequence: Synthetic coding sequence
atgaccgattcggagcatgccggacatgatagagaagatggcgagcttgaagatggagaaattgacgatgctgggtttgaggaaattcaggagaaagaggcaaaggaaaatgagaaacaaaagtccgaaaaggcataccgcaaatcgcgaaaaaagcacaaaaaagagagagagaagaagaagtccaaaaggaggaagcgagaaaaacacaagcacaacagccctagcagcgatgacagtagcgattattctctcgactccgatgtagagcataccgagagcagccataaaaagcgaacaggattctacagggactacgacattcccttcacacagcgcggtcacatctcaggcagctacataactagtaaaaagggacagcacaataagaaattcaagtccaaggaatacgacgaatatagtacctattccgacgacaatttcgggaactattccgacgataatttcggtaattatggccaggagacggaggaggactttgcaaaccagttaaagcaataccggcaagccaaagagacctcgaatatagccttagggtccagtttttccaaagagagcggtaagaagcaaagaatgaaaggtgttcagcagggcattgaacaacgggtcaaatcatttaatgttggcagaggacgtggactcccaaagaaaataaaacgaaaagagcgaggtgggagaaccaataaaggcccaaacgtgttctctgtctccgacgattttcaggaatacaacaagcctggaaaaaagtggaaggttatgactcaggaatttattaatcagcatacagtggagcataagggtaaacaaatctgcaagtacttcctggaaggacggtgtatcaaaggagatcaatgtaaatttgatcacgacgcagagctcgagaagaggaaagagatctgcaagttttatctgcagggatattgtacaaaaggggagaattgcatttacatgcacaacgagttcccatgtaagttctatcactctggcgcaaaatgctatcagggcgataactgcaagttcagtcatgatgaccttacaaaggagacgaaaaagctgctggataaagtgcttaacacggatgaggagctaattaacgaggatgagagagaactcgaggagctgcggaagaggggcatcacccccctgcccaagccaccaccgggagtcggcctactacctacccctcctgaacattttcccttcagcgatccagaggacgattttcagaccgattttagcgacgatttcagaaaaattcccagcctgtttgagatagttgtgaagcccaccgtggacctagcccataagattggacggaagccgcctgccttttataccagcgctagccctccaggccctcagttccagggctcatccccccatcctcaacatatttattcctcgggctcgtctcctggcccaggccctaacatgtctcaaggccatagcagccccgtgatgcatccaggttcacccggacaccacccatgcgcaggtccccctggcctgcctgttcctcaatccccgccattgcccccagggcctccagagattgtggggcctcagaaccaggccggagttctggttcaacccgatacatccctgacccctccctctatgggaggcgcttatcattctccaggctttcccggacatgtcatgaaggtaccacgtgaaaaccattgctcgcctggctctagttatcaacagtcaccaggggaaatgcaactgaacacaaactatgagtccctacaaaacccagcagagttttatgacaattattatgctcaacactccattcataattttcagccacctaacaacagtggggacggaatgtggcacggagagttcgctcaacaacagccccctgtcgtgcaggactcacccaaccatggatctggctcggatggatcttccacacgaacaggccacgggccactgcctgtgccaggactgctcccagccgtgcagcgtgcccttttcgttcgcctcacgcagcgttaccaggaggacgaagagcaaacctcaacacagccacaccgcgcaccaagtaaggaggaggacgacacagtaaattggtactcctcctccgaagaggaggaaggcagctccgtcaaatccatcctgaagaccttacaaaagcagacagagacgctgagaaatcagcagcagccaagcacggaattatccactccaactgatcccaggcttgctaaggagaagtctaagggtaaccaggtcgtggacccccgtctgagaactatccctcgccaggacatacgcaagcccagcgagagtgcacctcttgacctgagactggcatgggacccccgaaagctccgaggaaatggctctggccacataggaagtagtgtcggcggtgccaaatttgatctgcatcatgcaaatgccggaacgaatgtgaagcataagcgtggagatgacgatgacgaggacaccgagagagaactaagagagaaagctttcctgatcccgcttgatgcctctcccggtataatgctgcaggacccaagatcgcagttgcgccagttttcgcacatcaagatggatatcactttgactaagccgaatttcgccaagcacattgtttgggccccagaagacttgctgccagtgcccctccccaaacccgaccccgtctctagcatcaatctgcctctgcctcctctgattgccgaccagcgcttgaatagactgtggaatacaaagtccgatttgcatcagaacaccgtgagcatcgacccaaagttagcagccaaggccaaaatcaacactacaaaccgagagggctacctcgagcagtttggtgattcccacgggtccggcgcaaaactgggcgatcccaggctgcaaaagaatttcgatcccagactgcatcgactgccaaatacagagtcccaccaggtcgtgatgaaggattcccacgcctctaagggcgcaccacatctaccacggtctaatcccggtagcagtcagccctcaggcgcaggtaccagcaactctgggtccggtgcactacctccctacgccccaaaactgagctcaagcgctggattacctctaggtacatcaacgtcagttctgtcaggcatttccctttatgatccccgtgatcacgggtcctcaagtacttcggagcttgcaacggcaagttctggtgagaattccaaaaatcagaaaaagtccggcggtctcaaatcttcagataaaaccgaaccgtctccaggggaagccatcttaccccagaaaccaagtcccaatgtcggagttaccctggaaggccctgctgatccacaggcagacgtgcccaggagctctggtaaggtgcaggtgccagcagtgcactcattgccagtgcaggccctgactggccttattcgccctcagtacagtgatcccagacaggcgcgacagcccggtcagggcagtcctaccccagataatgatcccggacgggaaactgatgacaagtctctgaaggaggtatttaagacatttgatcccacagcgagccccttctgctag

SEQ ID NO: 61277 - DNA, 2679 bp, Artificial Sequence
  Description of Artificial Sequence: Synthetic coding sequence
atgcaggacctcaagaaatataaaaaaaagaaacagaaacgcatgaagagtcgcaaagtgaggaagcctacggaaaaccaggagaagaacattaggaagcgggaacgtaaaaagtcaaagcgccgtaaaagagaaaagcacaagcacaactccccaagcagcgacgattccagtgattatagtctggactctgatgtcgaacacacagagagttcccacaaaaaacggaccggcttctaccgagattatgacattccatttacccaacgcggtcatatttccggctcatacattactagcaaaaaaggccagcacaacaaaaagttcaagagcaaggaatatgacgagtactctacttattctgacgacaacttcggcaattattctgacgataatttcgggaattatgggcaggaaaccgaagaggactttgccaaccaactgaaacaatacaggcaggcgaaggagacctccaatatcgctctgggctcctccttttctaaggaatctggaaagaaacagcgcatgaaaggcgtccaacagggaatcgagcagcgagtgaaatcctttaacgttggtagagggcgaggactgccaaagaaaattaagcgtaaagagcgtggtggacgcactaacaaggggccaaacgtctttagcgtgagcgatgactttcaggaatacaacaagccgggaaaaaagtggaaggtgatgacacaggaatttattaaccagcacaccgttgagcataagggcaagcagatatgcaaatacttcctggagggcaggtgcatcaagggtgatcagtgcaagtttgaccatgatgcagagctcgaaaagagaaaggaaatatgtaagttctaccttcagggctactgtactaagggtgaaaactgtatttatatgcacaacgaatttccctgcaaattttaccattccggtgccaaatgttaccagggtgataactgcaaattttcacacgatgacctcacgaaagaaacgaagaagcttctggacaaagtcctgaatactgatgaggagctaattaacgaagatgagagggaactggaagaactgagaaagcgcggtataacgccgttgccaaagccccctcctggggtcggcttgctgccaacaccgccagagcattttccattcagcgaccctgaggacgactttcagactgatttttcagacgactttagaaagattccaagcctgttcgaaatcgtagttaagcctactgtagatttagcccataaaatcgggagaaaacctccggctttctacacatccgcctcccctcctgggcctcagtttcaagggtctagtccgcatccacagcacatctactcttctggatccagcccaggacctggacctaacatgtctcagggccactcctcccctgtgatgcacccagggtccccgggacatcatccctgcgccggaccccctggcttgcctgttcctcaaagtcctccactgccccctgggcctcccgagatagtagggcctcagaatcaagcaggcgtgctggtccaacccgacacctctctgactcccccttcaatgggtggggcatatcattccccagggtttcctggccatgttatgaaagtcccgagggagaaccactgttctccaggctcatcttatcagcagtctcccggagagatgcagctcaatacaaattacgagagcctacagaatcctgccgaattctatgataattactacgctcagcattccattcacaattttcagccacccaacaattccggcgacgggatgtggcacggcgagttcgcccagcagcaacctcccgtggtgcaagatagccctaaccacggcagcggcagcgacggctcatcaacccgaaccgggcatgggcctttacctgtgccaggccttctgccggcagtgcagagagctctctttgtccgtctaacacagaggtatcaggaagacgaggagcagacaagcacccaaccccatcgagctccttcaaaagaagaggacgataccgtgaattggtacagctcctcagaggaagaggagggatcctccgtcaagtcgatcctcaaaaccctgcagaagcaaacggaaacactgcgtaaccagcagcagccaagtacagagctcagcactcctacagatccacggctcgctaaggagaagagtaagggcaaccaggtggtagacccaagactgcgcacaatcccacgccaggatataaggaagccctccgaatcagctcccctagacctgcgattagcctgggatccccgaaagctgcgagggaatgggtcgggtcacatcggctccagtgtggggggtgcaaagtttgacctccaccacgctaatgccggaaccaatgtaaagcataagcggggtgatgatgacgacgaggacacagagcgcgagctgcgggaaaaagctttcctcatccctctggacgcctcacccggaattatgctgcaggacccgaggtctcagcttcgacagttttcccacatcaagatggacattacgcttactaaacccaattttgcaaagcacatagtgtgggcgcctgaagatctcctacctgtgcctcttcctaagccagatcctgtgtcatctatcaatttaccacttccccctttgatcgccgaccagagactcaatcgcctgtggtag

SEQ ID NO: 61278 - DNA, 903 bp, Artificial Sequence
  Description of Artificial Sequence: Synthetic coding sequence
atggcagaacccaccgtctgttccttcttgactaaggttctgtgtgcacacgggggtcgcatgttcctgaaagacctgagaggccacgttgagctgagcgaggccaggctgagagacgttcttcagagggccggtcccgagcgattcctcctgcaagaagtggagacccaagagggcctgggggatgcagaagctgaagctgctgcaggggctgtggggggagggggtacctcagcttggcgcgtggtcgctgtgtccagcgtgcgcctctgtgcaagataccagcgcggagaatgtcaggcctgtgaccagctccacttctgccgccgacatatgctggggaagtgtcccaacagagactgttggtccacatgcacattgtctcacgatatccacacaccagtcaatatgcaggtcttaaaaagccacggcctctttgggctgaatgagaaccagctacgcatccttctgttgcaaaacgatccctgcctgctacctgaggtctgtctcctatataataaaggcgaggctctatatgggtattgtaacctgaaggataagtgtaataaatttcacgtctgcaagtcattcgtgaagggggaatgcaagttgcaaacctgtaagcgcagtcatcaactgatccacgctgccagcctcaaactattgcaggatcaggggctgaacatcccaagtgtcgtcaacttccagatcatttcaacatataagcacatgaagctgcacaagatgctcgaaaatacagataacagtagtccatctaccgaacactcccagggattggagaaacagggcgtgcatgcagctggggcagccgaggccggaccgttggcctctgtgccagcccaaagtgctaaaaagccctgcccagtgtcatgcgaaaagtag

SEQ ID NO: 61279 - DNA, 309 bp, Artificial Sequence
  Description of Artificial Sequence: Synthetic coding sequence
atggcagaaccaacagtatgtagttttctaaccaaggtcctctgtgcgcacgggggaaggatgtttttgaaggatttgcgaggccacgtggagctgagcgaggctagattacgcgatgtcctacagagagcgggtcctgagagattcctcctgcaagaggtggagacacaagagggtttgggtgacgcggaggccgaggccgcagcaggcgctgttggaggaggcggtacatctgcttggcgtgtcgtggccgtttccggaaccatcggggcttgccaccatacacagctaattttcctgggcttctag

SEQ ID NO: 61280 - DNA, 1575 bp, Artificial Sequence
  Description of Artificial Sequence: Synthetic coding sequence
atgatgaccactctgcagaataaggaggagtgtggcaaaggaccgaagaggatattcgcccctcctgcccagaaatcgtattctttgctgccttgttctcccaactctcctaaggaggaaactcccggaattagtagcccagaaaccgaagccagaattagcctgccaaaggcatcactgaagaaaaaggaagaaaaagccaccatgaagaacgtgccttcgcgagagcaagaaaagaaaaggaaagcacagatcaacaagcaagcagaaaaaaaggaaaaagaaaagtcctctcttaccaatgcagaatttgaagagattgttcagatagtactccaaaagtctctgcaggaatgcctaggcatgggaagtggcctggactttgccgagacgagctgcgcacagcccgtggttagcacccagtcagacaaagagccaggcatcaccgcctctgccacggatacagacaatgctaacggtgaggaggtcccgcacactcaggaaatcagtgtatcgtgggaaggcgaagctgccccagaaataaggacatccaaactcggacagccagacccagctccctctaagaagaagagcaacagactgaccctatcgaagcggaagaaagaggcccaggacgagaaggtagagaagacacaaggtgggcacgagcaccggcaggaagatcggctgaagaaaaccgtgcaggatcactctcagataagggatcagcagaagggggagatatctggctttggacagtgtctggtgtgggtgcagtgctcatttcccaactgtgggaaatggaggcggctctgcgggaatattgatccatcagtgttaccagataactggagctgcgatcagaacacagacgtacagtataacagatgtgacatcccagaagagacttggaccgggctcgagtctgatgtggcatatgcatcttacatcccaggatctataatctgggctaagcagtacggatatccgtggtggcccggtatgattgagtcagacccagatctcggagaatactttctctttacgtctcacctggacagtctgccttctaagtaccacgtaacattcttcggcgagacggtgtccagagcttggattcctgtgaacatgttgaaaaattttcaagagctttctcttgaactgagtgtgatgaagaaaagaaggaatgactgtagccaaaaactgggggtagccttaatgatggctcaggaagcagaacaaatctcgatccaggagagggtgaacctgttcggcttctggagtcgtttcaacgggagcaacagtaatggagagcgaaaggacctccagctgagtggcctcaattcaccaggctcttgcttggagaaaaaggagaaagaggaggagttagaaaaggaggagggggaaaaaactgcacttcgaaagaatctgaaactgcccagggctcgaccttggcagccggcatttcagagagagaagaagcttgagcagtgtcagcgaacctgggcctaccagagggtgcgcggacccgcaccacatttgcggaagaagagcccggacacagggaacccgtag

SEQ ID NO: 61281 - DNA, 330 bp, Artificial Sequence
  Description of Artificial Sequence: Synthetic coding sequence
ccgatggtcggccttttggtccacacagcagccacttttaactactcattccgcaaaattcgtggcttactttgcccccagcataagcaacgcggtgtacaggcgaaccagaccccggtgcttttccttcacatctcttgtgtctattacagcttataccttttctttctcttttgctgcttgttcctgattcccctagagcagaagatgaccacatccccccttccctatccttgcgacaatattcacgtgacggtgtggcctttgggagaggtcctgatggagacccggatgtgggagagtaagattggcctggagatgcggctgtag

SEQ ID NO: 61282 - DNA, 399 bp, Artificial Sequence
  Description of Artificial Sequence: Synthetic coding sequence
atgaggaacatgattccacaagacaacgaaaaccccccacagcagggcgaagctaaccaaaatgatttcgctctggtcgctcaagctggagtgcagtggctagatctggggcctcagctgcctctactgcctggcttcaaacagtttttttgtttaagcctccttagctcttgcggctatagttggagccttgcactgagccctagacttgagtgtagtggagcaatcagtgcttacggcaaacttaggttacccggttcctgccacagccctgcctccgctagtcgcgtagcccgtaccaccggggctcggcaccatactcgtctcatctttgtgttcctggtggagaccaggttccaccgggtctcccaggatggcctggatctgctgacctcttag

SEQ ID NO: 61283 - DNA, 891 bp, Artificial Sequence
  Description of Artificial Sequence: Synthetic coding sequence
atgattgctgaaaggctggctcgtcttagacaggaaaataaaccgaaactggtcccatctcaagcagaaatcgaagcaaggctggccgcacttaaagacgaaaggcaaggctctatcccctctacgcaggagatggaagccaggctggccgcactgcaggggagagtcctacctagccagacaccacaacctgcccaccacacacccgacacccgcacacaggcacagcaaacccaggaccttctgacccagctcgccgcagaggtggccattgatgaaagttggaaaggcggaggcccagcagcctcactccagaacgatctgaatcaggggggaccagggtctacgaactctaagcgccaggctaattggtccctggaggaagagaagtctagacttcttgcagaggcagcccttgagctgagagaagaaaatactcggcaggaaaggatccttgccctggcgaaacgtctggccatgctccgcggacaggatccggaaagagtaaccttgcaggactatcggctacctgactctgatgatgatgaagacgaggagaccgcaatccaaagagtcctgcagcagctgacagaggaagcctccctggatgaggccagcggttttaatataccagccgaacaggccagtcgtccctggacccagccaaggggtgctgaacctgaggctcaagacgtggacccaagacccgaggccgaggaagaagaattgccatggtgctgtatttgcaacgaagatgctacactgcgctgcgcaggttgcgacggtgacctcttttgtgctcgctgcttccgggaggggcatgacgctttcgagctaaaagagcatcaaacctccgcctatagcccaccaagggccggtcaagagcattag

SEQ ID NO: 61284 - DNA, 1584 bp, Artificial Sequence
  Description of Artificial Sequence: Synthetic coding sequence
atgtatcagcctgaggacgacaacaatagtgatgttacctctgacgacgacatgactcggaataggcgggaaagttccccaccacacagcgttcactccttttctggagacagagattgggacagaaggggacggagccgagacatggagccccgagacagatggtctcacactaggaatcccaggtcccgaatgcctcccagagacttgagtctgccagtcgtggctaaaacgagcttcgaaatggaccgcgaagacgaccgggatagtagagcctatgaatccagaagccaggacgccgagagctatcagaacgtggttgacctggccgaagatcgcaaaccacataataccattcaggacaacatggagaactacagaaagcttctgagcctggggtttctggctcaggatagcgtgcctgcggaaaagcggaatacggagatgttagacaacctcccatccgccggttcccagtttccagacttcaagcacttgggtacatttctggtttttgaggaactggttactttcgaggatgtcctagttgactttagcccagaagaactgtcttcgctgtcagctgcccagcgaaacctgtaccgtgaagtcatgctagagaactatcggaacctcgtgagcttaggacatcaattttccaagccagacattatttcccgactggaagaagaggagtcctacgctatggagacagactctaggcacactgtaatttgccaaggggaatctcacgatgaccctctcgaacctcatcaaggtaaccaagagaaactgctgacccctatcacgatgaatgatccaaaaactcttaccccagagcgttcctatgggtccgacgaattcgaacggtcatcaaacttatccaagcagtctaaggacccgttgggcaaagacccccaggaggggactgcccctggaatttgcacctcacctcagagtgcatcacaggagaataaacacaatcgttgtgagttttgcaagaggaccttttctacacaggttgctctgcgaaggcatgaaaggattcataccggcaagaagccttacgagtgtaaacagtgcgcggaagccttttacctgatgccccacctcaaccgacaccagaagacccattcaggtaggaagacctccggatgtaacgagggacgaaagccttccgttcaatgtgctaacttgtgcgagcgcgtgagaatccactctcaagaagattacttcgaatgcttccagtgcgggaaagcatttttacagaatgtccatctcctgcagcacctgaaagcccacgaggcagcccgagttctgccacctgggctatcccattcaaaaacttaccttataaggtatcagcgtaaacacgattacgtgggcgagagggcctgccagtgctgcgattgtggcagagtatttagcaggaactcttatcttattcagcactacaggacccacacccaagaaaggccttaccagtgccagttgtgcggaaaatgttttggaagaccatcctacctgactcaacattatcagttgcattcacaagagaagacggtggaatgtgatcactgctag

SEQ ID NO: 61285 - DNA, 1809 bp, Artificial Sequence
  Description of Artificial Sequence: Synthetic coding sequence
atggcaagattaacaaagcgccgtcaagccgacacaaaagcaatccaacacctttgggctgctattgagattatccggaatcagaaacagatcgcaaatatcgatcgcattaccaagtatatgagccgggttcatggtatgcaccccaaagagacaactaggcagttgagcctggcggtgaaggatggacttatcgttgaaacactgacagtaggatgcaaaggctccaaagctggcatagagcaggaaggatactggcttccgggagatgagattgactgggaaacagagaatcatgactggtactgttttgagtgccacttgcctggcgaagtgctgatctgtgacctgtgcttccgcgtttatcacagcaagtgccttagtgacgagtttaggctgcgggattctagctccccctggcagtgccccgtgtgtagatctattaagaaaaagaacaccaacaaacaggaaatgggcacatacctcagattcattgtgagccgcatgaaggaacgggcaatcgatctcaacaagaaaggcaaggataataagcatccgatgtatagacggctagtgcattccgccgtcgacgtccctacgatccaggagaaagtcaacgaggggaaatacagaagctacgaagagttcaaggctgatgcacagctgttattgcacaacaccgtgatattctatggagctgacagcgaacaggctgacattgctaggatgctgtacaaagatacttgccatgaactggatgagcttcaattgtgcaagaactgcttttacttaagcaacgcaaggcccgacaactggttttgctatccctgcatccccaatcacgaactggtctgggcaaaaatgaagggctttggtttctggcccgcaaaggtgatgcagaaggaggacaatcaggtggacgtgcgcttttttggccatcatcaccaaagagcatggatcccgagcgagaacatccaagatattacagtaaatatacatcgccttcatgtgaaaaggtcaatgggatggaaaaaagcctgtgatgagctggagctgcaccagcggttcttgcgggaggggcgtttttggaagtctaagaacgaagaccgcggagaagaggaggctgagtcctctatctctagcactagcaatgaacagttgaaggtgacccaggaaccacgggctaagaaggggcgtcggaatcagagtgtggaaccaaagaaagaggaacctgaaccggaaaccgaggctgtcagttcctcccaggagatcccaacgatgcctcagcctatcgagaaggtcagcgtcagcacacaaacgaaaaagctcagcgcctcttcccccaggatgttacataggtcaacacagacgaccaacgacggcgtgtgtcagagtatgtgtcacgacaagtatactaaaattttcaatgactttaaagaccggatgaaaagtgaccacaagagggagacagaaagggtcgttagagaagccttggagaaactgaggtcagaaatggaagaggagaagaggcaggccgtcaacaaagccgtggcaaatatgcaaggcgaaatggacaggaagtgcaagcaagtaaaggaaaagtgtaaggaagaatttgtggaggaaattaagaagctggcaacacagcacaaacagctgatctctcagaccaagaagaaacagtggtgttacaactgtgaggaggaagcaatgtatcactgctgctggaacactagctactgttccattaaatgccagcaggaacactggcatgctgagcacaaacgcacttgtcgacggaaacgctag

SEQ ID NO: 61286 - DNA, 1920 bp, Artificial Sequence
  Description of Artificial Sequence: Synthetic coding sequence
atgacccctgctagcgcaagcggcgaagactcaggatcattctactcatggcagaaggcaaagcgagagcagggtctcgttacctttgaggatgtcgcagtcgacttcacccaggaagagtggcaataccttaaccccccacaaaggactctgtatcgcgacgtcatgctggaaacatattccaacctggtctttgtgggacagcaggtgaccaagccaaacttgatcctgaaattagaggtggaggaatgccctgctgaaggcaaaatacctttttggaattttccggaagtgtgccaggttgatgaacagatcgagaggcagcatcaggacgatcaagataagtgccttcttatgcaagttggctttagcgacaaaaaaactatcatcaccaaatctgctcgagactgccacgagtttggaaacattctccacttgtccaccaacttggtcgcctccattcagcggcctgacaagcatgaaagcttcggaaataacatggtggacaacttggacctgttcagccgatcctccgcagagaacaaatacgacaatgggtgtgctaagctgttttttcacacagaatatgagaagacaaatccgggtatgaagccttatgggtacaaagagtgtggaaaggggctgcgaaggaagaaaggactatcattgcaccagcgcataaagaacggcgaaaaaccatttgagtgcactgcctgcagaaagaccttttcgaaaaagagccatctcattgtgcattggcggacgcacacgggggagaagccctttggctgtaccgagtgcgggaaagctttttcccagaaatcccagctgattatccaccttcgcacccacaccggggagcgtcccttcgaatgccccgagtgtgggaaagcgtttcgcgaaaaaagtacagtcattattcattacaggactcataccggagagaagccttatgagtgcaacgagtgcggtaaggcttttactcagaaatcgaacctaatcgttcatcaaaagacacatactggtgagaagacctatgaatgcaccaaatgtggtgagtcatttatccagaagcttgatctgatcatccatcactccactcacacaggcaagaaaccccatgagtgtaacgaatgtaagaaaaccttcagcgataagtccaccctaatcatacaccagaggacccatactggcgaaaaacctcacaaatgtacagagtgcggcaagagtttcaatgaaaagtccacactgatagttcatcaaaggacacatactggtgaaaaaccttatgagtgcgacgtgtgtggcaagacattcacacagaagtctaaccttggcgtacatcaacgcacccacagtggggaaaagccattcgaatgcaacgaatgcgagaaggccttcagccagaagtcctacctgatgcttcaccagaggggccacacaggtgagaaaccttatgaatgtaatgagtgcgaaaaggcattcagtcagaagagctacttgatcatccaccagcgcacccacacagaggagaaaccttataaatgcaatgagtgcgggaaggcttttcgggaaaaaagcaagcttataattcatcagaggatccacacaggagagaagccatacgagtgccctgtgtgctggaaagcgttcagtcaaaagagtcagctgattatacaccagaggacccataccggagaaaagccgtacgcgtgcactgagtgtgggaaagcctttcgggagaaaagtaccttcacggtccatcagcgaacccacacgggggagaaaccgtataaatgcaccgagtgcgggaaggcgttcacacagaagagtaacctaattgtgcaccaacgaacccatgctggaaagaaggcccacggcagagggcatactcgcaaaagtaagttcatggcgcactag

SEQ ID NO: 61287 - DNA, 993 bp, Artificial Sequence
  Description of Artificial Sequence: Synthetic coding sequence
tagtccgaaatggccgctcgggacgagttgggcctgggaggggattctctggaggccatgcctgtgccggctgctcgcggtcgaccaaggattactaatgggcctgaagagctcgctgcccctagccctgctgcactagccgactacgaaggtaaagacgtggccacgcgggtcggcgaagcctggcaagagaggccgggtgctcctcgcggtgggcagggagatccagccgtgcccgctcagcaacctgccgatccatccacccctgaacgacaaagctccccaagtggctctgaacaactagtgaggcgagaaagttgtggcagctctgttctgaccgactttgaaggcaaggacgtggctactaaagtcggcgaagcctggcaggacaggccgggtgcgcctcggggtggccaaggtgacccagcagtccccacacaacagcctgctgatccttccactcctgaacaacaaaactcaccctctggatctgaacagttcgtgaggcgcgagtcatgcacctctcgtgtccgatcaccgtcatcgtgcatggtgaccgtgaccgtcacagcaacctccgaacaacctcatatctatatccctgcgcctgcttcagagttggattccagtagtactacaaaggggattctgttcgttaaagaatatgtcaacgccagtgaggttagtagcggtaagccagtgtccgcacgctactcaaacgtctcctccatcgaggactcattcgcaatggaaaagaaacctccttgtggttccacaccgtactccgaacggactaccgggggtatatgtacctattgcaacagagaaatcagagactgccccaagattaccctcgagcaccttggcatttgttgccatgaatattgtttcaaatgcggtatctgcagtaaaccgatgggcgacctgctcgaccaaattttcatccacagagatacgatccattgtggaaaatgttacgaaaaactgttttag

SEQ ID NO: 61288 - DNA, 1167 bp, Artificial Sequence
  Description of Artificial Sequence: Synthetic coding sequence
atggccgcagtcagccccacaaccaggtgccaggagagtgtgacgttcgaagacgtcgcagttgtattcaccgacgaagagtggtctaggttagtaccgatacagcgcgacctttacaaggaggtgatgctggagaattacaattcgattgtttccctggactgggaaactaaaccggaaattcacgacgcctcagataagaaatctgaggggagtttgcgcgaatgcctgggacgtcagtccccactctgccctaagttcgaagtgcatacccccaacgggcgaatgggtaccgaaaaacaatcaccctctggagaaacccgaaagaagagtctctctcgtgataaggggctgcgacggcgtagatccgccctatcaagggagattcttaccaaggaacgccaccaagagtgcagtgattgtggaaagaccttcttcgatcatagttcactgacacgccatcagaggacccacaccggggaaaagccatatgactgtcgggagtgtggcaaggccttcagtcacagatctagcctgtctcggcatctgatgagccacacaggcgaatcgccctatgagtgcagcgtttgctccaaggccttcttcgatagaagttccctgacagttcatcagagaattcacacaggtgagaagcctttccagtgcaatgagtgtggtaaggcgttctttgaccgctcgtccctgactaggcaccagcgaatccacaccggggagtcgccgtacgagtgccaccagtgcggcaaggcatttagccagaaatccatcctgaccaggcaccagctgatccacaccggtcgtaagccatacgaatgtaacgagtgcgggaaggcattctacggcgtgtctagtctcaatagacaccagaaggcgcacgcaggtgacccgagataccagtgcaacgaatgcggcaaggcctttttcgatcgctcttcacttacccagcatcaaaagattcatactggcgataagccatacgagtgctccgaatgtgggaaagcgttttcgcaacggtgtcgtttaacccgccaccagagagtgcacactggggagaaaccattcgaatgtactgtttgcggtaaagtgttctccagcaaatctagcgtgatccagcatcagcgcagatacgcaaagcagggaatagactag

SEQ ID NO: 61289 - DNA, 2049 bp, Artificial Sequence
  Description of Artificial Sequence: Synthetic coding sequence
atgatccccaaacaggatatcagtgaggaactcgaaagccagagagccaagtcagaggatcacgtcaggaacatctttaaagaaactgaggagatgagcaagactgagggcaaacttgaaaattgttggaggaaatatgcggtagaaggagtgaaaaatagtttcagtcaaaagagtaattttagggaaataacaatgcgctatgtgaaaacactgtcccgcgagaacgggcagaagtttaatgccgtgggtgaaaactgtattaccgactcaaacccagcaaagcacctccgtggcagcagggaggagagcctgcacccaagcgtttcttccgtagaaaatctgcagcaacatgaagatctgatcaatctgcaaagcttccagttaggagagagagcttaccagactgatgtgctcgttaaggttccacgccagagttctgtcctgagcgagaaccagcggatgaataaccccgagagatggttcgaaagtacggggtgcggcaaaacctacaaccagaaccgggctttcaaccagcaccagcggtttcatagcggcgagaagacttatgaacataacgaatgtggaaaagctttttcatggccttcgatactcagcaaacaccagagaatacatacaggaaaaaaactgtatacatgcgaggactgtggcaaaagctttagcgtccactcttatttcatccagcattgcaagatccacacaagggagaaaccttacgaatgtattaaatgcggcaaggctttctccacacattcatcttacgtccaacatctcaagatccataccggagaaaagcatcatgaatgtaatcaatgcggaaaggccttcagccactcatctaatctgatccaccaccagcgcatccactcaggcgagaagccctacaagtgcaaagagtgcggcaaagccttcaacaggcagagtaacctgatccagcaccagagaatccactccggcgaaaagccatatgactgtaaggaatgtggaaaggccttcagtacgcagctgttcctgattcagcatcagcgaattcacactggcgagaagccctatgaatgcaacgaatgcgcaaagtccttctccctcaatcggactctgaccgtgcatcagagaatacacacgggggagaagccttaccggtgtaatgagtgtggaaagtcctttagtcagtgcagtcaagtcattcagcataaaaggattcatactggagaaaaaccgtatatttgcaatgaatgcggcaagtctttcggtgcccgactcagtctcattcaacatcagaggattcatacaggtgagaaaccctacggttgccgagagaagccctatgagtgctccgagtgcggaaaggccttctcccagtcgttcaacctcatccaccaccaacggacccacaacggcgagaagtcctatgaatgtaatgaatgcgacaaggcgttttcactcctatcctctttggtgcagcaccagcgtatccataacggagacaaaccttacgagtgtcacaaatgcggtaaggctttctcccagggtagccacttgatacagcatcaaagaagccacatcggtgaaaaaccatatgagtgtaacgagtgcggcaagacctttggtcagatatccaccctgataaagcacgagcgaacacacaacggtgaaaagccttacgaatgtagcgactgcgggaaagcttttagccaaagcgctcatctaatccatcatcaacggatccacaccggggaaaacccctatgagtgctccgagtgtggaaaggctttcaacgtgtgcagctcactcatccagcatcatagaattcacacaggagaaaagccttacgaatgcagcgactgtggaaaagcctttagccaacactcccagttcatccaacaccaacggattcataccggggaaaagccatatatgtgcaacgagtgcgagaagtctttctccgcctgcttgtccctcatacagcacaagcggatacacaccggagagaaaccctacgtgtgcgctaaatgtggcaaaagcttctag

SEQ ID NO: 61290 - DNA, 1419 bp, Artificial Sequence
  Description of Artificial Sequence: Synthetic coding sequence
atgatgggtacatacggtaatctactgtccctgggatgcgattctaggatcgagaaggaggagatgatcccgaagcaggacatctctgaggagctggagtctcagcgcgcaaagagcgaagaccacgtgaggaacattttcaaggagacggaagagatgtccaagacagaggggaagctggagaactgctggcggaagtacgccgttgagggtgtgaagaacagcttcagtcagaagtcaaactttagagagattaccatgaggtatgtcaaaacactcagtcgtgaaaacggccagaagtttaatgcagtaggcgagaattgcataaccgacagtaatccagcgaagcacctgcgagggtcaagggaggagagcctgcacccctccgtttcttccgtggaaaatctgcagcagcatgaggatcttatcaatttgcagtctttccagctgggcgaacgggcttaccagactgacgtgttagtgaaggtccctcggcagagctcagtgctttcggagaatcagcgaatgaataatcccgagcgctggttcgagtctacggggtgtggtaagacctataatcagaaccgcgcttttaatcagcatcagagattccattcgggcgaaaaaacctatgagcacaacgagtgtggtaaggctttcagctggccatccatcctctcgaaacaccaaagaattcatacaggtaagaagctctatacgtgtgaagattgcgggaaatccttctctgttcattcttacttcatccagcactgcaagatccacactcgagagaaaccctacgaatgcatcaagtgcgggaaagcattttctacgcattcatcctacgtacagcacctgaagatccataccggtgaaaaacatcatgaatgcaaccagtgtggcaaggcgtttagccactcctctaacctcatccatcatcagcgaatacattcgggcgagaagccgtataagtgcaaggaatgcggcaaaacattcggccaaatttcaacccttattaagcacgagagaacacacaatggcgagaaaccttacgaatgttccgactgtggaaaggcattcagtcaatccgcccacctgatacaccaccagcgtattcacactggcgaaaacccttacgaatgttccgaatgtggcaaggcattcaatgtgtgcagctcactgattcagcaccaccgtattcacactggagagaaaccctacgagtgctccgattgcggaaaagctttctcccaacacagtcaattcattcaacatcaaaggatccacaccggcgagaaaccgtacatgtgtaacgaatgcgaaaagagcttttccgcttgcctgagtctcatccagcacaaaaggatccacaccggcgagaagccttatgtctgcgctaagtgcggcaagagcttctag

SEQ ID NO: 61291 - DNA, 1200 bp, Artificial Sequence
  Description of Artificial Sequence: Synthetic coding sequence
atgagccaagtcacattctctgacgtcgcaatcgacttctcccatgaggaatgggcatgtttggacagtgcccagcgggacctttataaagacgtgatggttcagaattacgagaacttagtctccgtagggcttagtgtcacaaaaccatatgtaatcatgctcttggaggatggaaaagaaccatggatgatggaaaaaaaactgagtaaggactgggagagccgctgggaaaataaggaattgtctaccaagaaagacatctatgacgaggattctccgcagcccgttaccatggaaaaagtggtgaagcagagctatgagttcagcaattccaataagaatctcgaatataccgagtgtgataccttcagaagtaccttccacagtaagtctacacttagtgagccccagaacaattctgcggaagggaactcccacaaatatgacatcctcaaaaagaacctctccaagaaaagcgtgattaaatctgagagaataaacggaggcaagaaactcttgaattctaataagtccggagccgcatttaatcagagtaagtccctcacacttccccagacctgtaatcgagagaagatttacacctgttccgagtgcggcaaagccttcggtaagcagtccatccttagccggcattggagaatccacactggagaaaaaccctatgagtgtcgcgagtgtggcaagacattctctcacgggagcagtctcacaaggcaccagatttctcacagcggggaaaagccatacaaatgcatcgagtgtggtaaagctttctcccacggctccagtctgaccaatcatcagtctactcatactggcgagaagccctacgaatgcatgaactgcggcaagagcttttccagagtaagcctgctcattcagcacctccgcatccatactcaggagaagaggtacgaatgccggatctgcggcaaagcgttcattcactcttccagcctaatccaccatcagaaatcacacaccggcgagaagccatatgagtgccgggagtgtggcaaagcattctgttgcagttcccatctgactcaacaccagcgtatccattcgatgaaaaagaaatacgaatgtaacaagtgtcttaaagttttttcctctttttctttcttggtccagcaccaaagcattcacaccgaagaaaagcctttcgaggtgtag

SEQ ID NO: 61292 - DNA, 1332 bp, Artificial Sequence
  Description of Artificial Sequence: Synthetic coding sequence
atgtcacagagacagtatccggaatgctatttggcaccaaatgggtgccttgtgagcaattgcggtgtaaataaaatgtccaacgaagaactggtcggacagaaccacggaatggagggcgaggcatgcacaggaggggacgtgaccttcagcgacgtcgccatcgacttctctcacgaagagtgggcttgtctcgactcagcccagcgagacctctacaaggatgtgatggtgcagaattacgagaatctggtgagcgtggggttgtccgttaccaagccttatgtgatcatgctgcttgaggatggaaaagaaccttggatgatggagaagaagctaagcaaggactgggagtctcgctgggaaaataaagaactcagtactaagaaagatatctacgacgaggattcgccccagcccgtgaccatggagaaggttgttaagcagtcttatgaattctctaactccaacaagaacctggagtatacggagtgcgatacatttcggagcacattccactctaaaagtacactgtcagaaccccaaaataattcggctgagggcaactcacacaagtatgatattttaaaaaaaaacctgagcaaaaaatctgttatcaaatcagagaggataaatggcggtaaaaagctgttaaacagcaataagagcggggcagcctttaaccagtctaagtccctgacgctgccgcagacatgtaatcgcgagaaaatttacacgtgctccgaatgcggcaaagcattcggaaagcaaagtattctgagtaggcattggaggattcataccggcgagaagccttatgaatgtcgtgagtgtgggaagacattctcccatggctctagtctgactcgccatcagattagccattccggagaaaaaccttacaaatgcattgaatgtggcaaggctttctcccacggctcttctctcaccaaccaccaatcgacgcacaccggcgaaaagccgtatgagtgtatgaactgtggtaagagtttctccagagtgtccctcttgattcagcacctgcgaatacatacacaagaaaagcgctatgagtgtcgcatatgcgggaaggcctttatccattctagcagcttaattcaccaccagaagtcccatacaggtgaaaaaccttacgaatgtcgggaatgtggcaaagctttctgctgctccagtcatttgactcaacaccaacggatccattctatgaaaaagaaatacgagtgcaataaatgcctgaaagtgttctctagcttcagttttttggtgcaacaccagtctatccacaccgaggaaaaaccttttgaagtctag

SEQ ID NO: 61293 - DNA, 1200 bp, Artificial Sequence
  Description of Artificial Sequence: Synthetic coding sequence
atgtcacaggtgacgttttccgatgtggcgatcgacttctcccatgaggagtgggcgtgcctggatagcgctcagagagatttatacaaggacgttatggtccagaactacgagaatctggtttccgttggcctgagtgtaactaaaccttatgttatcatgctgttggaggatggcaaagaaccctggatgatggaaaagaaactctctaaagactgggaaagcaggtgggagaacaaagagctgtctacgaaaaaggatatttacgacgaggactcaccacagcccgtgacgatggagaaagtggtcaaacagtcttacgagttctccaattcaaacaagaacttggaatataccgaatgcgacacattcagaagtacctttcattcaaagagcacacttagcgaaccccagaacaattccgcagagggcaacagtcataaatacgacattcttaagaagaatctctctaagaaaagcgttatcaagagtgaacggatcaatggagggaaaaagttactaaatagtaataaatcgggcgcagctttcaaccagtcgaagagcctgaccttgcctcagacatgtaatcgagaaaaaatctatacttgctccgagtgtggtaaggcattcggcaagcagtctatactgagcagacactggcggatccacactggggaaaaaccttatgaatgcagggaatgcggcaaaaccttttcacatgggtcgagtctcacaaggcaccagatttcccattccggggagaagccgtacaaatgtatagagtgcgggaaggccttctctcatggttcctccttaacgaatcaccagtctacacacaccggggaaaaaccctatgaatgtatgaattgcggcaagtcattctcacgggtttctctgttgatacaacatttaagaatccacacacaggagaaacgatacgagtgccgtatttgtgggaaagccttcatccatagctcttctttaatccaccatcaaaagtctcacaccggcgaaaagccttacgagtgcagagagtgcgggaaggctttttgctgtagctcccatctgactcagcaccagcgtattcattctatgaagaagaaatatgagtgcaataaatgcctcaaagtgttctcctccttcagctttctggtccagcatcagtctatacacacggaagagaagcccttcgaggtttag

SEQ ID NO: 61294 - DNA, 429 bp, Artificial Sequence
  Description of Artificial Sequence: Synthetic coding sequence
atgtctcaggtaacctttagtgacgtggctatcgacttctctcatgaggaatgggcctgcctagacagcgctcagcgggatttatataaggacgtgatggtacagaactacgagaatctcgtgagtgttggactcagtgttaccaaaccttatgtgataatgttgctcgaggatggaaaagagccatggatgatggaaaaaaaactgtcaaaggattgggaatctagatgggaaaacaaggaattgagcacgaagaaggacatatatgacgaggacagcccccagcccgtcacaatggaaaaggtggtgaagcagagctacgagttcagtaactctaacaaaaacctggagtacacagaatgtgacacctttcggagtacattccacagcaagagcactctctctgagcctcagaataactcggcctag

SEQ ID NO: 61295 - DNA, 1200 bp, Artificial Sequence
  Description of Artificial Sequence: Synthetic coding sequence
atgtctcaggtcaccttttcagatgtggctatcgatttcagtcacgaagaatgggcctgtctggacagtgcacaacgcgacctatacaaggatgtgatggtccagaactacgagaatctagtcagcgtgggtctatctgtcacgaagccgtacgtgatcatgctcttggaggacgggaaagaaccatggatgatggaaaaaaaactgtccaaagattgggaaagccgatgggaaaacaaagaacttagtactaagaaggatatctatgatgaagacagcccccagccagtgaccatggaaaaagtggtgaagcagtcttatgagttctcaaactctaataagaacctggaatacacagaatgtgatacctttagatccacctttcacagcaaatccaccctgagcgaaccgcagaataatagcgcagagggtaactcccacaaatacgacattcttaagaaaaatctgagcaagaaatctgtcataaagagtgagcgcatcaacgggggtaaaaagttactcaattccaataagtctggcgctgcatttaatcaatcgaaatcgctgacccttccccagacttgtaaccgcgaaaaaatctatacctgtagcgagtgcggaaaagcttttggaaaacagagcatcctgtctcggcattggagaatccataccggtgaaaaaccttacgagtgccgcgaatgtggcaagacctttagccatggcagcagtttaaccaggcaccagatcagccattctggggaaaaaccatacaaatgtattgagtgtggcaaagcattcagccacggctcctcccttactaaccatcagagcactcatacaggggagaagccatacgaatgcatgaattgcggcaagtcattcagcagggtgagcctcttaatacagcatctgagaatccacacccaggagaaacgctacgaatgcagaatttgtggcaaggcttttatacattcttcctccctgattcaccatcaaaagtcccacactggggaaaagccctatgagtgccgcgaatgcggcaaagctttttgctgcagctctcacctgactcagcaccagcggatacacagtatgaagaagaagtatgagtgtaacaaatgtttgaaagtcttcagtagcttttcctttctcgtgcagcaccagtcaatccacaccgaagagaaacctttcgaggtgtag

SEQ ID NO: 61296 - DNA, 399 bp, Artificial Sequence
  Description of Artificial Sequence: Synthetic coding sequence
atgtcccaggttacatttagcgatgtcgccatcgacttctcacacgaggaatgggcgtgcttggacagcgcccaaagagatctctacaaggatgtgatggtacagaactacgaaaacctggtgagtgtggcgggactgagcgtgactaagccttacgtcattatgctcttggaggatggcaaggaaccgtggatgatggagaaaaaattgtcaaaagcctatcctttccctttgtcccactctgtccctgctagtgtaaatttcggcttctccgccctctttgagcactgcagcgaagtgaccgaaatttttgaactgagtgaattgtgcgtgttttgggtgttgcacttcttgtcaaactctcccaattcaactgttgaagcattctttaaaaagtag

SEQ ID NO: 61297 - DNA, 399 bp, Artificial Sequence
  Description of Artificial Sequence: Synthetic coding sequence
atgtcacaggtgacttttagcgatgttgccatcgatttctcacacgaggagtgggcctgcctggactctgctcaacgtgacctgtataaagacgtaatggtgcagaattatgagaatctcgtgtcggtcgctggcttgagtgtaaccaagccttacgtgatcatgctccttgaggatgggaaggagccctggatgatggaaaagaaactttctaaggcttacccatttccactgagccatagcgtgcccgcttccgtaaattttgggttttctgctttgttcgagcactgctccgaagtcacagagattttcgaactgtccgaactctgcgtgttctgggttctgcatttcctgtctaatagccccaacagcactgtagaagcctttttcaaaaagtag

SEQ ID NO: 61298 - DNA, 2001 bp, Artificial Sequence
  Description of Artificial Sequence: Synthetic coding sequence
atgcaagaagtggtacttctcgatgagagcagtggtcctccttctcagttactttggacccgccaagatacccagttgccacaggaatctgccttgttgcctgccccttatccagcctttacaaaggatggctcccaggggaatctgccgcaggcagatatcactctgatgtcgcaagcccaggaaagcgttactttcgaggatgtcgccgtaaactttacaaatagggaatggcagtgtctaacttacgctcagcgtcatctttacaaggatgtcatgctcgagaactacggcaatatggtttccctgggttttcctttccccaagcccccactcatctcccacctcgaacgcgaagtggatccttgtgtgcaagacccccaggacagggagtcgctctcttgctcttacccagtgtccgccgataaaatgtggccggaaaacgagaaagcttcgagtcagcaggaaatttttgaaaatggtgaggcatactggatgaagtttaatagccttctgaaggtcgacagcagggaccccaaagtcagagaggtctgtgtccaggatgttaaactcgagaatcagtgggaaacgagtatcagagaaaagcttagggaggaaaaagagggtagcgaagaggttacttgcaaaaagggtaaaaaccagaaagtactgtctaaaaaccttaatcctaacagtaagcactcgcagtgcaataaggtactgattgcacaaaagctccacgagtgcgcacgatgtggcaagaatttctcatggcatagcgacctgatcttacacgagcagatccattcaggtgagaagccgcatgtttgcaacgagtgcgggaaggcgtttaagaccagaaaccaactgtctatgcataggatcatacacactggcgaaaagccgttcaactgcacacagtgtggtaaggccttcaacagccgttcagccctgtgccgccataagaagactcattccggagaaaaaccgcatgagtgtagagactgtggaaaagccttcaaaacccggaacagactgtgtatgcaccagttaatccacaccggcgagaagccttataaatgtaactgttgcggaaaggccttccagttcaaacattccctgaccattcatgggaggattcataccggcgagaaaccatatgagtgcgaagaatgcggtaaggcattttcaggcagttctgacctcaccaaacacatccggattcacaccggagaaagaccctatgagtgtagtaaatgtggtcgcgctttctctaggagttccgacctgagtaaacacaagagaatccacactcgtgagaaacactatggctgcccacagtgcggcaaggatttttctattaaagccgaactcactaagcatcgcaggattcacactgaagaaaagcgctatcgatgtgaagagtgtggcaaagctttccgtcataactgtaaacgcagagcacatgagcgagaacatactggcgaaaaaccatatcagtgtagagactgcggaaaaactttccaagaccagcactgtttgacaattcatcaacgcatccataccggggaaaagccgtataagtgcctggaatgtggtaaggccttctccggcaagtcaaatctcaccaaccataggagaattcacacaggcgagaagccccacaagtgtgaggtgtgtgggatggcctttcatcattcaagcgtactgcgccagcataaacgcattcataccggcgaaaagccatacacttgctctgaatgcggcacgagtttccgccaaggctccgctctcattggccataaacgggttcataccggcgagaaaccatatgagtgtgaggagtgtggcaaggcattccgtgtcagctctaacctcacggggcataaaaaacgaaagcaccaggtttggtccacacacgagctggacggctcgcgtaaaagccttagtccagttaccgtgtcccagaccagcgtcgtctcaatcctgacctctgcctag

SEQ ID NO: 61299 - DNA, 1725 bp, Artificial Sequence
  Description of Artificial Sequence: Synthetic coding sequence
atgctggagaattatggtaacatggtctcactggggtttccttttcccaaaccacccctaattagtcatctggagcgcgaagtggacccgtgcgtccaggacccacaggatagagaaagcctgtcatgcagttatccagtgagtgcagacaagatgtggcctgagaatgaaaaggcctcatcacaacaggagatctttgagaacggcgaggcctactggatgaagtttaattccctgctgaaagtggattcacgggaccccaaggtaagggaagtgtgcgtgcaagacgtgaagctggaaaatcagtgggaaacctctattcgggagaagctgcgagaggagaaggaaggaagtgaggaagtgacttgcaaaaaaggcaagaaccaaaaggtactaagcaagaacttaaatccaaatagcaaacattcccaatgcaataaagtcttgatcgcgcagaagctacatgagtgcgcacgatgcggaaaaaacttttcttggcactcagacctgatcctgcacgaacagattcattctggggaaaaaccacacgtttgtaacgaatgtgggaaggcgtttaagactagaaaccagctcagcatgcacaggattatccatacgggcgaaaaaccatttaactgtacacagtgtggaaaagcctttaacagccgatccgctctctgtcgccacaagaaaacacattctggagaaaaaccacacgaatgtagagactgcggcaaggctttcaagactcggaaccgtttatgtatgcaccagctgattcatactggcgagaaaccttataagtgcaactgttgtgggaaagcattccagttcaagcattcgctcactattcacggacgcatccacactggtgaaaagccatacgagtgcgaagagtgcggtaaggccttttcggggagctcagacctcaccaagcacatacggatccacaccggagagcgaccatacgagtgttctaaatgcggacgggcttttagccgctcatctgacctctcaaagcataagagaatccacactagagagaagcattacgggtgcccccagtgtgggaaagatttctccataaaggccgagttgaccaagcacagaagaatacacactgaggagaagcggtacagatgcgaggaatgtggtaaggccttccggcataattgcaagcgcagggctcatgaacgcgaacacacgggcgagaagccataccagtgtagagactgcggtaagacattccaagatcaacactgtctaacaatacatcaacgcatccataccggggaaaagccctacaagtgtttagagtgcggcaaggctttctctggcaaatcgaatttgacaaatcaccggaggatccacactggggaaaagccccataagtgtgaggtctgtggaatggcattccatcactcaagcgtgctcagacagcacaagcgcatacacacaggagaaaaaccttacacctgctctgagtgtggaacatctttcagacaggggagtgccctcatcggccacaagcgcgtgcacaccggcgagaagccatacgagtgcgaggagtgtggaaaagccttccgtgtgtcaagtaaccttactgggcacaagaaacggaagcatcaggtgtggtctactcatgagcttgacggctcccgcaagagtctgtcacctgtaacagtctctcagacgtccgtcgtgtctattttaaccagtgcatag

SEQ ID NO: 61300 - DNA, 702 bp, Artificial Sequence
  Description of Artificial Sequence: Synthetic coding sequence
atgctgcgggaggaagctacaaaaaagtcgaaagaaaaggagcccggaatggcgttaccgcagggccgtcttacgttcagggatgttgcaatcgagttctccctcgaggagtggaaatgccttaatcccgcacaaagagccctttacagagcagtaatgctcgagaactatagaaaccttgaattcgttgatattagcagtaaatgcatgatgaaagagttttccagtacagcgcaagggaacacagaggtgattcacacgggcacactccaacgccacgaatctcatcacatcagggacttctgttttcaggaaattgaaaaggacatacataatttcgagtttcaatggcaggaggaggaacggaacggccacgaagccccaatgacagaaatcaaagagctcacaggctccactgaccggcatgaccagcggcacgcagggaacaaaccaattaaggatcagctggggtcctcattccactctcacctccccgagctgcatatttttcaacctgagtggaaaatcggaaaccaggttgagaaatctataattaacgccagcttaatactgacatctcagaggatttcatgcagccccaagacccgcatttctaataactacggcaataactctcttcacagcagtctgcctattcagaagctcgggagcacacacgagaggaaaatctttccaatgtag

SEQ ID NO: 61301 - DNA, 1209 bp, Artificial Sequence
  Description of Artificial Sequence: Synthetic coding sequence
atgtacacttcggaagaaaagtgcaaccagagaacgcagaagcgcaagatctacaatgtttgtccaaggaaaggcaaaaaaatttttattcatatgcacgagatcatccagattgatggacacatctatcagtgcctcgagtgcaagcagaacttttgtgagaatttggcactcatcatgtgtgaaaggacccacactggagagaaaccatataaatgcgatatgtgtgagaagacatttgttcagagctcagatttaacctcccaccagagaatccacaattatgagaagccttacaagtgtagtaaatgcgagaaatcattctggcaccatctcgccctgtctgggcatcaacgcacccacgcagggaagaagttttacacatgtgacatctgcgggaaaaatttcggacagtctagtgacctgctggttcaccaacgcagtcatacaggcgaaaaaccgtacctctgtagcgaatgtgataaatgctttagtaggagcacaaatctcatacggcaccggcgaactcataccggcgagaaacccttcaagtgtctcgagtgtgaaaaagcctttagtggcaaatcggacctcatctcgcatcaaaggactcacaccggagaacggccatacaagtgcaacaagtgcgaaaaatcttaccgacatcggtctgcttttatagttcataaacgggtccacacgggggagaagccctataagtgtggggcttgcgaaaagtgctttggtcagaaaagtgatcttatcgtccatcagagggttcatactggcgaaaaaccctacaagtgtttagagtgtatgaggagtttcacccgctccgctaatctcatccgtcaccaggccacacatacacacacctttaaatgtctagaatatgaaaaatccttcaattgttcatctgatcttattgtgcatcagcgcattcacatggaagagaaaccccaccagtggtccgcctgcgagtccggattcctcctgggcatggactttgttgctcagcagaaaatgaggacccagaccgaggagctgcattataagtacacagtatgtgataaaagctttcaccagtcctcagctctcctgcagcaccagacggtgcatataggagaaaagccgtttgtttgcaacgtatctgagaaaggattggagctcagtccaccacatgcctctgaagcatcccaaatgtcttag

SEQ ID NO: 61302 - DNA, 744 bp, Artificial Sequence
  Description of Artificial Sequence: Synthetic coding sequence
atggtaacgcaactgagatacgagtccttctgccttcaccaatttcaggagcaggacggcgaaagcattcctgaaaatcaggagttggcgtctaaacaggagatcctgaaagagatggagcaccttggagactctaagttgcagcgagacgtgtccttggatagcaagtaccgagaaacgtgcaagcgggactctaaagctgaaaagcaacaggcgcacagtactggcgagaggaggcataggtgtaatgagtgcgggaaatcatttaccaagagcagcgttctaatcgagcaccagcgcattcacacaggcgaaaagccatacgagtgtgaagaatgcggaaaggcgttttcccgcagatcttcgttaaatgaacacagacggtcgcatactggcgagaagccctatcagtgcaaagaatgcggcaaggccttttctgcgagcaacggccttactcggcataggagaatccacacgggggagaagccttacgagtgtaaggtgtgtgggaaagcttttctactatccagctgcctggtgcagcatcagaggatccacacaggcgagaaacggtaccaatgtcgagagtgcggcaaagcattcattcagaatgcaggcctttttcagcatctacgtgtgcacaccggcgaaaagccgtaccaatgtagtcagtgctcaaagctctttagtaaacgaaccctcctgaaaaaacaccagaagatccatactggagagagaccttag

SEQ ID NO: 61303 - DNA, 1653 bp, Artificial Sequence
  Description of Artificial Sequence: Synthetic coding sequence
caggtccctctgactttttctgatgtcgcaattgacttttctcaggaggagtgggaatatctaaatagcgaccagagggacctgtatcgggacgtcatgctcgagaattataccaacctggtgtcactggattttaatttcaccaccgagagtaacaagctttcaagtgaaaagaggaactacgaggtgaatgcataccaccaggagacatggaaacgcaacaagactttcaatttaatgcggtttattttcagaacagacccgcagtacactatagagtttggcagacagcaacgccctaaggtgggctgcttttcgcagatgatcttcaaaaagcataaatcgcttccactgcacaaacgaaataatacaagggagaagtcctatgaatgcaaagaatacaaaaaaggatttcggaagtacttacatctgactgaacacctcagggaccacactggcgttataccgtacgagtgcaacgagtgcggcaaagcgttcgtcgtctttcaacactttatcaggcacaggaaaatacacaccgacctgaaaccctatgagtgcaatggctgcgagaaggcctttagattctacagccagctgatccagcatcagataatccataccggcatgaaaccgtacgaatgtaagcagtgtggtaaagcatttaggcgccattcacaccttacagaacatcagaaaatacatgtggggctgaagcctttcgagtgtaaagaatgtggggaaacctttaggctctaccggcacatgtgtctgcatcaaaaaatccatcacggcgtaaagccatacaagtgtaaggagtgtggcaaggcctttggtcatagaagttcactatatcagcataagaagatacattcaggcgagaagccgtataaatgcgaacaatgtgagaaggcttttgtgcgtagttacttgctcgtggagcatcagagatcacacacgggagaaaaaccacatgaatgcatggaatgtgggaaagcctttggaaagggctcttctcttctgaagcacaaaagaatacactcatctgagaaactctacgactgtaaggactgcggaaaagctttctgccgcggaagccagcttactcagcaccagaggatacatacaggagagaaacctcatgaatgtaaggagtgcggaaaaacattcaagctacattcctacctcattcagcaccagataatccacactgatctaaagccctacgaatgtaaacaatgtggtaaagcattcagtcgcgttggcgatttgaagacccatcagtcaattcatgcgggagaaaaaccctacgaatgcaaggagtgtgggaaaacttttcgcctgaattctcagctaatttatcaccagactattcacacaggtctgaagccttatgtgtgcaaggagtgcaaaaaagcttttcggtctatcagcggactgtcacaacacaaacgcatacacactggcgaaaaaccctacgaatgcaaagagtgtgacaaggcttttaaccgcagtgaccgtttaacgcagcacgaaaccattcataccggagtcaagccgcaaaagtgtaaggagtgcggaaaggccttcagccactgttatcagctttcccagcatcagagattccaccacggtgaaaggctcctcatgtag

SEQ ID NO: 61304 - DNA, 1668 bp, Artificial Sequence
  Description of Artificial Sequence: Synthetic coding sequence
atggcgtttacacagctcactttccgggatgtggcaatcgaattcagccaagacgagtggaaatgtctgaattctacgcagcggaccctgtatagagatgtcatgctcgaaaattaccgtaacctggttagccttgacttgagtagaaactgtgttattaaggagttagccccacagcaggaggggaaccctggggaggtttttcacactgtgaccttagaacagcatgagaagcacgacatcgaggaattttgctttagggagattaagaaaaaaattcacgacttcgattgccagtggcgagatgacgaaagaaactgtaataaggtcacaaccgcccctaaggagaacctgacctgcaggagggaccagagggatcgtagaggcatcggaaataaatcaatcaaacaccaacttggtttatcgttcctgccacaccctcacgagctgcagcagttccaggctgaagggaagatctatgaatgcaaccacgtggaaaagagcgtgaaccatggatcttccgtgtcacctccacaaattatcagcagtacaatcaagacacacgtgtccaacaagtatggaactgattttatctgtagctcgttgcttacccaggagcagaagtcatgtatccgggaaaagccttatagatatatcgaatgtgataaggctttaaaccatggaagccatatgacagtccgccaggtgagtcattccggcgagaaaggatacaaatgtgatctctgtgggaaggtgttctctcagaaaagcaatctggcacgacattggcgagttcataccggcgaaaagccttacaagtgtaatgaatgcgatagaagtttcagtagaaatagctgtctcgctttgcatagacgcgtgcatacgggcgaaaagccatataaatgctacgagtgtgataaggtctttagtaggaatagctgtctcgcactgcatcagaaaacccatatcggagaaaaaccttatacctgcaaggaatgcggtaaggcgttctcagtgaggagtaccctgacaaatcatcaggtgatccattccggcaagaaaccctacaaatgtaacgagtgtggtaaggttttttcacagacctccagcctggcaactcatcagcgtattcatacgggcgagaaaccgtataaatgcaacgagtgtgggaaagttttttcccaaacttcaagtttggcacgccactggcggatccatacaggtgaaaaaccatataagtgtaacgaatgtggcaaagtgttcagctacaattcacacttagcttcccaccgacgagtccacaccggagagaagccatacaagtgtaacgagtgtgggaaagcattttcagttcatagcaacttaaccacccaccaagtgattcacactggcgagaagccgtacaagtgcaatcagtgcggaaagggtttctcagtgcattcatcactcaccactcatcaggtaatccacactggcgagaagccatacaagtgtaacgaatgcggaaagtccttttctgtccggcctaacttgactcgtcaccagataatccatactgggaagaagccttacaagtgttctgactgtggaaagtcctttagcgtgaggccgaaccttttccgacatcagataattcacaccaaggagaagccttataaaagaaactag

SEQ ID NO: 61305 - DNA, 1704 bp, Artificial Sequence
  Description of Artificial Sequence: Synthetic coding sequence
atgcctgaactatacacagaagacttcatccagggctgtgacgttggagagctccaggagcctggactgcccggattagaatgtaatggcgcaattagtgctcattgcaacctgagattacccgactctaacgattccccagcctctgcttcccgcgtagccggaattactgacctaagccgcaactgcgtaattaaggaattggccccacagcaggaagggaatcctggcgaggtgtttcataccgtcaccctggaacagcacgagaagcatgatatcgaggaattctgttttagggagatcaaaaagaagatacacgattttgactgccagtggcgggacgatgagagaaattgcaacaaggtgacaacggcgccaaaagagaacctaacgtgtcgcagggaccagagggaccggagagggatcggaaataaaagcataaagcatcaactgggtctgtcttttcttccacatcctcatgagcttcaacagttccaggccgaaggaaaaatctacgagtgtaatcatgtggagaaaagcgttaatcacgggagcagtgtttctcctccacaaattatcagctccactattaaaacacacgtgtcaaacaagtacggaacagacttcatttgctccagcctgctgacacaggagcaaaaatcgtgtataagggagaagccatatcgttacatcgagtgtgacaaagccctaaatcacggatctcatatgactgttcggcaggttagccattccggggagaagggatacaagtgcgatctatgtggcaaagttttttcccaaaaaagcaatctggccaggcattggagagtccataccggggagaaaccctacaagtgcaacgaatgcgatcggtcattttcccggaactcctgcttagctcttcatagacgggttcacacgggggaaaagccatataagtgctatgaatgtgacaaggtgttctccagaaattcttgtcttgctctgcatcaaaagacacacatcggcgagaagccctacacttgtaaagagtgcgggaaggccttcagcgtcagaagcactctaaccaaccatcaggttatccacagtggcaaaaagccgtataaatgtaatgagtgcggcaaggtttttagccagaccagttcactagctacccatcagaggattcacactggtgaaaagccatacaaatgtaatgagtgtgggaaggttttcagccaaacatccagcctcgctagacactggagaatccacaccggggagaaaccctataagtgcaacgaatgcgggaaagtattttcatataattcccacttggcctcacatcgcagggtccacactggagaaaagccatataagtgcaacgagtgtggcaaggctttctccgtgcattcgaacctgaccacacatcaggttattcacacgggggagaagccctacaaatgcaaccagtgcggaaagggattttcggtacactcctccttgaccacacatcaggtgatccataccggcgagaagccctacaagtgtaacgagtgtggaaaaagtttttcggtgaggccaaatcttactaggcatcagatcatccataccggcaaaaagccatataagtgctccgattgcggcaagtctttctcagtacggccaaacctgtttcggcatcaaatcatacatactaaggagaagccatataaacgtaactag

SEQ ID NO: 61306 - DNA, 1629 bp, Artificial Sequence
  Description of Artificial Sequence: Synthetic coding sequence
atgtgggagcaccgcaaagaaccatggacaatagagtcccaagtgcgcgttgcacggaaaccaaaagggtgggagtggatcaagggtgtgaaaactgatctgagcagaaactgtgtgattaaagaattggcccctcaacaggaagggaatcccggtgaagtgtttcataccgtaactctggagcagcacgaaaagcatgatatcgaagagttctgctttagggaaatcaagaagaaaattcatgactttgattgccagtggcgtgatgacgagagaaattgcaataaggtgacaactgctccaaaggagaacctcacctgcaggcgggaccagagagacaggcgcggtatagggaacaagagtattaagcaccagctcgggctaagctttctgccccacccacatgagttacagcagtttcaggccgaaggaaagatctacgagtgcaaccacgttgagaagtctgtgaaccacggtagctcagtcagcccgcctcagatcatcagctccaccattaaaacgcacgtctcgaacaagtatggaacggacttcatctgctcctctctgctcactcaggagcagaaatcctgtatccgagagaagccctatcggtacatcgaatgcgacaaggccctaaatcacggatcgcacatgaccgtcagacaagtgagccactcaggcgagaagggatataagtgtgacttgtgtggtaaagtgttttctcagaagtcaaacctagctcggcactggcgcgtccacacaggggaaaagccatacaagtgcaacgaatgcgacagatcattctctcgaaactcatgtcttgccttgcacaggcgcgtgcacactggtgagaagccttacaagtgttacgagtgtgataaggtgttttctcggaacagctgtttagctttacatcagaaaacccatataggcgagaaaccctacacctgtaaagaatgtggcaaggcattttctgtgagatccacattgactaaccaccaggtgattcattccggtaaaaaaccctacaaatgtaacgagtgtggcaaggtgttttcccaaaccagctccctggcaacacatcagagaattcacacaggagaaaagccttataaatgcaatgagtgtggcaaagtcttctctcagacaagcagccttgctcggcactggaggatccacactggagagaaaccttacaagtgtaatgagtgcggcaaggtcttcagttacaactcgcatctggcctcccatcggagggtccatactggggaaaagccatacaagtgtaacgaatgtggcaaggccttttctgtccattctaatctaactactcaccaagtcattcatactggtgagaaaccttataaatgcaaccagtgcggcaaggggtttagtgtgcactctagtctgaccacacaccaggttatacatacaggagagaaaccgtataagtgtaacgagtgtgggaaaagcttctcagtgcgcccaaatctcactcggcaccagattatacacaccggaaagaaaccctacaagtgttccgactgcgggaaaagtttttcggttaggcctaacctgttccggcaccagatcatccataccaaagagaagccatacaaacggaattag

SEQ ID NO: 61307 - DNA, 1812 bp, Artificial Sequence
  Description of Artificial Sequence: Synthetic coding sequence
atgcctgagttgtataccgaggacttcattcagggatgtgacgtcggcgagctccaggagccaggactgcccggtgtgctgtcctacgtgggagctcaagaacgggctctggaccacaggaaacccagcacgtcaagcaaaaagactaagcgggtcggtatggaccagcgatgtgagaatagactcgaatgtaatggggcaatctccgcccattgtaatctgcggctgccagactctaacgactcgcctgcttccgcctcgcgagtggcaggcatcaccgacctgtctcgcaactgcgtaatcaaagagctagcgccacaacaagaaggcaaccctggagaggtattccatacagtgaccctggaacaacatgagaagcatgacatcgaagaattttgttttagggagatcaaaaaaaagatccatgattttgactgtcagtggcgcgatgacgaacggaactgcaacaaagttaccactgctccaaaagagaatctgacctgcagacgtgaccaaagggaccggagggggattgggaacaagtcgattaagcaccaactgggcctcagctttcttcctcaccctcatgagttacagcagtttcaagctgagggcaaaatatacgaatgcaatcacgtggaaaaaagcgtcaatcatggcagttccgtaagtcccccacagatcatcagttccacgataaagacccacgtgagtaataagtacggaactgactttatttgttcctccctgctcactcaggagcagaagtcgtgtattcgggagaagccctatcgctatattgaatgcgataaggctctcaatcacggatcgcacatgactgtgaggcaggtgagtcactccggtgaaaagggatacaagtgtgacctctgcggaaaagtctttagccaaaagtccaacctagcacgccattggagagttcacacaggagagaagccctacaagtgcaacgagtgcgaccgcagcttctcccggaattcttgtttagcactgcacaggagagtacatactggagaaaaaccatataagtgctatgaatgcgacaaggtcttttccaggaattcctgtctggccttgcaccagaaaactcacataggtgagaagccctatacttgtaaggaatgtgggaaggccttcagcgttaggagtaccttgactaaccatcaggtgatccactctggtaagaagccatacaagtgcaatgagtgtggcaaggtgttctctcagacgtcatccttggctactcaccagagaatccatactggtgagaaaccatataaatgcaatgagtgcggcaaggtgttcagtcagactagctcccttgccagacattggcggatccatactggcgagaaaccttacaaatgcaacgagtgcggcaaggttttcagctacaattcccatctagccagccaccgtcgggtgcacaccggcgagaaaccttacaagtgcaatgagtgtggcaaggccttctccgttcactccaatcttaccactcaccaggtgatccataccggagagaagccctacaaatgcaatcaatgtgggaaggggtttagcgttcatagttctctgaccacccaccaggtgattcacaccggtgagaagccttacaagtgtaatgaatgcggtaagagcttctccgtcaggcctaacctcaccagacaccagattattcacaccgggaaaaaaccttacaaatgtagcgattgtgggaaatcgttttcagttcgccctaatctatttcgtcaccagattatccatactaaggagaaaccttataaacggaattag

SEQ ID NO: 61308 - DNA, 1812 bp, Artificial Sequence
  Description of Artificial Sequence: Synthetic coding sequence
atgcccgaattatataccgaagacttcattcagggatgtgacgtaggcgagcttcaggagccaggcttgcctggcgtcctctcctacgtgggggctcaggaacgcgctctggatcaccggaaaccctcaacgtccagtaagaagactaaaagagtgggcatggaccagcggtgtgagaatcgattggagtgtaacggtgctatttcagctcactgcaatctcagactgcccgattccaatgattcaccagccagcgcgtcccgggtcgccggaattacagacttgagccggaactgtgtgataaaagagctggccccacagcaggagggcaatccaggtgaagtgttccatacagtcacattggagcagcacgagaagcatgacatagaggaattctgcttccgggaaattaaaaaaaaaattcatgatttcgattgccaatggcgcgatgatgagaggaactgcaataaagtgaccactgccccaaaagagaatctgacttgtagacgagatcagagggatcgccgtgggataggtaataagtccatcaagcatcaattgggcctgtcttttttgccgcacccacatgagctccaacaatttcaggccgaaggaaagatctatgagtgcaaccacgttgaaaaatcagtaaaccatggaagttcagtatctccaccacagataataagttccaccatcaagacgcacgtgtcgaataagtacggtaccgactttatctgctcttccctgctgacacaggagcaaaagagctgcatacgggaaaagccctacagatacattgagtgtgacaaggccctgaatcacggttctcatatgacggtaagacaggtttcccattccggcgaaaaaggatataaatgcgacctttgcgggaaagttttttcacagaagagcaacttagccaggcactggcgggtgcacaccggcgaaaaaccctacaaatgtaacgagtgtgacagatccttcagtcggaactcctgtctggcgcttcatcgacgtgtacacaccggcgagaagccgtacaagtgttatgaatgtgataaagtcttttcccgcaattcatgtttggctttgcaccagaagacacacatcggggagaagccctatacatgtaaagagtgtggcaaagctttcagcgtcagatctacacttacgaaccaccaggttatccacagtggcaagaagccatacaaatgtaatgagtgcgggaaggtttttagccagacctctagtctggcaacacaccaacgcattcatacaggtgagaagccatataagtgcaatgagtgtggaaaagtgtttagccagacatcgtccttggccagacattggcgtatccacacaggggagaaaccatacaaatgcaatgagtgtggcaaggtgttctcctataatagccacctcgccagtcataggcgcgtgcatactggagaaaagccatataagtgcaatgagtgcgggaaggcttttagcgtccatagcaatctgaccacccatcaggtcatccacaccggggaaaagccttacaaatgcaatcagtgcgggaaaggcttcagcgttcactcatcacttacaacccaccaggtgatccacaccggcgaaaagccatacaaatgcaacgaatgtggaaaaagcttttctgtcagaccaaatttgacaagacaccagatcatccacaccggcaagaaaccctacaaatgttccgattgcggaaagtcgttcagcgtcagacccaacctgttccggcatcagatcatccacacaaaggaaaagccatataagcgaaactag

SEQ ID NO: 61309 - DNA, 1668 bp, Artificial Sequence
  Description of Artificial Sequence: Synthetic coding sequence
atggacggtgacggactgaccttcagagacgtggccatcgaattctcccaagacgagtggaagtgcctgaactccacccaacgtactctgtatcgcgatgtgatgctcgaaaattaccgcaacttggtttctttggacctaagccgcaactgcgtcatcaaagagctcgcccctcagcaggaggggaatcccggagaagtgtttcatacggtcaccttagagcagcatgaaaaacatgatatcgaggagttctgttttcgcgagatcaagaagaagatccatgacttcgactgccagtggcgcgacgacgaaagaaactgcaacaaagtaacaactgctcccaaggagaatctgacctgccggcgagaccagcgcgacagacggggaatcggaaacaagagcattaaacaccagttgggtctctcttttctccctcacccccacgagctccagcaattccaggcagaaggaaagatatatgagtgtaatcatgtcgagaaatccgtgaatcacggcagctctgtaagtcctccccagatcatcagttccactatcaagacccatgtgtctaataaatatggaaccgacttcatatgtagttctctattgacgcaagaacagaaaagctgcattagagagaagccatatcggtacatcgagtgcgataaagccctgaatcacggcagtcatatgacggtgagacaggtaagtcattcaggcgagaagggttataagtgcgatctatgtggcaaggtgttctcacagaaatcgaacctggccaggcattggagagtgcacaccggggagaagccgtataaatgtaacgaatgtgaccgcagcttttcacgtaactcttgtctcgctctccacagaagggtgcacacaggagagaaaccctacaagtgttatgagtgtgacaaggtgttcagcaggaactcgtgcctagccctccaccaaaagacgcatatcggagaaaagccttacacttgcaaagagtgcgggaaggccttttccgtgcgcagcactcttaccaaccatcaggtcattcatagtggcaaaaaaccctacaagtgcaatgagtgcggcaaagtgttcagtcagacaagcagcctggctacccatcagcgaatacacacaggagaaaaaccatacaagtgtaacgagtgcggaaaggtatttagccagacctcatcacttgcgagacactggaggatccatacaggagaaaaaccgtataagtgcaacgaatgcgggaaagttttctcttacaactctcacctggcttcacaccgaagggtccacaccggcgaaaaaccttataagtgcaatgagtgcggcaaggccttctctgtgcactctaacctgaccacccatcaggtcatccacactggcgagaaaccatataaatgcaaccagtgtgggaagggattctcagtccactcatcattgactactcaccaggtcatccatacgggcgagaagccatacaagtgcaatgaatgtggcaaaagcttttccgtgagacctaatctcactcgccaccagatcattcacaccggcaaaaaaccgtataagtgtagtgactgcggcaaatcattttcagtccgccctaatcttttcagacaccagatcattcatacgaaggagaaaccgtacaaacggaattag

SEQ ID NO: 61310 - DNA, 567 bp, Artificial Sequence
  Description of Artificial Sequence: Synthetic coding sequence
atgactgagacccgggagcctgcagagactggcggatatgccagtctggaggaagatgatgaggatcttagtcctggccctgaacattcctccgattctgaatacacccttagtgagccagacagtgaagaggaagaagatgaggaggaagaggaagaagagaccactgacgaccctgaatacgatcctggatataaggttaaacagaggctgggcggagggcgagggggaccttccagaagggctccaagagcggctcagcccccagcacagccttgtcagctgtgcgggagaagtcccttaggcgaggctcctcccggaacaccgccatgtagactttgttgtccagctacagccccacaggaggcccctgccccagaggggcgtgccctgggagaggaggaggaagaacctcccagagctggcgagggtcgaccggcagggagggaggaggaagaggaggaggaggaggaaggaacctatcattgcacagaatgtgaggatagcttcgacaacctaggagaactccacgggcattttatgcttcacgccaggggcgaggtttag

SEQ ID NO: 61311 - DNA, 375 bp, Artificial Sequence
  Description of Artificial Sequence: Synthetic coding sequence
atgacagaaaccagagagcccgcagagaccggcggatatgcttctctggaggaagacgatgaggacttgtctcccggacctgaacatagctccgactccgaatatactctgagtgagcctgactccgaagaggaagaagatgaggaagaggaagaagaagagaccactgacgaccctgagtatgaccccggatataaagtgaaacagcgactcggtggtgggcgaggcggtccatcccggcgagcaccacgggcagctcaaccacccgctcagccttgccagctctgcggccgaagtccactcggcgaggccccaccaggtacacctccttatggtgagcttggacgcaggggcggagtgggaggtggaggttag

SEQ ID NO: 61312 - DNA, 2412 bp, Artificial Sequence
  Description of Artificial Sequence: Synthetic coding sequence
atggacgtggctattgaattctgtcttgaggagtggcaatgccttgatatcgcccagcaaaatttatatagaaacgtgatgctggaaaactacaggaacctggtcttccttggcatcgcggtttcaaaaccagacctaatcacatgcctggagcaggaaaaggagccctgggaacctatgcgacgccacgagatggtagcaaagcccccagttatgtgttcacactttacacaggacttctggcctgaacaacatattaaggacccattccagaaagctacactacggagatacaagaactgtgagcacaagaatgtgcatctgaaaaaagaccataaaagcgtggatgagtgtaaagtgcacaggggcggatataatggcttcaatcagtgtctgcccgctacgcaatccaagatcttcctgtttgataagtgcgtcaaggcttttcacaaattctccaacagtaaccggcacaagatcagtcatactgaaaaaaaactgtttaaatgcaaggaatgtggaaagtccttctgtatgcttccccacctggcacagcataagattattcacacccgcgtcaatttttgtaaatgtgagaaatgtggaaaggcatttaactgccctagtattattacaaagcacaaacgaatcaacaccggagagaaaccatacacttgcgaggaatgtggtaaggtgttcaattggagctcgcgactgactactcacaagaagaattatactcggtataagttgtacaagtgcgaggagtgtgggaaagcctttaataagtcgtccatactgacgacccataagatcatcagaacaggggagaaattctataagtgtaaggagtgcgcaaaagctttcaatcagagttcaaacttgacggagcacaaaaaaattcatccaggcgaaaaaccctataagtgcgaggaatgcggcaaggcctttaactggccgtcaacacttactaagcataagaggattcatacaggcgagaagccatacacatgtgaggagtgcggcaaggcctttaatcagttctcaaatttgacgactcataagaggattcataccgccgagaaattttacaaatgcacggaatgcggagaggctttctctcgatctagcaatctaactaaacataagaaaatccacaccgaaaagaagccttacaagtgcgaggagtgtggcaaggcctttaagtggtccagcaagctcaccgagcacaagcttacccacactggtgagaagccttacaagtgcgaggagtgtggaaaagctttcaactggcctagcactctgacaaaacataaccgcattcacacgggagagaaaccatataagtgcgaggtttgcggtaaggcattcaaccagttcagtaacctgacaacccacaaacggatccacactgccgagaagccttacaaatgcgaggaatgtggaaaggcgttcagccgttcttcgaatctgacaaagcacaaaaagatccacattgaaaagaaaccttataagtgcgaggaatgtggtaaggcttttaagtggtcaagcaagttgacagaacataaaattacacatactggcgagaaaccctacaagtgcgaggaatgcggcaaagccttcaatcatttttcgatcctaactaaacacaaacgaatccataccggggaaaagccttacaagtgtgaagagtgcggtaaagctttcacacagagcagcaacctgactacccataaaaaaatccacaccggggagaagttttataaatgcgaagagtgcgggaaagctttcactcaaagttcaaacctaaccacacacaagaaaatccatacaggcggaaagccttataagtgcgaagagtgcggaaaggcatttaaccagttctctacgttaactaaacataagatcatccacaccgaagagaagccttacaaatgcgaggagtgtgggaaagcatttaagtggagctccacacttaccaaacacaaaatcatccatacgggtgagaaaccatacaaatgtgaagagtgcggtaaggctttcaaattgtccagcaccctgagcactcataaaattatccacaccggagagaagccctacaaatgcgaaaagtgcggtaaggcttttaatcggtcttcgaatttgatcgaacacaagaaaatccacactggagaacagccttacaaatgcgaagagtgcggaaaggcctttaattactctagccacttaaatactcataagagaattcacactaaagaacagccctacaaatgcaaagagtgtggtaaagcttttaatcagtactcaaacttgacaacgcataacaagattcacacgggggagaaactctacaaaccagaggacgttacagtgattctcaccactccccagaccttcagtaacataaaatag

SEQ ID NO: 61313 - DNA, 1095 bp, Artificial Sequence
  Description of Artificial Sequence: Synthetic coding sequence
atggagcgaggtaaaaaaaaacggatctccaataaactccagcagacattccaccactctaaggagcccacatttcttattaaccaggccggactgctctcaagtgattcttatagttccctcagccccgagaccgagagtgtgaatcctggcgagaatattaaaactgacacgcagaagaagaggccaggcacagtgatcctcagcaaactgagcagcaggagaataatctccgaatctcaactgagcccccctgtgattccggctcgcagaccgggtttccgagtgtgttacatttgtggccgtgagtttggctcccagtccatagccatacacgaacctcagtgcctccagaagtggcacatcgaaaattctaagctgccaaaacatctgcggcgtcccgaacccagtaagccacagtccttatcctctagcgggtcttactcacttcaggctacaaacgaggcagcatttcagagcgctcaagcacagttgcttccctgtgagtcttgcggaaggacttttctccctgatcatttactcgtgcatcatcggagctgtaagcctaagggtgaagggcctcgagcaccccatagcaactcatctgaccatctgaccggcctgaagaaggcctgctccggaacacccgctcgacctaggacagtcatttgctacatctgcggcaaggaatttgggacactgagtctaccaatccatgaaccaaagtgccttgagaagtggaagatggagaacgatcggttacccgttgagcttcatcagcccctgccccaaaagcctcaacctctgcccaatgcccagtccagccaggccggtcctaatcaggcccagctggtattttgtccccactgtagtcggattttcactagtgacagactgctggtccaccagcgctcgtgcaaaactcatccgtacgggccaaagtatcagaacctgaatctagggtccaaaggcggtttgaaagagtatactaattctaagcagcagcgaaatagagccgcaccctcagttaccgacaaggtgattcatgcaactcaggacgccctaggagaacccggtggagcgctctgtctgtag

SEQ ID NO: 61314 - DNA, 192 bp, Artificial Sequence
  Description of Artificial Sequence: Synthetic coding sequence
atggagcggggaaagaaaaagagaatttctaataaactacagcagacctttcatcatagtaaggagccaacattccttattaatcaagcagggctcctcagcagtgattcatatagttcactgagcccagagacggagagcgtgaatcccggtgagaatatcaagactgacacacagaaaaagcgcccttag

SEQ ID NO: 61315 - DNA, 111 bp, Artificial Sequence
  Description of Artificial Sequence: Synthetic coding sequence
atggaacggggtaagaagaagcgcatttcaaataaattacagcaaactttccatcactcgaaggagcctacctttctgatcaaccaagccggactccttagctctgactag

SEQ ID NO: 61316 - DNA, 4452 bp, Artificial Sequence
  Description of Artificial Sequence: Synthetic coding sequence
atgccatcagaacagaagcaactcttttgcgacgaaaagcagactactctgaagaaggattatgatgtgaaaaacgaaatcgtcgacaggtcagcgccaaaacctaagatttccggtagcattcattatgcgctgaagaacgtcaagattgacctgccaaaaatcaacatccctaacgaggtattgctcaagcacgaggtggataagtaccgcaaacttttccagagcaagcagcagaccgctcgcaagtccattagcattaaaacagtaagctgcgtggaagaatgcacccttttacacaagagcgagagagctgaggaagagggggtgaagatgagcgctaagatcctgaacttctcctgtctaaaatgtagagacaataccaggtacagtcctaatgatctccagaagcacttccaaatgtggcatcacggcgagctcccctcgtacccctgcgagatgtgcaacttcagcgctaacgatttccaagtatttaagcagcatcgtcgtacccatcgctctactctcgtgaagtgtgacatttgtaacaatgagagcgtttacaccctcctgaatttgactaagcacttcacctccacccattgtgtgaatggcaactttcagtgtgaaaagtgcaaattctccacccaggacgtgggtacatttgtacagcatatccatcgccacaatgagatccactataaatgtggaaagtgtcatcatgtctgcttcaccaaaggagaactccagaagcatctgcatatccactccggaacgtttccatttacctgccagtactgcagctatggtgcaacacgaagagagcatctcgtgagacatgtgatcaccctccacaaagagcacctctatgcaaaagagaagctggagaaagacaaatatgagaaacgcatggcaaagacaagcgcgggactgaagcttatattaaagaggtacaaaataggcgcttcgcgtaagactttctggaaacggaagaagataaacagtggtagtgaccgtagtattgaaaaaaacacacaggtgctcaagaaaatgaataaaactcagactaaatcggaggaccagtcccatgtcgtgcaggaacacctgagcgaggaaaaagacgaacggctgcactgcgaaaataacgacaaggcccctgaaagcgaaagcgaaaaaccgacaccattgtctaccgggcaggggaaccgggctgaagaggggccaaacgcttcctccggctttatgaaaaccgctgtacttggccctacgttgaaaaatgtgatgatgaaaaacaacaagctggctgtgtcacctaactacaacgctacattcatggggttcaaaatgatggacggtaaacagcatattgtgctgaagctggtgcctataaaacaaaacgtttgtagcccaggctcccagtcaggtgcagccaaagacggaacagcgaatctacaacctcagacattggacactaacggatttttgactggcgtgaccaccgaattaaacgataccgtctacatgaaagctgctacacctttctcctgctccagtagtattctgtctggaaaagcatcttctgaaaaggaaatgaccctcatttctcagcgcaacaatatgcttcaaaccatggactacgagaagtccgtcagcagcctgtccgccacctccgagctggtgacagcttcagtcaatctgacaacaaagtttgaaacgagagataacgtagacttttggggcaatcatctgactcagtcccaccctgaggtgctcggtaccactattaaatctcctgacaaagtgaattgcgtggccaaaccgaacgcgtacaactcaggcgatatgcacaattactgcattaactacggtaattgcgaattacccgtcgagagcagcaaccaggggagtttgccattccataattactcaaaagttaataactctaataagcgtagaaggttttccgggaccgccgtctacgagaatccacaacgggagagttccagctctaaaaccgtggtccagcaacccatcagtgagtcattcctatctctggtaaggcaagagagcagtaagccggattcccttctggcaagcatcagtctgctgaatgacaaagatgggaccttaaaagccaaaagtgaaatcgaagagcaatacgtgctggagaaaggacagaacatcgacgggcaaaatctctacagcaacgaaaatcagaatcttgagtgtgcaaccgagaagagtaagtgggaggactttagtaacgtagatagtcctatgatgcctcgtatcacatccgtcttttctctgcaaagtcagcaggccagtgagttcctccctccagaagtgaaccagctcttgcaggatgtacttaagatcaaacccgatgttaagcaggattcaagcaacacaccaaataaagggctgcctcttcactgtgaccagagttttcagaagcacgagcgggaagggaaaatcgttgagagttcaaaggatttcaaggtgcagggcatatttcccgttccccctgggtctgtggggattaatgtgcccaccaatgacttaaatttgaaattcggcaaagagaagcaggtgagctcaattccccaagacgtgagggattccgaaaagatgccgaggattagcggatttggcacactcctgaaaacccagtctgatgcgattatcacacagcagctggtgaaagataagttgcgggcaaccacccagaaccttggttcattctatatgcagagtcctttactgaattcagaacagaagaaaacaatcattgtgcagacatctaaaggattccttattccgctgaatattaccaacaagcctggtttgccggtcatccccggaaatgctctcccgctagtgaattctcaggggattcctgcaagtttgtttgtgaataaaaagcccggtatggttctaactctaaacaacggcaagctggaaggtgtctcagcagtgaaaaccgagggtgctcccgctcgcggtactgtgactaaggagccatgtaagaccccaatcttaaaggtcgagcctaataataactgtctcacacctggcctgtgcagttccatcggatcatgtttgtccatgaagtccagctctgagaatactttacctttgaaagggccatacattctgaagcctacgagtagcgtgaaagcagtgctgattccaaacatgctgtcagaacagcagtctaccaagcttaatatcagtgactctgtgaagcagcagaacgaaatttttccaaaacccccactttatacctttctcccagacgggaagcaagctgtgttcctgaagtgcgtcatgcccaataaaacagagttgcttaagcccaaactcgttcaaaatagtacgtaccagaatatacagcctaagaagcctgaaggcacaccgcagcgaatactgctaaaaatcttcaatcccgtattgaatgtcaccgcagccaacaacctgtctgtctcaaactcagctagttcgctgcagaaagacaacgtaccttccaaccagattatcggcggtgaacagaaggagcctgagagtagggatgccttacctttcctgctagacgacctgatgcccgcaaatgaaatcgtgattaccagtactgctacgtgtcccgaaagcagcgaggagcccatctgcgtgtccgactgttccgaaagccgcgtgctgcgatgcaaaacaaactgcagaatcgagaggaatttcaacaggaaaaagacttcaaaaaagatctttagcaaaaccaagacccatggtagcaaagactccgaaaccgcgttcgtctccaggaataggaattgcaagcgcaaatgtagagattcatatcaagagccccctagacggaaagccacgctgcacagaaaatgtaaggagaaagccaaacctgaagacgtgagggaaacattcgggttctcaagaccaaggttgtctaaggatagcatcaggacattgcgtctgttccccttctcttctaaacagctggtaaagtgccctagacggaatcaaccagttgtagtgctgaaccatcccgacgctgatgcacctgaggtagtgagtgttatgaaaaccattgctaagtttaatgggcatgtgctaaaagtgagcctcagcaaacgcacaattaacgctctgctgaagcctgtgtgctataaccctcccaagacgacatacgatgatttctctaagcgacataaaacattcaagcccgtttccagcgtgaaggaaagatttgtgctgaagctgaccctcaagaaaacttctaaaaacaactaccagatcgtgaagacaaccagcgagaacatactcaaggctaagttcaactgttggttctgcggaagagtgttcgacaaccaggatacctgggcagggcacgggcagcggcaccttatggaggctacccgggactggaacatgttggagtag

SEQ ID NO: 61317 - DNA, 1734 bp, Artificial Sequence
  Description of Artificial Sequence: Synthetic coding sequence
atggccgttggtctctgtaaggccatgagccagggacttgttacttttcgggacgtggcccttgattttagccaagaagaatgggagtggctgaagccctcacaaaaggatctgtatcgcgacgttatgctagaaaattatcgcaacctggtttggcttgactgggaaagttggtgtgagatagaggagttgtctccaaagtggtttatcgacgaagacgagatttcccaggaaatggttatggaacgtctcgcaagccacggcctggagtgttccagttttcgcgaggcatggaaatacaagggcgaattcgagttgcaccagggtaatgccgagaggcactttatgcaggttactgctgtgaaggaaatctctaccggcaaacgggataatgagtttagtaatagcggacgatccatacccctcaaatctgtgtttttgacacagcaaaaggtgcctacgattcagcaggtccacaaattcgacatatacgataaactgttcccgcagaattctgtgattattgagtacaaacgcctccacgccgaaaaagagtcactgattggcaatgaatgcgaagagtttaaccaaagcacatatctgtcaaaagacattggcatcccacccggagaaaagccttacgaatctcacgacttctcgaaattattgtccttccacagtcttttcactcagcatcagacaactcacttcggaaagttaccccatggctacgacgagtgtggggacgcattctcatgttactccttttttacgcagccccagcgaatccactccggagagaaaccctatgcctgtaatgactgcggaaaggctttctctcacgactttttcctgtccgaacatcaacgcactcacataggcgaaaaaccttatgagtgtaaggagtgcaataaggctttcaggcagagcgctcatctcgcccagcatcagaggattcatacaggtgagaagccattcgcctgtaacgaatgcgggaaggcctttagcagatatgcattcctcgtggagcaccagcggatacataccggagaaaaaccttatgagtgtaaggaatgtaataaagcttttcgccaaagcgcacatttgaatcagcatcaaaggatccacacaggggaaaagccctatgaatgcaaccagtgcggaaaggcattctcaagaagaatcgcattaacactgcaccagagaattcatacgggcgaaaagccgtttaagtgtagtgagtgcgggaagacattcggctatagaagccacctgaaccagcatcaaaggatacacacaggggagaaaccctatgaatgtataaagtgcggtaagttcttccgaacagacagccagctaaatagacaccatcgcatccacaccggtgagcggccattcgaatgttcaaagtgtggtaaagcattttctgatgccttggtgttgatccaccacaaaagatctcacgccggtgagaagccctacgagtgtaacaagtgcggaaaggcattctcttgcggttcatatctaaaccaacaccaacggatacatacaggcgaaaagccttatgagtgtagtgagtgcgggaaagcttttcatcaaattctcagcttgcgcctgcatcaacgcatccacgccggtgaaaaaccatacaagtgtaacgaatgcgggaacaatttcagctgtgtaagtgccctacgcagacaccagagaatacacaaccgagagacgctctag

SEQ ID NO: 61318 - DNA, 1830 bp, Artificial Sequence
  Description of Artificial Sequence: Synthetic coding sequence
atggctgtaggcctgtgcaaagctatgtctcagggcctggtgacattccgggatgtggctctggatttttcccaggaggagtgggagtggctgaaaccttctcagaaagatctgtaccgcgacgtgatgctcgaaaattaccgtaatcttgtatggctaggattgagtattagcaagcccaatatgatcagcctgctggaacagggaaaagagccatggatggttgagcgcaaaatgtcccagggtcactgtgctgattgggaatcctggtgtgaaattgaggagctcagtcccaaatggtttatagacgaagatgagatctctcaggagatggtcatggagcggcttgccagccatggtctggagtgtagcagcttcagagaagcatggaagtacaaaggagaattcgaactgcatcaggggaacgcagaacgccatttcatgcaagtgacagccgtaaaagagatcagcacagggaaaagggataatgagttcagcaattctggacgcagcatcccattaaagtcagtgttcctgactcagcagaaagttcccacaatccagcaagtgcacaaatttgacatctacgacaagctgtttcctcagaactccgttattattgagtataagcggctacatgctgaaaaagaatcactaattggcaacgagtgcgaagaattcaaccagagtacgtacttgtctaaggacattggaattcctcctggcgagaagccatacgagagccacgactttagcaaattgttatcattccactccctgttcacacaacaccagactacccattttggcaagctccctcatggttacgacgagtgcggcgacgcctttagttgttatagcttcttcacccagccccaaaggattcattctggcgaaaaaccctatgcctgcaatgactgtggcaaagctttctcacatgatttcttcctttctgagcatcaacgcacacacattggggagaaaccctatgaatgtaaggaatgtaataaggccttcagacagagcgcccacctggctcagcaccagaggatccatactggcgagaagccctttgcatgcaacgagtgcggtaaagccttctcaaggtacgcctttttggtagaacatcagcgtatccacactggagagaagccatatgagtgcaaggaatgcaataaggctttccgacagtctgctcatttaaatcagcaccagagaattcacaccggggagaagccatatgagtgtaaccaatgtgggaaagccttcagccgacgcatcgccctcaccctgcaccagcgaatccacaccggcgagaaaccgtttaaatgcagtgagtgcgggaaaaccttcggatatagatcacaccttaaccagcaccagcggattcatactggggaaaagccttacgaatgtataaagtgtggaaagttctttcggactgatagtcagctcaaccgccaccatcgcattcataccggagaacggcctttcgagtgtagcaaatgcggcaaggctttctccgacgcgctggtgctcattcatcataagagatctcacgccggtgagaagccgtacgagtgcaataagtgcggtaaggcctttagttgcggcagctatctgaaccaacatcaacgaattcacactggggagaagccctatgaatgcagtgagtgcggcaaagcctttcaccaaattctgagtctgaggctgcaccagaggattcacgccggagaaaagccttacaaatgcaatgaatgcgggaacaacttcagctgcgtttcagccctgcgcagacatcagaggatccacaatagggagaccctgtag

SEQ ID NO: 61319 - DNA, 1674 bp, Artificial Sequence
  Description of Artificial Sequence: Synthetic coding sequence
actggcctctcaataagtaaacctaacatgatctcacttctcgagcaggggaaagagccttggatggtggaaagaaaaatgtcccagggacactgtgccgactgggaaagttggtgcgagattgaggagctttcccctaagtggtttattgatgaagacgaaatatcccaagaaatggttatggagaggctggctagccacgggctggaatgttccagttttcgagaagcctggaaatacaagggggagttcgaattacaccaagggaatgcagaacgacacttcatgcaggtgaccgcagtgaaggaaatttccaccggaaagagggataacgaattcagcaactcaggacgtagcattcctctgaagagtgtgttcctgacccagcagaaggtgccaactatacagcaggtgcataagtttgacatctatgataagctctttcctcagaatagtgtgatcattgagtataagaggctgcatgcagagaaggaatccctgattgggaatgagtgtgaggagtttaatcagagtacatatctttccaaagatatcggcatcccccctggcgagaagccgtatgagtcccatgatttctctaagctgctcagctttcatagcctgtttacacagcaccaaaccactcattttgggaaacttccccatgggtatgacgagtgtggggatgcattctcatgttactcctttttcacacagcctcagagaatacactctggagagaagccatacgcctgcaacgactgcggtaaggcatttagccacgacttttttctatctgagcatcagcggacacacattggcgagaagccttacgagtgcaaggagtgtaacaaggctttccgccagagcgcacatctcgcacagcaccagaggattcatacaggcgagaagccctttgcatgtaatgagtgcggcaaggccttctcccgatacgccttcttagtagaacaccagagaatccatacaggggagaaaccctatgagtgtaaagagtgtaataaagcctttaggcagagtgcacaccttaaccagcatcagaggattcacactggtgagaaaccatacgaatgtaaccaatgtggcaaggccttcagtcggaggattgctcttactttgcatcaacgcatccatacaggggagaagccttttaaatgttccgagtgcgggaagacatttgggtatcgcagtcatctgaatcagcaccagcgtatccatactggtgaaaaaccctacgaatgcatcaagtgcgggaaattctttcgcacagactcccagctcaatagacaccaccggatacatacaggagagcggcctttcgagtgttccaaatgtgggaaggcattctccgatgctttggtcttaattcatcataagcgatcccacgcaggcgagaaaccatatgagtgcaacaaatgcgggaaagccttctcctgtggctcctatctcaatcagcatcaacggattcataccggcgaaaagccctacgagtgctctgagtgcggtaaagcattccatcagattctttctttgaggctgcatcaacgaatccacgctggggagaaaccatataagtgtaatgaatgtgggaataacttcagctgtgtgagtgcactcaggcggcaccagcgcatccacaatcgcgagaccctctag

SEQ ID NO: 61320 - DNA, 1692 bp, Artificial Sequence
  Description of Artificial Sequence: Synthetic coding sequence
atggccaactcttcatttatcggtgaccacgtacacggggctccccatgccgtgatgcctgaggtggagtttcccgatcagttctttactgtactcactatggatcacgaacttgtcaccctacgagacgtcgtgatcaacttcagtcaggaagagtgggaatatctagattccgctcaacgtaacctttactgggacgtgatgatggagaattactctaatctgttgtctttggatcttgagagcaggaatgagactaagcacttgtcggtcggcaaagacattattcagaacacagggagccaatgggaggtgatggaaagctctaagttgtgtggcctcgaaggatctattttccgaaacgattggcaatccaagagcaaaattgacctgcagggacccgaggtgggctatttcagtcaaatgaaaatcatctccgagaacgtgccaagctataaaacccatgagtcgcttacactaccgaggcgcactcacgactccgaaaaaccgtacgaatataaggagtatgagaaggtctttagctgcgacttagaatttgacgaataccagaaaattcacactggtggtaaaaactacgaatgcaatcagtgctggaaaacttttggtattgataacagcagtatgctacaactgaacatccacaccggtgtcaaaccttgtaagtacatggaatatggaaatacgtgctccttctacaaagatttcaatgtgtatcaaaagattcataatgagaaattttataagtgtaaggagtaccgcagaacctttgagagagtgggcaaagtcaccccactacagagagttcacgacggagaaaagcacttcgaatgctcattttgtggtaaatccttccgcgtgcacgctcagctgactcgccatcagaagatacacactgacgagaagacttacaaatgtatggaatgcgggaaggacttcagattccatagccaactcacagagcaccagcgaattcataccggtgagaagccttacaaatgcatgcattgtgaaaaggttttcagaatctcctcacagctgatcgagcaccaaagaatccataccggagagaagccctacgcatgcaaagagtgtgggaaggccttcggagtctgtagagaactggctaggcatcagagaatacacactggaaagaagccttacgagtgtaaggcatgcggtaaggtattccgcaactcttcaagcctcactcggcatcaaagaatccatactggggagaaaccctataagtgcaaggagtgtgagaaggcattcggcgtgggctctgaactgacaagacacgaaaggattcattccgggcaaaaaccttacgagtgcaaagaatgtggcaagttcttcaggttgacaagcgctctgattcagcaccagagaattcatagtggagagaagccatacgagtgcaaggtctgtgggaaggcttttcgacatagctctgcattaacggagcaccagcgaattcacaccggcgaaaagccttatgaatgtaaggcctgtggcaaagcattccggcactcaagcagctttaccaagcaccagcgaattcacacagacgacaaaccatatgagtgcaaagaatgtggtaattcgttctctgtggtagggcatcttacatgccagcctaaaatctatacaggcgagaagagtttcgactag

SEQ ID NO: 61321 - DNA, 1692 bp, Artificial Sequence
  Description of Artificial Sequence: Synthetic coding sequence
atggcaaactcgagtttcattggcgaccacgtgcacggtgccccacacgccgtcatgcctgaagtagaatttccagaccagttcttcaccgtgctcactatggatcacgagctcgttactttaagagatgtggttatcaatttctcccaagaggaatgggaatatctggacagcgctcagcggaatctttattgggatgttatgatggaaaactactccaacctgctaagcctggatttagagagcaggaatgagacaaaacatctctcggtagggaaggacattattcaaaacaccggttcccagtgggaggtcatggagtcgtccaagctgtgtggccttgagggctctatctttcgtaatgattggcagtctaaatccaagatcgaccttcagggtcccgaggttggatacttctctcagatgaagattattagcgagaatgtaccaagttacaagacacacgaatccctgactctgcctagacgtactcacgactccgagaaaccatacgagtacaaggagtacgagaaagtgttttcttgtgacctggagtttgatgagtaccaaaagattcatacaggagggaagaactatgaatgcaatcagtgctggaagacattcggcattgataacagctccatgctgcagctgaacatccacactggagtcaagccttgtaagtacatggagtatggaaatacctgttcgttttacaaagatttcaacgtataccagaagattcataatgagaaattctacaaatgcaaagagtatagacgcactttcgagcgagtgggcaaggttacacccctgcaacgagttcacgatggagagaaacactttgaatgctctttctgcggcaaatcattccgcgtacatgcccaacttacaagacaccagaaaatccacacagatgagaaaacctataagtgtatggaatgcggtaaggattttaggttccactcccagctcactgaacatcagagaattcacactggagagaaaccatacaaatgtatgcattgtgaaaaggtttttcgtatctcaagtcaacttattgagcatcagcgaatccacacaggggagaagccttacgcttgcaaagagtgcggtaaagcctttggtgtctgtcgcgagttggctcgacatcagcggattcacaccgggaaaaagccctacgaatgtaaggcttgtggaaaggtgtttagaaactcatctagtttaacaagacaccagcgtatccatactggcgaaaaaccatacaaatgtaaggaatgtgagaaagcctttggcgtgggatcagaattaaccaggcacgagcgaatccattctggacagaagccctatgaatgcaaggagtgtgggaaattttttagacttacctctgcccttatccagcatcagaggattcacagtggcgagaagccatacgaatgcaaggtgtgcggtaaagcgttccgacacagctctgccctgaccgagcatcaaaggatccacaccggcgagaagccttatgagtgtaaagcttgcggcaaggcattccgacactcaagttcgttcacgaagcaccaacggattcatactgacgacaaaccttatgaatgcaaggaatgcggcaactcgttctccgtagtggggcacttaacctgtcagcccaagatatacaccggagagaagagctttgattag

SEQ ID NO: 61322 - DNA, 1209 bp, Artificial Sequence
  Description of Artificial Sequence: Synthetic coding sequence
atggctgccgtcatcctcccatctactgcagcaccatcctctcttttccccgcaagtcagcagaaagggcatacccaagggggagaattagttaacgagctgctgacctcttggttgaggggcctggtcaccttcgaggacgtggcagtggagttcacacaggaagagtgggcactgctcgaccctgctcaaagaactctataccgggacgttatgcttgagaattgcaggaatctggcttctctggggtgcagagtcaataagccctccttaattagccagcttgagcaggataagaaggttgttacggaggagaggggcattctaccatctacctgtcccgatctggagacgttactgaaggcaaaatggcttacgcccaagaaaaatgtttttcgcaaagaacagtcaaaaggagtcaaaaccgaacggtcacatagaggagtaaaattgaacgagtgtaatcagtgctttaaagtgttctctacaaagtcaaatctcacccagcacaagcgaatccatacaggggagaaaccctacgactgttcccaatgcggaaagtccttctcatctcgcagttacttgaccatccataaacggatccacaacggggagaagccctatgagtgtaaccattgcggcaaagccttctctgacccaagcagtcttcgcctccaccttcgcattcatactggagaaaagccatatgagtgcaaccagtgtttccacgtgtttcgcacatcctgtaatctcaagtctcacaaacgtatccacaccggggaaaatcatcacgagtgcaatcaatgtggaaaagccttcagcacccgctcctcgctcaccggacacaattcaatccatacaggcgagaaaccctacgagtgccacgactgtggcaagacctttcgtaagtcatcttacctaacacaacatgttagaactcatacgggggaaaagccctatgaatgtaacgaatgtggaaaaagcttcagctctagcttctcacttaccgtccataaacgtatccataccggtgagaaaccctacgaatgctctgactgtggaaaagcgttcaataatctgagtgccgtaaagaagcacttgcggactcacaccggggaaaagccatatgaatgtaatcactgtgggaagtctttcacgtccaactcttacctctctgtacacaagagaatccataacaggtggatctag

SEQ ID NO: 61323 - DNA, 1098 bp, Artificial Sequence
  Description of Artificial Sequence: Synthetic coding sequence
atgagggagaagtcttttcaatgcaatgagacaggcgaagcatttaactgttcatctttcgtaaggaaacaccaaataatccatttaggtgaaaaacagtacaagttcgacatttgcggcaaagtcttcaacgagaagagatatttggcccgtcatcgcagatgccatacttctgagaaaccttataaatgtaacgagtgtggtaaatcgttctcatacaagagctccctaacctgtcacagaagatgccacacaggcgagaagccctataagtgcaacgaatgcggaaagtctttcagttacaaatcttcccttacctgccaccaccggtgtcacactggggaaaaaccgtacaaatgtaatgagtgtggcaagtcattttcttacaagtctagcttacggtgtcatcggaggcttcacacaggtattaagccatataaatgtaatgagtgtgggaaaatgtttgggcagaattcaaccttggtaatacataaagcaatacacacaggcgaaaagccctacaagtgtaacgagtgtggcaaagcatttaatcagcagagccacctatccagacatcacagactacatacaggtgagaagccatacaagtgtaatgactgcggaaaggctttcattcaccagagctcgctggctcgacatcacaggctgcacactggcgaaaaatcgtacaaatgcgaagaatgtgacagagttttttctcaaaaatctaatctcgagcggcacaagataatacacactggggagaaaccgtacaagtgcaacgagtgtcacaaaacgttttcccatcggtcctctctgccctgccatcggagactacactcaggcgaaaaaccctacaaatgcaacgaatgtggcaagacctttaacgtgcagtcccacctatcccgtcatcaccggctacacaccggggagaagccttataaatgcaaggtttgcgacaaagcatttatgtgtcatagctatctggcgaatcacacaaggatccacagcggagagaaaccttataagtgtaatgagtgcgggaaggcacacaaccatttgatcgactcgtccattaaaccgtgtatgagcagttag

SEQ ID NO: 61324 - DNA, 1773 bp, Artificial Sequence
  Description of Artificial Sequence: Synthetic coding sequence
atgcttcacgaggaagccgctcagaaaagaaaaggaaaagaacccggaatggccctgcctcaaggacgcctgaccttccgggatgtggcaattgagtttagtctggccgaatggaagttcctgaaccccgcacagagagctctttatcgggaggtgatgctggaaaactatcggaacctcgaagcagtcgatatatcttcaaagaggatgatgaaggaagtcctctccacgggtcagggcaatactgaggtcattcataccggaatgctccagcgccatgagtcttaccataccggagatttttgttttcaggaaattgaaaaggacatacacgacttcgagtttcagtcacagaaggacgagcgcaacggccacgaggccagtatgcccaagataaaggaactgatgggatccaccgatcgccatgatcagagacacgctgggaacaagccaataaaggaccagctggggctctccttccacctgcacctccccgaactgcacatattccagccagaagaaaaaattgccaatcaggtcgagaaaagcgtcaacgacgcatctagtatttctacatcccagagaattagctgtcgtccggaaacccatacaccaaacaattatggcaacaattttttccatagctccctgctgacacagaagcaggaggtgcacatgcgcgaaaaatcgttccaatgcaatgaaacgggcgaggccttcaactgttctagtttcgtgaggaagcatcagattattcacctcggtgaaaaacagtataagttcgatatttgtggaaaagtgttcaatgagaagcgatatctcgccagacatcggagatgtcatacatctgaaaagccgtataagtgcaacgagtgcggcaagtccttctcatataagagttctttaacctgccaccgaagatgtcacaccggcgaaaaaccatacaagtgtaatgagtgcggtaagtcttttagctataagtcatctttgacttgtcaccatcgttgccatacaggagaaaagccctacaagtgcaatgaatgcggaaagagctttagctataagtcttccctgagatgccacagaagactgcatactggaattaagccctataagtgcaacgagtgtggaaagatgtttggccaaaacagtacgttagtgatccacaaggccatccacaccggagagaagccttacaagtgcaacgagtgcgggaaagcgtttaaccagcagtcccacctgtcccgccaccaccgcctgcatacaggagaaaagccatacaagtgcaacgactgtgggaaggctttcatccaccagtcttctctggctcgacaccaccgactccatactggagagaaatcatataagtgtgaggaatgtgaccgtgtcttcagccagaagagtaatctggaacgtcacaaaataatacatacgggagagaaaccctataagtgtaatgaatgtcataagactttttcgcacaggtcttcattgccatgccaccgacgactgcacagcggtgaaaagccttacaagtgcaatgaatgcggaaagacttttaatgtccagagccatttatcccggcatcacagactgcatacaggcgaaaagccttataaatgcaaagtgtgcgataaagcgtttatgtgccattcgtacctagccaatcatacacgaatacattcaggagaaaaaccttataaatgtaatgaatgcggaaaagcccataaccacctcatcgattcttccataaaaccctgcatgagcagctag

SEQ ID NO: 61325 - DNA, 1773 bp, Artificial Sequence
  Description of Artificial Sequence: Synthetic coding sequence
atgttacatgaggaggctgcccaaaaacgtaaaggcaaggagcccggaatggccctgcctcagggccgactcacattccgcgacgtggctatcgagttttcgctggccgaatggaaattcctgaatcctgctcagcgagccctatatcgggaagtgatgctggagaactacaggaatctcgaagccgtggacataagttcaaagcgtatgatgaaagaggtactatcaacaggacaggggaacacagaggtgatacacacggggatgctgcagcgacacgagagctaccatactggtgacttttgctttcaggagattgagaaggatatccatgacttcgaattccagtcacagaaggatgagagaaacggtcacgaggccagcatgcctaagattaaggaacttatggggtccacagaccgacatgatcagaggcacgctgggaataagcccatcaaggaccaactggggctctctttccacctgcatctccccgaactgcacatttttcagcccgaggaaaagatcgccaaccaggtggagaaaagcgtcaacgacgcctctagcatctccacttctcaacgtataagctgtcgccctgaaacacataccccgaacaattacggcaataattttttccactcaagcctgctcacacagaagcaggaagtgcacatgcgtgaaaaaagcttccagtgtaatgaaacgggtgaagccttcaattgcagttcttttgtaagaaagcatcagatcattcacctcggagaaaaacagtataagtttgatatctgtggcaaggtgtttaatgagaaacgttatctggctcgccacagacgctgccacacaagcgaaaagccatataaatgtaatgaatgcggaaagtcattctcatacaaatcatctttgacctgccaccgaagatgccacaccggtgagaaaccctacaagtgcaacgaatgtgggaaaagcttctcttacaagtccagcctgacatgccatcacaggtgtcacacgggcgagaagccctataaatgcaacgagtgcgggaaatcattcagctacaaatctagcctgagatgccaccggagactgcacactggcataaagccctacaaatgcaacgagtgcgggaagatgttcggacaaaactccacattagtgattcacaaagccatccatacaggagaaaaaccatataagtgcaacgagtgtggtaaagcctttaaccagcagtcacacctgagtcggcatcaccggctgcatacaggggaaaagccttataaatgcaatgattgcgggaaagctttcatccatcagagttctctggccaggcatcataggcttcacactggagagaagtcttacaaatgcgaggaatgtgaccgtgttttcagccagaaaagtaatctggaaaggcacaagatcattcataccggagagaagccatataagtgtaacgagtgccataaaaccttttcccaccgatcatccttgccatgccatcgcaggctacacagcggtgagaaaccatataaatgtaacgagtgtggcaaaacatttaatgtacaaagccacttgagtaggcatcaccgccttcacacaggtgaaaaaccgtacaaatgtaaagtgtgcgataaggcgttcatgtgccattcatatctggccaatcatacgcggattcacagcggcgagaaaccttataaatgtaacgaatgtgggaaggctcacaatcatttgatcgactcaagcattaaaccatgcatgtcttcctag

SEQ ID NO: 61326 - DNA, 279 bp, Artificial Sequence
  Description of Artificial Sequence: Synthetic coding sequence
atggaactagtgacttttcgtgacgtcgccattgaatttagcccagaggaatggaaatgcctggaccctgcacagcagaatctgtatagagatgttatgttggaaaattacaggaacttggtaagtctggggttcgtgataagcaatccggatctggttacctgccttgagcagattaaggagccttgcaatctaaaaatccatgaaacagcagctaaacctcctggttccgaccttcaggtatacaaggaatcacagtgtcccctgtataggctttag

SEQ ID NO: 61327 - DNA, 2715 bp, Artificial Sequence
  Description of Artificial Sequence: Synthetic coding sequence
atggccgcagcaggaggagccgaggggagaagagctgatatggaggccgaggccgctgcagctccagaacgcgaaggtggcagctgtgtgctgtgctgcggcgacttagaggctacagcgctggggaggtgcgatcaccctgtttgctaccgttgcagcacaaaaatgagagtattatgtgaacagagatactgcgctgtttgccgggaggagctgcggcaggtggtctttggcaaaaaattacctgcctttgcaaccataccaattcatcaattgcagcacgaaaagaagtatgatatctacttcgccgacggaaaggtgtacgctctgtaccggcaactccttcagcacgagtgtccaagatgccctgaactgccgccatttagcttgtttggggatctggagcagcacatgagaagacagcatgagctgttttgctgtcgtctctgtttacagcaccttcagattttcacatacgagcggaaatggtactcccgcaaagacctggccagacatcgtatgcaaggggaccctgatgacacttcacaccggggacacccgttgtgcaagttttgcgatgaaaggtatctggataacgacgagttgctgaaacacctgcgcagggaccactatttctgtcatttctgcgattctgacggcgctcaggattattacagtgattacgcttatctgagggaacatttccgcgagaaacattttctttgcgaggaaggccgttgctcaaccgaacagttcacacatgcattccgaactgaaatcgacctgaaagctcaccgaaccgcctgtcattcacgttctcgggcagaggcgcgacagaaccggcatattgacctacagttttcttatgccccacggcacagccgtaggaacgagggcgttgtaggaggcgaggactacgaagaggtggatcgctactcaagacagggaagggttgccagggcaggtacccgaggggctcagcaatcaagaaggggaagttggaggtacaaaagggaagaggaagatagagaggtcgctgcagcggtgagagcaagtgtggcagctcagcaacaggaagaagcccgtcgatccgaagatcaggaagaggggggtaggccaaagaaagaggaagcagcagcacgcggtcctgaggacccacgcggacctagaaggtcaccacggacccagggagagggtccgggacccaaggaaacatccactaatggcccagtgtcccaggaggcattctcagtaacgggccctgccgcacccggttgtgtgggagtgccgggagctctaccgccaccttctcccaaactaaaggacgaggattttccctccctatccgcgagcacctcctctagttgttctacagccgctacccccggaccagtaggcctggctctgccttatgcaatcccagccagggggcgatctgcattccaggaggaggacttcccagcactggtgtcatcggttcccaaacctggcacagcccctacatcattggtgtcagcctggaattcctcaagtagttctaagaaggtggctcagcctcccttgtccgctcaggctacgggatctggacagcctactagaaaagctggcaagggttctagaggaggtcgaaagggcggaccacccttcacccaggaagaggaggaggacgggggaccagctctgcaggagctcctcagtacccgaccgactggaagcgtgtcatcaacactgggactcgcttccattcaacccagcaaggtaggaaaaaagaagaaagtgggcagtgaaaaacccggaaccaccctcccacagccccctcctgctacatgccccccaggagctttgcaagccccagaggctccggcttcaagggcggaaggcccagtcgccgtcgttgttaacggccatatggaaggccctgcaccagcccgttcggccccaaaggagccccctggtcttccgagacccctggggtcttttccttgtcctacaccacaagaggacttcccggcactgggcggtccatgcccaccaagaatgccgcctccaccgggattctcagcagtggttttacttaagggaacaccccctcctcccccacctggactggtcccacccatttccaagccacctcccggattcagcggtctgctgccatctcctcaccctgcatgtgtgccatctcccgctactaccacgacaaccaaggccccacgtctgcttccggcaccgagggcttatctggtgcctgagaacttcagggaacgtaatctgcaattgatacagtctatcagggactttctccagtcagatgaggccagattcagcgaattcaaatctcatagcggagaatttcggcagggattgatctcagctgctcagtactataaatcttgcagagaccttctaggtgagaacttccagaaggtgttcaatgagctgcttgtgttgctgcccgacacagctaaacagcaggaattgttatccgcacatactgacttctgtaatagagaaaagcccctcagcactaaaagcaaaaaaaacaagaagagtgcctggcaagcaacaacccagcaggcgggtctggactgccgggtatgtccaacttgccagcaggtactggcccatggtgacgccagctcccatcaggcgttgcacgctgcccgagacgatgactttccatcattacaagcaatcgcaaggattataacctag

SEQ ID NO: 61328 - DNA, 2550 bp, Artificial Sequence
  Description of Artificial Sequence: Synthetic coding sequence
atgcgcgtgctgtgtgaacagaggtactgtgcagtttgccgcgaggaactgcggcaggtggtttttggaaaaaagctgccggctttcgcaacaattcccatacaccagcttcaacacgagaaaaagtacgacatctactttgccgatggcaaagtgtacgcactgtacagacagttgcttcagcatgagtgtcctcggtgtccagaactgccacccttttccctgttcggggatttggaacaacacatgagaaggcagcacgagttgttttgctgcagactgtgtctacagcacctgcagattttcacttacgagcgaaaatggtactcaaggaaggacttggctcggcacaggatgcaaggcgaccctgacgacactagccatagagggcacccgctgtgtaagttttgcgacgaaagatacctggataatgacgagcttctgaaacacctgcggagggaccactacttctgccacttttgcgactcagatggggctcaggactactatagcgattatgcttacctgagggaacactttcgtgagaaacattttctgtgtgaggagggcaggtgtagtactgagcaattcacccacgcatttcgaacagagatcgatctgaaagcccaccgcactgcctgccactccagaagcagggccgaggctcggcagaaccgacacatagatctgcagttttcctatgcgccaaggcacagtcggcgtaatgagggcgtcgtgggtggggaagattacgaggaagtggatcgatattcgcgccagggacgtgtggccagggctggaacccggggtgctcagcagagcaggcgaggcagctggagatataaaagggaagaagaggatagggaggtggccgcagctgtgcgggcttctgttgccgctcagcagcaggaggaagccaggaggtccgaggaccaggaagaaggtgggaggcctaagaaggaagaagccgcagcccgtggacccgaggatcctcggggtccccgacgtagcccgagaacccagggtgaaggccctgggcctaaagaaacaagcaccaatggaccagttagccaagaggctttctccgtgactgggccagctgccccaggttgtgttggggttcctggggctctgccgcctcctagccccaaattaaaagacgaagattttccttccttgtcagcctccaccagcagttcttgcagcaccgccgctacaccaggtcccgtaggccttgcactcccttatgccatacccgctcgcggacgatcagctttccaggaagaagattttccagcgttggtaagttccgtgccaaaaccgggaacagcgccaacctcactggtatcagcatggaacagcagcagtagttccaaaaaggtggcccagccgccactttctgcccaggcaactggctcaggacagccaactagaaaggccggaaagggatcacggggaggcaggaaaggcggtcccccattcacgcaagaagaggaggaggatgggggacctgctttgcaggagctgcttagcactagacccactggatctgtcagcagtactctgggtttggccagcatacaaccttcaaaagtgggcaaaaaaaagaaagtgggatccgagaagcccggtacaacactcccccagccccctcccgctacttgtcccccaggcgcactgcaggcgccagaggccccagcctcccgggcagaggggcctgtcgctgtcgtcgtgaatgggcacatggagggccctgctcctgccagatctgcaccaaaagagcctccagggctcccgaggcccctcggttcttttccctgtcccactccccaggaagactttcctgcactcggcggtccatgcccccctaggatgcctcccccacccggattctccgcagtggtgctgttgaaaggcactcctccaccacctcctccagggttagtgccgcctatttccaagcctccacccggattttccggcctgctgccgtcccctcatcccgcttgtgtaccctcccccgctacaaccacaacaacaaaggccccaaggctcctcccagcaccacgcgcttacctcgtcccagaaaacttccgggaacgcaacctccagctgattcaaagcattagagactttctccagagcgacgaggccagattctcagaattcaagtctcacagtggcgaatttaggcaggggcttatatccgccgctcaatactataaatcttgtagagacctgttgggcgaaaatttccagaaggtgttcaatgagctattagtgctgcttcccgacactgctaagcaacaggagttactcagtgctcatacagatttttgtaatcgggagaagcctctgtccactaaaagcaaaaaaaacaagaaatcagcctggcaggcgactactcagcaggcgggtttagattgtagggtctgccctacctgccagcaggtgctcgcccacggtgatgcttcgtcacatcaggctctgcatgccgctagagatgatgattttccatcgctgcaggccatagcaaggattatcacttag

SEQ ID NO: 61329 - DNA, 4539 bp, Artificial Sequence
  Description of Artificial Sequence: Synthetic coding sequence
atgtcagttaacatttctacagcagggaaaggcgtggatccaaatactgtcgatacttacgattcaggagatgattgggagataggcgtgggtaacctgattattgatctggacgccgatctagaaaaagacagacagaaatttgaaatgaacaactcaacaaccacaacctcaagttccaacagtaaggactgtggtggtccagcttcaagcggtgctggggcaaccgctgcattggctgacgggctgaaattcgcatccgttcaagcgtcagctcctcaggggaactctcataaggagacttcaaaatccaaggtgaaacgatcgaaaacttcaaaggatgcaaacaagtccctgccttccgcggctctctacggaatcccagagatatcatcgacaggaaagaggcaagaagtgcaggggagaccaggtgaggcgaccggaatgaactccgccctgggacaaagcgtgtcttccggaggcagcggcaatcccaactcaaatagcacgtcaacctctactagcgctgctactgctggagcagggtcctgcggcaagtctaaagaggaaaagcccggaaaaagtcagagcagcaggggcgctaaaagagataaggacgctggcaaaagccggaaggacaagcacgatttgctgcagggccatcagaacggcagcgggagtcaggcaccttctgggggacacttatatgggttcggagccaagtctaatggcggtggcgcatccccatttcactgtggtggcacgggcagcggttctgtggcagctgcaggagaagtaagcaaatctgcacccgacagtggactcatgggcaattcgatgttggtgaagaaagaggaggaggaggaagaatcgcatcgtaggattaagaagctgaagacagagaaagtggatcctctttttactgttcctgcccctcctccacccatctcttcttccctgacaccccagatcctgcccagctatttttccccgtcgtcctctaatattgcagcccctgttgaacagctcttggtacgaacccggagcgtgggcgtgaatacgtgtgaggtcggcgtagtcacagagcctgaatgcctagggccatgtgagcccggaacatcagtgaacttggagggtattgtttggcacgagactgaggaaggcgttttggtggtaaacgtaacttggaggaacaagacatatgtcggaacactactggattgtacaaagcatgactgggccccacccaggttttgcgaaagcccaacaagcgacctcgaaatgaggggaggacgtggtcggggaaaacgggcacgttctgctgcagccgcacctggttcggaggcctcatttacagagtcaaggggtctccaaaataagaatcggggaggcgcaaatgggaaaggcaggcgaggctccctgaacgcttccggacggaggacacccccaaactgtgctgctgaggacatcaaagcttcaccatcttccaccaataagaggaaaaacaagccacctatggagttggacctgaactcctcttccgaagataataaaccaggaaagagagtacgcacaaacagcagatccacccccacaactccccagggcaaacctgaaacaacctttttggatcaggggtgtagttcgcccgtactcatcgactgccctcatccgaattgcaataaaaaatacaaacacatcaatgggctcaggtaccatcaagcccatgcgcacttagacccagaaaacaaactggaattcgaacctgactcagaagataagattagtgattgcgaggaaggcctttccaacgtggccctcgagtgcagcgaaccatcaactagcgtaagcgcctacgaccagctgaaagccccagcatctcctggtgctggcaacccaccagggacccccaagggaaaaagagaactgatgagtaatggtcctggaagtattattggagctaaggcgggaaaaaacagtggcaaaaaaaagggactgaataatgagctgaacaacctacccgtcatttctaacatgacagccgctctggactcctgtagtgccgctgatggctccctggcggcagagatgcctaagttagaagcagaggggctcatcgacaaaaaaaacttgggcgataaagaaaagggcaagaaagcaactaactgcaaaacagacaagaacttatctaaactgaagtctgcacgccctatcgcgccagcacccgcacctacacctccacagctgattgccatccctacggccacttttacaaccactacaaccggaacaatccccggacttcctagccttacaacgactgttgtccaggctactcctaagtcaccccctcttaaacccatccaacctaagccgaccattatgggtgagccgataaccgtaaacccagccttggtgtcgctcaaggataaaaagaaaaaagagaagcgcaaattgaaggataaggagggaaaggagaccggctccccgaaaatggacgcgaagctgggaaagctggaggattccaaaggcgcttcaaaagaccttcctggccacttcttgaaggatcacctaaataagaatgagggcttagccaacggactctccgagtcgcaggagtcccggatggcgagcatcaaagcagaagccgataaggtgtatacatttactgacaatgcaccatctccctccatcggcagtgcatcaagactcgagtgttcaacccttgtgaacggacaggcccctatggctccgctgcatgtgctcacacaaaatggcgcagagtccagcgctgcgaaaactagctctcctgcatacagtgatatcagtgatgccgcagatgatgggggatcagatagtcgatccgaaggtatgcgttcgaaagcctcttctccttctgatatcattagttccaaggactcggtcgtaaaggggcatagcagtaccactgctcagtccagccaactcaaggagagccattcaccctattaccactcttatgacccttactactccccttcctacatgcatcccggtcaggtcggggctccggctgctgggaatagtggatccactcagggcatgaaaattaaaaaggaatcagaggaggacgccgagaaaaaagacaaggctgaacagctcgactcaaaaaaagttgatcataatagcgcttctctgcaacctcagcatcagagcgtaatcacgcagaggcatcccgcattggctcagtcactttattacgggcagtatgcttatggcctgtatatggatcagaagagcctaatggctacatcacccgcatacagacagcaatacgaaaagtactacgaagaccagaggctcgccgagcagaaaatggcacaaacaggaagaggcgactgcgagcggaagagcgaactgcccctcaaagaactaggaaaggaggaaactaagcagaaaaacatgccgagtgctacaatcagtaaggccccttccacccctgaaccaaacaagaatcacagtaagctgggacctagtgtgcctaataaaactgaggagactggcaagtcacagctgctgagcaaccaccaacagcagttgcaagccgactcattcaaagccaaacagatggaaaatcatcagctgataaaggaagccgtggaaatgaaatccgtcatggatagtatgaaacagactggcgtggatcccactagcagattcaagcaagatcccgactcccgcacttggcatcactacgtctaccagcccaaataccttgatcagcagaagtccgaggagctggaccgggagaagaagctcaaggaggacagtcctcggaaaacgcccaacaaggagagcggcgtccccagcttacccgtcagtctgacatcaatcaaagaggagcctaaggaggccaagcacccagactctcaatccatggaggagagcaagttaaagaatgacgacagaaagacccctgttaattggaaggatagtcgcggaacacgcgttgctgtttcaagccccatgagtcagcaccagagctacatccagtaccttcatgcgtacccctacccccagatgtacgatccatcccaccccgcatatcgtgcagtctcccccgtgttgatgcattcttaccctggggcatacctctcccccggattccattatcccgtatacggtaaaatgtcagggagagaggaaacagaaaaagtgaacaccagcccgtctgtcaatactaagactactacggagagcaaggccctggatctcctccaacagcatgccaaccaataccgatcaaagtctccagcccctgtggagaaggctactgcagagcgggagagggaggcggagagagagcgcgatcggcattccccatttggccagagacacctgcatactcaccatcatacccacgttggaatgggttaccccttgattcccggacaatacgatccctttcagggtctgacaagtgcagcattagtcgcctctcagcaggtggccgctcaggcttcagctagtggcatgttccctgggcagcgcagagaatag

SEQ ID NO: 61330 - DNA, 3258 bp, Artificial Sequence
  Description of Artificial Sequence: Synthetic coding sequence
atgcgaggaggcagagggcgaggcaaaagggcccgatcggccgcagcagcacctggatcagaagcctcctttactgagagcagaggattgcagaacaagaacagagggggagcaaacgggaaggggaggagaggctccctgaacgccagcggcaggcggacacctcccaattgtgcggcagaggatataaaggctagcccctcatcaacgaacaaacgtaaaaacaagcccccaatggaactcgacctgaattcatcttccgaggacaacaaacctggtaagcgagtgcgcacaaactctcgatctacccctaccacccctcagggaaaaccagagacgacatttctcgatcaaggttgttcatcaccagtgctgattgactgcccacatcctaactgcaacaaaaagtacaagcatattaatggactgagataccatcaggcccatgcacatttggatccagagaacaaactagagttcgagcctgattccgaagataagatatccgactgcgaggaaggactaagcaatgtcgctctcgaatgtagtgagccctcgacatctgtttctgcctacgaccaacttaaggcaccagcctcacccggagcgggaaaccctccaggaacgcctaaaggaaaacgagaactgatgtcgaacggcccaggcagcattatcggggcaaaagccggtaagaattcgggaaaaaaaaagggcctgaataatgagctcaacaatttgccggtgatctcaaacatgactgctgcactagatagctgctcagcggctgacggttctttggcagccgaaatgccaaaacttgaggccgagggtttaatagataagaagaacttgggcgataaggagaaaggcaaaaaggctacaaattgcaagacagacaagaatctgtccaagttaaaaagcgcccgacccatcgcaccagctccagcacctaccccgcctcagctgatcgccattcccacggcaacctttacaacgaccacgactggaactattccgggacttccaagcctgaccaccacagtggtacaagccactcccaaatcacccccacttaaacctatccaacccaaacctacgatcatgggagaacccattacggtgaaccccgctctggtatctctcaaggataaaaaaaagaaagaaaagcgaaaactgaaggacaaagaggggaaggagaccggatcccctaagatggacgctaagttggggaagttggaggatagcaaaggagcaagcaaggatctgcccggtcatttcttgaaggatcatctgaataagaacgagggcctcgcgaacgggctgtctgagtcccaggagtcaaggatggcaagtatcaaagcagaggctgataaagtgtatacctttaccgataatgcaccctctccttccatcggctcagcatcaagattggaatgttctaccttggtcaacggccaagcgccaatggctccattgcatgtcttgacccagaacggtgccgagagctctgccgcaaagacaagctcacctgcgtactctgacatatcagacgccgctgacgacggagggagtgactctcgatccgagggcatgaggtccaaggcctcctcacctagcgatatcataagcagcaaagactccgtcgtgaaaggccactcctctaccaccgcccaaagcagccagctgaaggaatcacactccccatactaccattcgtacgatccctattattccccatcatatatgcaccccggtcaggtaggtgcaccggcagccggaaactccgggtcgactcaaggtatgaagatcaagaaagagtctgaggaagatgccgaaaaaaaagataaggctgaacaacttgacagcaaaaaagtggatcataacagtgccagtttgcagccgcaacatcaaagcgtcatcacgcagcgtcaccctgccctggctcagtccctgtattacggacaatatgcatacggactgtatatggaccagaaaagccttatggcgacctctcctgcttaccgtcagcagtatgaaaagtattatgaagaccagcggttggctgagcagaaaatggcccagaccggccgtggcgactgcgaaaggaagtcagagctgcctttgaaggaattgggcaaagaagagacaaaacaaaagaacatgcccagtgccacaatcagcaaagccccaagcactccagagcccaacaagaatcatagtaagcttgggccttccgtgccgaataaaaccgaagagacaggaaaatcgcagctgctatccaaccatcagcagcaattgcaggccgactccttcaaggccaaacagatggaaaatcaccaacttatcaaggaggcagtcgaaatgaaatctgtgatggatagtatgaaacagaccggggtggaccctactagcagatttaagcaggaccccgacagccgcacatggcaccattacgtgtatcagccaaagtacctagatcagcagaaatctgaagaattagatcgagagaagaagctgaaggaggatagtccccgaaaaacccccaataaggagtcaggcgtcccctcccttcccgttagcttaacatcaattaaggaggagcccaaagaagccaaacatcctgacagccaatcgatggaagaatcgaaactcaaaaatgacgataggaaaacccccgttaactggaaggattctcgcggaactcgtgtggccgttagcagtccaatgagtcagcaccagagttacatccaatacctacacgcctatccttatccacagatgtacgatccaagtcacccagcctaccgggctgtgagccccgtgttgatgcatagctatccaggcgcttatttatcacccggttttcactacccagtgtatggcaaaatgagtggccgtgaggagacagagaaggtgaacaccagcccttctgtcaacaccaaaaccactaccgaaagtaaggcgctggatcttctccagcagcacgcgaaccaatataggagcaaatcccctgctccagtcgagaaggcaaccgccgagagagaacgggaggccgagagagagcgggatagacactcaccatttggccaaaggcaccttcacactcatcaccacactcacgtcggcatggggtacccattaatcccgggacagtacgacccttttcagggcctaacatccgctgccctggtagccagccaacaggttgccgcacaggcatcagcctctgggatgtttccaggccagagacgggaatag

SEQ ID NO: 61331 - DNA, 2148 bp, Artificial Sequence
  Description of Artificial Sequence: Synthetic coding sequence
atgagcgtcaatatttccacagcaggaaagggtgtagacccaaatacagttgatacctatgactccggtgacgactgggagatcggcgttggcaacctcatcattgatttggatgccgatctcgagaaggatcgacagaaatttgagatgaacaattccacaacaacaaccagtagctccaatagtaaagattgcggcggacccgcaagctctggagcaggagcaacagccgctctggcggacggattaaagttcgcatcggtgcaagcctccgctccccagggcaactcgcacaaagagaccagcaaatcaaaggtcaaaaggagtaagacgagtaaggacgctaacaagtcactacctagcgccgctttatatggcattccggagattagctccaccggcaagcggcaagaggtgcaaggaagaccaggtgaggctaccgggatgaatagcgctcttggacagtctgtgagcagcgggggtagtggaaatccgaattccaactccacaagcacctctaccagtgcggctactgctggagccggttcttgcgggaagagtaaggaggagaagcctggcaagtcacagagtagcagaggcgctaagcgtgacaaagatgcaggcaaatccaggaaagataagcacgacctgctgcagggccaccaaaatggatccgggagccaggctcctagcggaggtcatctgtatggctttggtgccaaaagtaatggcggtggggcatccccattccattgtggaggcacgggaagtggctctgtggcggcagccggagaagtttccaaatcagctcctgactccggtctaatgggcaattccatgctggtgaagaaggaggaggaggaagaggagagccaccggagaattaagaagcttaaaacagagaaggtggatcctttgtttaccgttcccgctccccctccccctatatcatcctcactgacaccgcagatcctccccagctatttctctccatcaagcagtaacatcgcagcacctgtcgaacaacttctagtccgaactcggtctgtcggggtgaacacatgtgaggttggggtggttacagagcccgaatgtcttggcccttgtgagccagggaccagtgttaatctggaaggaatagtctggcacgagactgaagaaggtgtgttagtcgtgaatgttacatggcggaacaaaacatacgtcggaactctgttagactgtaccaaacatgactgggcccctccaaggttttgtgagtccccaaccagcgacctggaaatgcggggaggcaggggaagaggcaaaagggccaggtctgccgcagcagctcctggcagtgaggcaagctttaccgagtctagaggcctgcagaataagaacaggggcggtgccaacgggaagggccgacgcggatcacttaatgcgagcgggaggagaacaccgccaaactgtgccgcagaggatataaaggcctcacctagctctacaaataagagaaagaacaagcctcctatggagctggatctgaacagttcttctgaggacaacaagcccggaaaacgtgtccgaaccaactcacgctcaacaccaacaactccacagggaaagccagaaacaacattcctcgaccagggatgttcttcacctgtgctgatcgattgtccacaccccaactgcaacaagaaatataaacatatcaacggactcagataccaccaggcccacgcccacctcgatcccgaaaacaaattggagtttgagcccgactcagaagataaaattagtgattgtgaggagggattgtcaaacgtcgctctggaatgcagcgagcctagcacctcagtatctgcctatgatcaactgaaggcacctgccagtcctggagctgggaatcccccaggcacaccaaaaggaaaaagggagctaatgagtaacggcccagggtcgatcattggagctaaggcagggaaaaactctggcaagaagaagggcctaaacaacgagttaaataatctgcctgtgatcagcaatatgaccgccgctctagatagctgttccgcagccgatggctcacttgccgctgagatgccgaagttggaggccgaaggattgattgataagaaaaatttgggagacaaggagtag

SEQ ID NO: 61332 - DNA, 2124 bp, Artificial Sequence
  Description of Artificial Sequence: Synthetic coding sequence
atgagcgtgaatatcagcaccgccggaaagggagtggatcctaacaccgtggacacctatgatagcggtgatgactgggaaattggcgtgggcaatcttatcattgatctggacgcagatttagagaaagaccgccagaaatttgaaatgaacaatagcacaactacgacatccagctcaaactcaaaagattgtggaggacccgcaagtagcggtgccggtgccaccgcagccctggccgatgggctgaaattcgcttccgtccaggcgtcagcgccacaggggaattcacataaagagacctccaagtcgaaagtgaagaggagtaaaacttctaaggacgcaaataagtcgctcccatcagctgccctttatggcattcctgaaatatcatccacagggaagcggcaggaagtgcagggcagaccaggagaggctacggggatgaatagtgcacttgggcaatccgtcagttcaggagggagcgggaatccaaacagcaattccacgagcacctctacatccgccgcaacagccggagccggtagctgcggaaaatcgaaggaggaaaagccgggtaaaagtcagagttctaggggcgcaaagcgagacaaggacgcgggaaaatcaaggaaggataagcacgacttgctgcaggggcatcagaatgggagcggttctcaggcaccatctggaggacacctgtacgggttcggtgcaaagtcaaatggtggcggtgcttcaccatttcattgcgggggtacggggtctggctctgtcgctgcagctggcgaggtgtccaaaagtgcacccgacagcggcctgatgggaaactccatgcttgtcaaaaaggaagaagaagaagaagaaagtcaccgcagaatcaagaaactgaaaactgaaaaagtggaccctttgttcacagtcccagccccaccccctcccatctcctcgagcctgaccccccagatactcccatcatatttctccccctctagttccaatattgctgcaccggtagagcagctcttggtgcgcacgcgcagcgtgggcgtcaatacttgcgaggtaggagtagttactgaaccagagtgcctaggcccttgcgaacccggaacttcggttaatctggaagggattgtctggcatgagactgaggaaggggtgctggtcgttaatgtgacttggagaaataaaacctatgtgggcactttattagactgcaccaagcacgattgggccccacctcgcttctgtgagagccccacaagtgatctggaaatgcgtgggggaaggggtcgtggaaaaagggcccgaagtgctgctgctgctccaggaagtgaggcatccttcaccgaatctcgaggactacagaacaaaaaccgcggaggggcaaacggcaagggcaggcgcggaagcttgaatgcctccggccgtagaacacccccaaactgtgccgcagaagatattaaagctagcccatcttctaccaacaaaaggaagaacaagccgccaatggaactggatctcaactcatcctcagaggacaataagccgggaaagagggttcgcaccaacagtcgctcgacacccacaacacctcagggtaaacccgagaccacgtttctggaccaggggtgtagcagccccgtactgatcgattgcccacacccgaattgcaacaagaagtacaagcatatcaacggactgagataccaccaggctcacgcacatctcgaccctgagaacaagctggaattcgaacctgatagcgaagataaaatttccgactgtgaggagggcctatcgaacgtggcactcgaatgcagcgagccttcaaccagtgtatccgcctatgatcagttgaaggcgccagctagtcctggggctggaaatccaccaggtacccctaaggggaaacgcgagctcatgagtaatggcccaggttcaattatcggcgcaaaggcagggaaaaactcaggaaaaaagaaaggattaaataatgaattgaataatttacccgtgatcagcaacatgactgctgcactggattcctgctccgcagccgatggctcactcgcagcagaaatgccaaaactcgaggctgagggcctcatcgactag

SEQ ID NO: 61333 - DNA, 1503 bp, Artificial Sequence
  Description of Artificial Sequence: Synthetic coding sequence
ctattcctattcctcgctgtggtgtgctcgtactttgctcaagatttctggcccaagcagggaatcaaaaactgcttccagaaggtgatcctcaaacgctataaaaaatgcgggcatgaaaatctgcagctcgggaaatactgtaagtcaatggacgagtgtaaagtacatgaagagtgctataatgggctgaaccaatgcctcagaacaactcaaagtaagatactccaatgtgacaaatatgtaaaggttttccacaaattctccaactcgaatagatacaaaattcgacataccgggaaaaaacctttcaagtgcaaagagtgcgagaaatcattttgtatgctgagtcatcttgcccaacataagaggatccacacacgcgagaaaccatataagtgcaaagagtgcggcaaggcctacaacgaagccagcaatctctcgactcataagagaatccacacgggtaagaaaccctacaagtgcgagcaatgtggtaaagccttcaacagactgtcgcacctgaccactcacaagatcatccataccgggaaaaagccctacatctgtgaagactgcggcaaagccttcaaccagagcgccaacctgacaacccataagcgtatacatactggggaaaagccctataagtgcgaggagtcgggcaaggctttcagccaatcatcaacattaaccactcacaagatcatccacgccggtgaaaagccatacaagtatgaggaatgtggcaagtccttcaaccagtcaagtactctgactacaaggaagataatacacactggcgagaaattctgtaaatgcgaagagtgggggaaagcctttagccgcttgagccacctgaccacacataagagaatccatagtggtgagaaaccctataagtgtgaggaatgtgggaaggctttcaagcagagcagcaccctgacaacgcacaagagaattcactccggtgagaaattttataaatgcgaggtctgtagtaaggctttcagccggttctcacatttgaccacccacaagcgtattcacagcggagaaaaaccttataagtgtgaggagtgcggtaaagcctttaatctgtcgagccacctaactacgcataagatcatacacaccggtgagaaaccctacaaatgcgaggagtgtggcaaagcctttaatttgtcctctcatttgactacacacaaaatcattcacacaggagagaagccttataagtgcgaagaatgtggcaaagcattcaatcagagcagtacattaagtaagcacaaggtgatccataccggcgagaagccatacaaatgcggcgagtgcggcaaggccttcaaccagtcgtctcatttgaccacccataaaatcatccacaccggcgaaaagccctataaatgtgaggagtgcgggaaggcctttaataattccagtattctgaacagacacaagatgatacacacaggggaaaagttctataagccggaaagttag

SEQ ID NO: 61334 - DNA, 1239 bp, Artificial Sequence
  Description of Artificial Sequence: Synthetic coding sequence
atgacatttacttttcagagtgaagacctcaagagagattgtgggaagaagatgtctcatcagcacgtttttagtctggcaatggaggaggacgttaagaccgccgatacaaagaaggcgtctaggatcttggatcacgaaaaggaaaatactaggtccatttgtctattggaacagaagagaaaagtggtctcttctaacatcgacgtcccccctgccagaaaatctagcgaggagctggacatggacaaagttacagcggctatggtcctaacctccctgtctacttcaccactggtgcgctccccgccagtgaggccgaacgagtcactctcagggtcatggaaagaaggtggatgtgtgccctcgtcaaccagtagcagcgggtactggtcctggtctgctcctagcgaccagtctaacccaagtactccaagtccaccactcagtgccgacagttttaaaccattccggtcacccgctcagccagacgatggcattgatgaggctgaagcctctaatctactatttgatgagcccatcccacggaaacgcaagaactctatgaaggtcatgttcaaatgtctgtggaaaaactgcggaaaagtgttgtccacggcagctggtatacaaaagcacatccggaccattcacttagggagagtcggggacagcgactacagcgacggtgaagaggacttctactacacagagatcaaactgaataccgatagcgtcgccgatgggctaagctcactggcccctgtgtccccaagccaaagcctcgcctccccccctacttttccaattccagattccagtcgcacggagaccccgtgcgccaagacagaaacaaaactaatgacccccctcagccgttctgccccaaccaccctgtatctggttcacacagaccacgcataccaggccacgccacccgtaacaataccaggcagcgctaaattcacccccaacgggagctcctttagcataagctggcagagtccacctgtcacttttacgggtattccagtctcgcccactcaccacccagttgggaccggggaacagagacagcacgcccataccgtgctgtcctcgcccccacggggaactgtgtcactcagaaaaccgagaggggaaggaaaaaaatgccgtaaagtgtacggcatggagaatcgagacatgtggtgtacagcatgtcgctggaaaaaggcctgccagaggttcctggactag

SEQ ID NO: 61335 - DNA, 570 bp, Artificial Sequence
  Description of Artificial Sequence: Synthetic coding sequence
atgacatttacatttcaaagcgaggacttgaagcgggactgcggtaagaagatgagtcatcagcatgtgttctccttggcaatggaggaggatgtcaaaaccgcagacaccaagaaagcctcacgcatacttgatcatgagaaagaaaacactaggagtatctgcctgctggagcagaagcgaaaggtagtgtcatctaacattgatgtgccgcctgcacgtaagagcagcgaggaattagacatggacaaggtcactgccgctatggtattaacgtctctttccacctctccgctggtgcggtcccctccagtccggccaaatgaaagtttatcaggatcctggaaggagggcggttgtgtaccatccagtacctcatcatctggatactggtcttggtctgccccttcagatcagagcaatccgtccacaccatctcccccattgagcgctgattcattcaagccatttcgcagcccggctcagccggatgacggaatcgatgaggctgaggcgtccaatctcttattcgacgagcctattcccagaaaaagaaaaaatagtatgtag

SEQ ID NO: 61336 - DNA, 903 bp, Artificial Sequence
  Description of Artificial Sequence: Synthetic coding sequence
atgcatagtctggaaaaggtgacctttgaggatgtggccattgacttcacacaggaagagtgggacatgatggacacctcgaagaggaaattgtaccgcgacgtcatgttggaaaatattagccacttagtgtcactgggataccaaatttccaagtcctacattattctgcagctcgagcagggcaaggaactctggtgggagggacgtgtctttctgcaggaccagaacccagacagagaaagcgccttaaagaagaagcacatgatttccatgcaccctattatccgaaaggatacaagcacgtccatgacgatggagaattcattaatcttagaagacccctttgagtacaacgacagtggagaggactgcacccattctagtaccatcacgcagtgcctcttgacccattcaggaaagaaaccctgtgtgtcgaagcaatgcggcaaatccttacggaatctgctgagcccaaagcccagaaagcagatccatactaaggggaagtcttaccagtgcaatctgtgcgaaaaggcttacacaaactgtttctaccttcggagacacaagatgacccatactggtgaaagaccgtatgcctgtcacctctgtggcaaggcttttacacagtgtagtcatcttcggcgacatgaaaagactcacactggagagcgcccatataaatgccatcaatgtggaaaggcatttatccaaagctttaatctgcggagacatgaacgaacacatctgggacaaaagtgctacgagtgtgataagagcggtaaggcctttagccagtcatctggctttcgcggaaacaagatcatccatattggcgagaagccacccgcatgcctgttgtgtgggaaggcctttagcctgtcatcagacctgagatag

SEQ ID NO: 61337 - DNA, 903 bp, Artificial Sequence
  Description of Artificial Sequence: Synthetic coding sequence
atgcactctctggagaaagtgacctttgaggacgtggctattgactttactcaggaagaatgggacatgatggacaccagtaagcgtaaactgtatcgtgatgtgatgctggagaatatttcccacttggtgtcactcggttaccagatcagtaaatcatatatcatattacagctagaacagggaaaggagctatggtgggagggcagagtcttcttgcaggaccaaaatccagaccgtgaatcagctctcaaaaagaagcatatgataagtatgcatcctatcataagaaaggacacgtccaccagtatgaccatggagaattccctgattttggaagatccttttgagtataacgacagcggcgaggactgtacccattcgtcaacgatcacacagtgcctgctgacgcattccggaaaaaaaccatgcgtctccaaacagtgcggcaagtccctgcggaacctactctcccccaaacctcggaaacagattcacacaaagggtaagagctaccagtgcaacttgtgtgagaaggcatataccaactgtttctatctgcggaggcacaagatgactcacacaggggagcgaccgtacgcttgccacctgtgtggaaaagctttcacccagtgcagtcatctgcgaaggcacgaaaagacccacaccggcgagagaccttacaagtgccaccaatgcgggaaagcatttatacagtcctttaacttgcgcagacacgaaaggactcacctggggcaaaagtgctatgagtgtgataagtctggcaaagcttttagtcagtcctccggtttcagaggtaataaaatcattcacataggcgaaaaaccaccagcttgtctgctgtgtggcaaagccttctcgctctcatctgatctgcggtag

SEQ ID NO: 61338 - DNA, 903 bp, Artificial Sequence
  Description of Artificial Sequence: Synthetic coding sequence
atgcactcattgaaaaaactaacatttgaagatgtggccattgacttcactcaggaggagtgggccatgatggacacaagtaagcggaaactgtaccgtgatgtgatgctggagaacatctctcatctggtctcactgggctaccagatctctaaatcttacattattcttcaactggaacaaggcaaagagctttggcgggaggggagagtgttcctacaagaccaaaaccccaatagagagtctgccctcaagaagacgcacatgatttctatgcacccaatcacacgcaaagacgcctctacctctatgaccatggagaattcactgatcctcgaggaccctttcgagtgtaatgactcaggggaggattgtactcgctccagtactattacacaatgcctgcttactcattctggtaagaagccttacgtatcgaagcaatgtggcaaatctctgcggaatctgttatctacagaacctcataagcagattcatacaaagggaaagtcgtatcagtgcaacctctgtgaaaaagcatacaccaattgttttcaccttaggcgacacaagatgacgcacacaggagaacggccttacgcctgtcacctctgccgcaaagctttcacccagtgctcccacctccgaaggcacgaaaaaacacatacagggcagagaccatacaaatgtcaccagtacggcaaagtgttcatacagagctttaatctgcagagacatgagcggacccatctgggcaaaaaatgttacgagtgcgacaaatcaggaaaggccttttcccagtcgtcagggttccgagggaacaaaattattcacactggcgagaagcctcacgcctgcctgctatgtggtaaagctttttccctttctagtaatttgcgctag

SEQ ID NO: 61339 - DNA, 903 bp, Artificial Sequence
  Description of Artificial Sequence: Synthetic coding sequence
atgcattcgctgaagaagctgacgttcgaagacgtcgccattgacttcacacaggaagaatgggcgatgatggacacctcaaaacgcaaactgtaccgagacgttatgctcgagaacataagccacctagtcagcctggggtatcagattagtaagagttacatcatcctacaattagagcagggcaaggaactctggcgtgaaggacgagtctttctgcaagatcagaacccaaacagagaatctgccctgaaaaagacccacatgatttccatgcacccaatcacgaggaaggatgctagcacgagcatgactatggaaaactcactgattttggaggacccctttgagtgtaacgactctggcgaggactgcacccggagttccaccattactcagtgtttgttgactcactccggtaagaagccatacgttagtaagcagtgtggtaagagtctccggaaccttctgtctacagagccccacaagcagattcacacaaagggtaagagttatcaatgcaacctctgtgagaaagcatataccaactgctttcacctgagaaggcataaaatgacgcatactggggagaggccttacgcctgccacctttgcaggaaggcattcacccaatgctcacatcttcgccgacacgagaagacgcacactggacagcggccatacaagtgccaccagtacggaaaagtttttatccagtcatttaacctccagaggcatgaaagaacccacctgggaaagaaatgctacgagtgtgataagtccggcaaggccttctctcagtcgtccggcttcagagggaataagatcatccacaccggggagaagccccacgcctgcttgctttgtggtaaggctttctctctgtcatctaatctgagatag

SEQ ID NO: 61340 - DNA, 231 bp, Artificial Sequence
  Description of Artificial Sequence: Synthetic coding sequence
atggcccgtggacaacagaaaattcagtcgcagcagaagaatgcgaaaaaacaggccggacagaaaaaaaagcagggacacgatcagaaagccgcagcaaaggcagcgttaatttatacatgtaccgtgtgtcgaacacagatgccagatccaaagaccttcaaacagcacttcgagagcaagcaccccaaaactccactgccacctgaactagccgacgtgcaggcttag

SEQ ID NO: 61341 - DNA, 231 bp, Artificial Sequence
  Description of Artificial Sequence: Synthetic coding sequence
atggcgaggggccagcagaagatacagtcgcagcaaaagaacgccaaaaagcaggctggccagaaaaagaaacaggggcacgatcagaaggctgccgctaaggcggctctgatctacacttgtaccgtgtgcaggactcaaatgcctgaccctaagacattcaaacagcatttcgagtcaaaacaccccaagacgcctcttcccccagaactggccgacgtgcaagcctag

SEQ ID NO: 61342 - DNA, 231 bp, Artificial Sequence
  Description of Artificial Sequence: Synthetic coding sequence
atggcgcgaggccagcagaaaatccagtcacagcaaaagaacgccaagaagcaagccggtcaaaagaaaaaacaagggcacgatcaaaaggccgctgctaaggccgctctgatatacacatgcactgtctgcagaacacagatgcccgaccctaaaacgtttaaacaacatttcgagagcaagcacccgaagacccctttgccccctgagttagccgatgtgcaggcctag

SEQ ID NO: 61343 - DNA, 231 bp, Artificial Sequence
  Description of Artificial Sequence: Synthetic coding sequence
atggcaagagggcagcagaagatacagtcacagcaaaagaacgcaaagaaacaggcagggcagaaaaaaaagcagggacacgatcagaaggctgcggctaaagctgctctgatatacacctgtacagtctgcagaacccagatgcctgaccctaagacatttaaacaacattttgaatctaagcaccccaagacccctttacctcctgagctggcagacgtgcaggcctag

SEQ ID NO: 61344 - DNA, 231 bp, Artificial Sequence
  Description of Artificial Sequence: Synthetic coding sequence
atggctcgcggtcagcagaagatccaatcccaacagaagaacgccaagaagcaggccggtcagaagaaaaaacaaggacacgaccagaaagctgccgcaaaagcggcactgatctacacctgtaccgtctgtaggacacagatgccagatcccaaaaccttcaagcaacatttcgaaagcaagcatcccaagacaccacttcctcccgaattggctgacgtgcaggcttag

SEQ ID NO: 61345 - DNA, 27 bp, Artificial Sequence
  Description of Artificial Sequence: Synthetic coding sequence
atggctagaggacagcagaagatctag

SEQ ID NO: 61346 - DNA, 231 bp, Artificial Sequence
  Description of Artificial Sequence: Synthetic coding sequence
atggccagaggacagcagaaaatccagagtcaacagaaaaacgccaaaaaacaagctggccagaagaaaaagcaagggcacgaccagaaagccgctgcgaaggctgccctgatctacacctgcactgtgtgtcggacgcagatgcccgatccaaaaactttcaagcagcactttgagtccaaacaccccaagactccactccctccggagctcgccgacgtgcaagcctag

SEQ ID NO: 61347 - DNA, 231 bp, Artificial Sequence
  Description of Artificial Sequence: Synthetic coding sequence
atggctcggggacaacagaagatccagtctcagcagaaaaatgcaaagaaacaagctggccagaaaaaaaagcagggccacgatcaaaaagctgcggctaaagcggcactgatttatacctgcacagtctgtaggactcagatgccagacccaaagacctttaaacagcacttcgagtccaaacaccccaagacccctttgccaccagaacttgcagacgtacaggcttag

SEQ ID NO: 61348 - DNA, 129 bp, Artificial Sequence
  Description of Artificial Sequence: Synthetic coding sequence
atggccagaggacagcagaagattcaatcccaacaaaaaaatgctaagaaacaggcaggccagaaaaagaaacaaggtcatgatcagaaagctgccgctaaggccgctttaatttacacttgcacatag

SEQ ID NO: 61349 - DNA, 1116 bp, Artificial Sequence
  Description of Artificial Sequence: Synthetic coding sequence
atggatatggctcaggagcccgtgaccttcagagacgtcgcaatttactttagccgagaagagtgggcctgtcttgagcctagccagcgcgcattgtacagagatgtcatgttggataacttctcatccgtggcggctctgggcttctgctcaccgaggccagatctggtgagccgattggagcagtgggaagagccttgggtggaggatcgggaaaggccggaattccaagcggtgcagcgcggaccgaggcccggtgcacggaagagcgctgaccctaaacgcccttgcgaccatccagcctgggctcacaagaaaacccacgtgcggcgtgagcgcgctagagaagggagtagtttcagaaagggctttaggcttgatactgatgacgggcagctacccagagccgctccggagcggacagatgccaaaccaaccgcttttccttgccaggtgctgacccagcggtgtggaagacggcctggccgtagggagcgacggaaacagcgagcggttgagttaagttttatctgcggcacgtgcggcaaggctctgagttgccactccaggctgctcgcccatcagacagtacacactgggaccaaggcttttgagtgtcccgaatgcggccaaactttccggtgggcatctaatttacagcgacatcagaaaaatcacacccgtgagaaacccttctgttgcgaagcatgcggccaagcgttttcactgaaagatcgtctggcccagcaccgtaaggtccacacagagcaccggccttacagctgcggggactgtggcaaagcgtttaagcagaagtctaatctcctgcggcatcaactggtacacaccggggagagaccgttttactgcgcggactgcgggaaagctttccgtaccaaagagaatctgagccatcatcaacgggtgcactctggagagaaaccttatacctgcgccgagtgtggaaagtccttcagatggcccaagggtttctccatacaccgtcgtctgcatctgacaaagcgtttttatgaatgtggacactgtggaaaaggcttccgtcatttgggtttctttacacggcaccagcgcacccaccggcacggggaggtctag

SEQ ID NO: 61350 - DNA, 1116 bp, Artificial Sequence
  Description of Artificial Sequence: Synthetic coding sequence
atggatatggcacaggaacctgttactttcagggacgtggccatttacttctcccgtgaggagtgggcctgcctggagccatcccagagagccctctatagggacgtcatgctggataacttcagtagcgtagcggcactgggcttttgcagtcctagacctgatctggtgtcccgcctggaacagtgggaagagccctgggttgaggaccgagagaggccagagttccaagccgtgcagagaggtccacggccaggggcacggaaaagtgctgatccaaagagaccttgcgatcacccagcgtgggcccataagaagacgcacgtgcggagagagcgggctcgcgaaggctcaagttttcgcaaaggatttagactcgacacagacgacggccagttaccacgcgcagccccagagaggactgatgctaagccaactgcttttccgtgtcaggtgctgactcaacggtgtggacggcgtccgggtcgtcgagaacgccgtaagcagcgtgcggtggaattgtcattcatttgtggcacttgtggcaaagcattgtcttgtcactcgcggctcctggcccaccaaaccgtccatactgggaccaaagcatttgagtgtcctgagtgcggccagaccttccgctgggcatcaaacttgcagagacatcagaagaatcacactagagaaaagcccttttgctgtgaggcctgtggacaggcgttctctctaaaagaccggttggcccagcaccggaaggtgcatacagaacatcgcccttactcatgcggggactgcgggaaggcattcaagcagaaatctaacctactaaggcatcaactcgtgcacactggggagcggcctttttactgcgccgactgcggcaaggcctttcgaaccaaagagaatctatcacaccaccagcgggtccatagcggcgagaagccatacacctgtgctgagtgtggtaaaagcttcagatggcccaagggctttagcattcaccggcgactgcatctgaccaaacgcttttatgaatgcggtcattgcgggaaaggcttcaggcacctcggcttcttcacgcgccaccaacgaacacatcgccacggcgaggtctag

SEQ ID NO: 61351 - DNA, 1665 bp, Artificial Sequence
  Description of Artificial Sequence: Synthetic coding sequence
atgaacgtgatgttggagaattacaagaatctggtgtttctcgctggaatcgccgtatcgaagcaggacccaattacttcactcgaacaggagaaagaaccttggaacatgaagatctgcgagatggtggacgagtccccggctatgtgctcctcctttactcgcgatctgtggccggaacaggacatcaaggacagcttccagcaggtgattctccggcgacacggcaagtgcgagcacgaaaatctccagctgcgtaagggctctgcaaatgtcgtggagtgcaaagtatataaaaagggttacgaactgaaccagtgtctgaccacgacacagagcaaaatcttcccatgtgacaaatacattaaagtgtttcataaaatttttaactcaaatcgccacaaaacccggcacaccggagagaaacccttcaagtgtaagaagtgtgacgaaagcttttgcatgcttttgcacttacatcagcataagcggatccacatcagagaaaattcataccaatgcgaggagtgtgataaggtcttcaagcgcttctcaacgcttacacgccataagcgtgtgcataccggtgagaaaccatttaaatgcgaggagtgcggcaaggctttcaaacattcatcaaccttgacaacacataaaatgatccatactggtgaaaagccttaccgctgcgaggagtgcggcaaggccttttatcactcgtcccacctgacaacccataaggtgatacacactggggagaagcctttcaagtgcgaggagtgcggtaaagctttcaaccacccatccgcactgactactcataagttcattcacgtgaaggagaagccgtacaaatgtgaggaatgtgacaaggcgttcaacagattcagctacctgactaagcacaagattatccacagcggcgaaaaaagttataagtgcgagcagtgcggcaagggctttaactggtcttcaactttaaccaagcataaaaggatccacactggcgagaaaccctataagtgcgaggagtgcgggaaggccttcaacgtgtctagtcaccttacaacacacaagatgatccacaccggcgagaagccctacaagtgtgaagagtgtggcaaggccttcaaccacagcagtaaactgaccatccacaaaattattcacacaggcgagaagccatataagtgtgaagaatgtggtaaggccttcaatcagtcctccaacctgacaaagcacaaaatcattcacactggtgagaaactttacaagtgcgaagagtgcgggaaagcttttaacagaagcagcaacctgaccactcataaaaggattcacactggcgagaagccctacaagtgcgaagaatgcggcaaagcttttaatcgttcctcgaacttgactaaacacaatattatccacactggcgagaaatcctacaagtgcgaggagtgcggcaaggcgttcaatcagtcttcaactctgacgaagcaccgtaagatacaacaggggatggtggcacacgcgtgtaatcctaatactctccggggtcttggggaacagatcgcaaggtctggagtccaggatcaaccgggtcagcatgggaaaactccttccctgctgaagatccagaaattcgccggatgcgggggacggcgtttatag

SEQ ID NO: 61352 - DNA, 1572 bp, Artificial Sequence
  Description of Artificial Sequence: Synthetic coding sequence
atgaatgtgatgctggagaactacaagaatctggtttttctggccggaatcgcagttagcaaacaggacccaattactagtttggaacaggagaaggaaccatggaacatgaagatatgtgagatggtggatgagagccccgctatgtgttcaagctttactcgggacctgtggcctgagcaggatattaaagatagttttcagcaggtcatcctccggaggcacgggaaatgcgagcatgaaaatttacagctgcgcaagggcagtgcaaatgtggtggagtgtaaagtttataagaaaggctatgaactgaaccagtgtttaactaccacgcagagtaaaatcttcccttgtgacaagtacattaaagtctttcacaagatcttcaatagcaatcggcacaagactcgacatactggcgagaagcctttcaagtgtaagaaatgcgatgagagcttctgtatgcttcttcatctacaccagcataagcggatacacatccgcgaaaactcataccagtgcgaagaatgcgacaaagtcttcaagcgctttagcaccctgactcggcacaaacgggtacacactggagagaagccctttaagtgtgaagagtgtggcaaggcatttaaacattcatctactctgacaactcataaaatgatccataccggagaaaagccctatcgctgcgaggagtgcggcaaagccttctatcactcctctcacctcaccactcacaaggtcattcatactggcgaaaaaccattcaagtgcgaagagtgcgggaaggcattcaatcatccgagtgctttgaccacccacaagttcatccatgtgaaggagaagccatataagtgtgaagagtgtgataaggccttcaaccgcttcagttacttgacgaagcataaaatcatacatagcggggaaaagagttataagtgcgaacagtgcggcaaaggattcaactggtctagtacactcaccaagcacaagaggatccacaccggcgaaaagccatacaagtgtgaagaatgtgggaaggcctttaacgtgtcgagccatttaactacccataaaatgatccacactggtgagaaaccttacaagtgcgaagagtgtggaaaggcattcaatcacagctcaaaactgaccatccacaagattatacatacgggcgagaagccttataaatgcgaggagtgcggaaaagccttcaatcagtcatccaatctgaccaaacacaaaatcatacacacaggggagaagctgtacaaatgcgaagaatgtgggaaagcctttaaccgatcttccaaccttactacccataagcggattcacacgggggaaaaaccatataagtgtgaggaatgtggtaaggccttcaacaggtcttccaaccttactaagcacaacatcatacacaccggagagaaaagttataaatgcgaagaatgcggaaaagctttcaaccagtcaagcacactgacaaagcatagaaagatccagcaaggtatggtcgcacacgcatgcaaccctaacacgctacgaggacagggacgttggattatgtag

SEQ ID NO: 61353 - DNA, 1665 bp, Artificial Sequence
  Description of Artificial Sequence: Synthetic coding sequence
atgaacgtcatgctggagaattataaaaacttagttttcttagcgggaatcgcagtgagtaaacaggaccccattacatccctggaacaggaaaaggagccatggaatatgaagatctgcgagatggttgacgaatcccctgccatgtgttcgtccttcactagggacctctggcccgagcaggacatcaaggactcattccagcaggtaattctcaggcggcatggaaagtgtgagcatgaaaaccttcagttacggaaggggtctgccaacgtagtggagtgtaaggtgtacaagaagggctatgagctgaaccaatgtctgacaacaactcagagcaagatcttcccttgcgacaagtatattaaagtgttccataaaatctttaactctaaccgacacaaaacgagacacacgggcgaaaaaccattcaaatgcaagaagtgtgacgagtcattttgtatgctactgcacctccaccaacacaagaggattcacatccgtgagaacagttatcagtgcgaagaatgcgataaggtcttcaaacggttctctaccttaacaagacacaagcgggtgcacaccggagagaagccttttaagtgcgaagagtgcgggaaggcgttcaagcactccagcactctgactacccacaagatgattcacaccggcgaaaaaccgtatcgatgcgaggagtgcggaaaggccttttatcacagcagtcatctgaccacccataaagtgatacacaccggagagaaacccttcaaatgtgaagagtgtggaaaagcattcaatcatcctagcgctctaactacccataagttcatccacgttaaggaaaagccttacaagtgtgaagagtgcgataaagcattcaaccgcttttcatacctgaccaagcacaagattattcatagtggggagaagtcctacaaatgcgaacagtgtgggaagggcttcaactggtcaagtaccctgacaaaacataagaggatccacacgggggagaagccgtacaagtgtgaagaatgtgggaaggctttcaacgtatcttcacacctgaccactcacaagatgatacacacaggcgagaaaccatacaaatgcgaggagtgcgggaaagccttcaaccactccagcaaattaacgatccataagataattcacacgggcgagaagccctacaagtgtgaagagtgcggtaaggcctttaatcaaagttctaacctgacgaaacataaaattatccatacaggcgaaaaattgtataagtgtgaggagtgtgggaaggcctttaacagatcaagtaacctgacgactcacaagaggattcacacaggagagaagccgtacaagtgtgaagaatgtgggaaggctttcaacagatcatcaaaccttaccaaacacaacattatccacaccggtgaaaagtcctacaagtgtgaagaatgcggtaaggcctttaaccagtcttccaccctaaccaaacatcggaaaatccagcagggaatggtggcccacgcctgcaacccaaacaccctgagaggccttggcgagcagatcgcaaggtctggagtgcaggaccaacctggtcagcacggcaagacaccgtctctgctgaagattcagaagttcgctggttgcggagggcgacggctgtag

SEQ ID NO: 61354 - DNA, 1452 bp, Artificial Sequence
  Description of Artificial Sequence: Synthetic coding sequence
atgggccttctaactttccgggacatagcaatcgagtttagcctcgctgagtggcaatgtctggaccacgctcagcagaatctctaccgggacgttatgctggagaactaccgaaatctggtgagtttggggatcgcagtgtccaagcccgacctgataacgtgcctggagcagaataaggaaccacagaatattaagcgcaacgagatggtggccaagcacccagttacgtgcagtcacttcacccaggacttacaatccgagcagggaataaaggactccttgcagaaagtcattctccggaggtatggaaagtgtggccaagaggacttgcaggtgaagaaatgctgtaaatcagtcggcgagtgtgaagtccataaggggggttacaactatgtgaaccaatgtttgagtgctacccaaaacaagaccttccagactcataaatgcgttaaggtcttcggtaagttcagcaactctaatcggcataaaacacgacatacagggaaaaagcatttcaagtgtaaaaacgacggaaaatccttctgcatgctgagccggctcaatcagcaccagattattcatacaagagagaagtcatataaatgcgaagaatgtggcaaatcctttaactgcagttctaccctcactcgccacaagcggatacatacgggcgagaagccctaccgctgcgaagagtgcggcaaggccttctcctggtctgcttctctgaccaagcacaagcgaatccacaccggggaaaaaccttacacttgtgaggaacggggaaaggtcttttctagatccaccctgaccaactataagagaatccacacaggcgaaaagccctacacctgtgaagagtgtggcaaagcttttagccggtcttccaccctcacaaatcataaaaggatccatactggcgagcgaccctacaagtgtgaagaatgcggaaaagccttctccctctccagcactctcaagaagcataaaattgtccataccggcgagaaactgtatacatgcgaggaatgtggcaaagctttcaccttttcatctacactgaacacccacaagcgtattcacaccggcgaaaagccatatacctgtgaggaatgcgggaaggctttctccctgccttccaccttcacctaccataagaggacgcacacaggggaaaagccttacaagtgtgaggagtgcggcaaggccttcaattgcagcagcaccctgaaaaagcataagatcatccatactggcgaaaaactgtacaaatgcaaagaatgtggcaaagcattcacattctctagcacgcttaatacacacaaaaggatccacacgggggaaaaaccctataagtgtgaagaatgtgaccagacattcaagtggcactcttcacttgccaatcacaaaaatatgcacactggggagaagccctacaaatacgaatag

SEQ ID NO: 61355 - DNA, 1488 bp, Artificial Sequence
  Description of Artificial Sequence: Synthetic coding sequence
atggctaagcgcccaggacctcccggtagtcgcgagatgggtctgttaacattccgtgatatcgccattgagttctctctggcggagtggcagtgcttagaccacgctcagcaaaatctgtaccgggatgtcatgttggagaactacagaaacctggtgtccctgggaatcgccgtctccaagcctgacttgatcacctgcctcgaacaaaataaggagccacaaaacatcaaaaggaatgagatggtcgctaagcaccctgttacttgctcccactttacccaggatctccagagcgagcaaggcatcaaagattcattgcagaaagtcattctgaggagatacgggaagtgtggacaagaggacttgcaggtaaagaagtgctgcaagagcgtcggtgaatgcgaggtgcacaagggcggatataactatgttaatcagtgtctgagcgccacccagaataaaactttccagactcataagtgtgttaaagtgttcggtaagttcagcaatagcaatagacataaaacgaggcataccgggaagaagcactttaagtgcaagaacgatggtaagagtttctgcatgctttcccgtctcaaccaacatcagattatacacacccgagagaagtcgtacaagtgcgaggagtgcggaaagtcattcaattgcagctctactctgaccagacacaaacggattcacaccggggaaaaaccttatcgctgcgaggaatgcgggaaagccttctcatggagtgcctcgctaactaagcacaaacggattcacacgggagagaaaccatacacttgtgaggaacgcggaaaggtgttctctagatccacactcacaaattataaaagaattcatacaggggagaagccctacacatgtgaggagtgcggaaaggccttctcccgaagcagtacactgacaaaccacaagcggatacacaccggtgaaagaccatataagtgtgaagagtgtggtaaggcattctcactgagttcgaccctgaaaaaacataaaattgtgcataccggggaaaagctttacacctgcgaggaatgcggcaaggcctttactttttcctctacactaaacactcacaagcggattcataccggagagaagccttacacatgtgaggaatgcggaaaggccttttcattaccctccaccttcacctaccacaaaaggacccatactggcgaaaaaccgtacaagtgtgaagagtgtggtaaggccttcaactgtagcagtactttgaagaagcataaaatcatccatacaggtgaaaagctgtacaagtgcaaagaatgtggcaaggccttcactttcagttctacactcaacactcataagaggatccacacaggagagaaaccatataagtgcgaagagtgcgaccagaccttcaaatggcattctagtctcgctaaccacaaaaacatgcatacaggtgagaagccttacaaatatgaatag

SEQ ID NO: 61356 - DNA, 2724 bp, Artificial Sequence
  Description of Artificial Sequence: Synthetic coding sequence
atgctggagacctataatagtttagtttctctgcaggagttggtttcctttgaagaagttgctgtccatttcacttgggaggagtggcaggacttggacgacgcccagcgcacactataccgcgacgtgatgcttgagacatactctagtctcgtatctcttggacactacataactaaacctgaaatgatattcaaactcgagcaaggagctgaaccctggatcgtggaagagacacctaacttgcggctctctgcagtccaaatcatagacgatttgatagaacgatcgcatgaaagccacgatcgctttttttggcagatcgtgattactaattccaacactagcactcaagaacgcgtcgagttgggtaaaaccttcaatcttaactctaatcacgtgcttaatctgataatcaacaacggaaatagctcaggtatgaaaccgggtcagttcaacgattgccagaacatgcttttccctattaagccgggagagacccaatccggcgaaaagcctcatgtctgtgatatcacaagacggagccacaggcatcacgagcatctcacacagcaccataaaatacaaacactactgcagaccttccagtgtaatgagcaggggaaaacctttaatactgaagccatgttttttattcacaaacgagtccatatcgtgcagacattcggaaagtacaatgagtacgagaaggcttgtaacaattccgccgtgatcgtgcaagtcatcacgcaggtggggcagccaacttgctgtaggaaatctgactttaccaagcaccagcagacacacacaggagaaaagccatacgagtgtgtggaatgcgagaaaccatctatatctaagagcgacctgatgctgcaatgcaagatgcctactgaagagaaaccttatgcttgcaactggtgtgagaagctgtttagctataagtcgtctctcatcatccaccaaaggatccacacgggagaaaagccttacggttgcaacgaatgtggcaaaaccttcagacgcaagtctttcttgacactgcatgaacggacacacactggcgataagccttacaagtgtattgagtgcggaaagacgttccactgcaaatccctgcttacgctgcaccatcgtacacattcgggagagaagccctatcagtgcagcgaatgcggcaagactttttctcagaagtcctatttgaccattcatcataggacccatacaggggagaaaccatatgcctgcgatcactgcgaggaggcgttctcacataagagtcgcctgactgttcaccagagaacgcacacaggtgagaagccatatgagtgtaatgagtgtggaaagccctttatcaataagtctaacctgaggctacaccagaggactcacactggagaaaagccttatgagtgtaatgagtgcggcaagacctttcaccggaaaagctttctgaccatccaccaatggactcatactggagagaaaccatacgagtgcaacgaatgcggcaagaccttcagatgcaaaagtttcctcacagttcaccagaggacccatgcaggtgaaaaaccctatgcatgcaacgaatgcggcaaaacctatagtcacaagagctacctgaccgtccatcaccgcacacacaccggcgagaagccatacgagtgtaatgaatgtggaaagtcctttcactgcaaatccttcctgaccattcaccagaggacccatgccggtaaaaaaccttatgaatgcaacgagtgcgagaaaacattcattaataagctgaacctgggaatccacaagagaacacatactggagaaaggccttatgagtgtaatgagtgcggaaagacgttcaggcagaaatccaatctttccacacatcaggggactcatacaggggaaaaaccttatgtgtgcaacgagtgcggaaagacctttcatagaaaatcattcttaaccatccaccagcgcactcacacaggcaaaaaccgtatggatgtgatgaacgtcgagaaacttttcgtgaggaaccacactctgctgtacattcgggagcttactccgggtaagagccccatgaacgtaatgaatgtggagaacccctttattcggaggcagattttccgatccataaaggtgttcacccgagggcgtaacccgatgaacgttgcaaatgtggaaaagccctgtcagaagagcgtcttaaccgttcatcaccgcacacacacgggcgaaaaaccctatgagtgcaatgagtgtggcaaaaccttttgtcacaagtctaatctgagtactcaccaggggacgcacagcggcgaaaagccgtacgaatgcgacgagtgtaggaagaccttttacgacaaaacagtattgacgatacaccagcgcacccataccggtgaaaagccattcgaatgcaaggagtgcagaaagacattctcacagaaaagtaaactttttgtacatcataggacccacaccggagaaaagccctttagatgcaatgagtgtaggaagaccttctctcaaaagtcagggttatccatacatcagagaacacatacgggggaaaaaccctatgaatgcaaagaatgcggcaaaacattttgtcagaaatcccacctctcaaggcatcagcaaacgcatattggagagaagtccgacgtggctgaagcaggttacgtatttcctcagaatcatagtttttttccgtag

SEQ ID NO: 61357 - DNA, 2745 bp, Artificial Sequence
  Description of Artificial Sequence: Synthetic coding sequence
atgtttcccgtattttctggatgcttccaggagttgcaggaaaagaacaagagcctggaattagtgtctttcgaggaagtggccgtccattttacatgggaggagtggcaagatcttgacgatgcccagaggactctgtaccgcgacgtaatgctcgagacatacagttcactggtctctctgggacactatatcaccaaaccggagatgatcttcaagcttgaacagggagcggaaccgtggattgtggaggaaacccccaacctcaggctttctgccgtccaaataattgatgacctcatcgaaagatcccatgaatctcacgatcggtttttctggcaaattgtaatcaccaattcaaacacctcgactcaggagcgtgtcgaactggggaagacttttaacttgaacagtaatcatgtcctgaatctgataatcaacaacggaaactctagcgggatgaagcctggacagttcaatgactgtcagaacatgctattccccatcaagcccggtgagacccagagtggcgagaagccacatgtgtgcgacatcacaaggagaagccaccgccaccacgaacatcttactcagcatcataaaatccaaactctgcttcagacttttcaatgtaatgagcagggaaaaacgtttaacacagaagcaatgtttttcatccacaaacgggttcatatcgtgcagacctttggaaagtataacgagtatgaaaaggcctgtaataattcagcagtgatagttcaggtgatcactcaggtgggacagccaacatgctgtaggaagtcggatttcacaaagcaccagcaaacccacactggagagaagccctatgagtgtgtggaatgtgagaaaccctctatcagtaaatcagacctgatgctgcagtgtaaaatgccaactgaagagaagccctatgcctgcaactggtgcgagaaactcttcagctacaagtcatccctgattatccatcagcggattcacactggagaaaaaccctacggatgtaacgaatgtggtaaaacttttagacgtaaaagttttcttacccttcatgagcgcacacacactggcgataaaccatacaagtgcatcgagtgcggaaaaactttccactgcaaatccctgctgaccctgcatcatagaactcattctggcgaaaaaccttaccagtgctcagagtgtggcaaaacgttctcccagaaaagctacctgacaatccatcacaggactcataccggcgagaagccatacgcctgtgaccactgtgaggaggcctttagccacaagtcacgcttgactgtccaccagcggacgcatacaggggaaaagccctatgagtgtaacgagtgcggtaaaccgtttatcaacaaatccaatttacgcctccaccagcggactcacacaggcgagaaaccttacgagtgtaacgaatgtgggaaaacatttcatcggaaatccttccttactattcatcaatggacacacaccggggagaagccatacgaatgtaacgagtgtggtaagacctttaggtgcaaatccttcctaactgtgcaccaaaggacccatgccggagagaagccctatgcgtgcaatgaatgtggcaaaacttactcccataaaagctatctcacggttcatcacagaacccacactggtgagaagccctacgagtgcaatgaatgtgggaaatcctttcactgcaagtcatttctgactattcaccaacggactcacgccggtaagaaaccctacgagtgcaacgagtgtgagaaaacttttattaataagctcaatttggggattcataagagaacacacacgggtgaacgaccatacgagtgtaatgagtgcggaaaaacattccggcagaagtcaaatttgtctacacatcagggaactcacactggcgagaagccttacgtttgtaatgagtgtggcaaaacttttcaccgcaagtcatttctgaccatccaccagagaacccatacaggcaaaaatagaatggacgtcatgaacgtcgagaaactcttcgttcgcaatcataccctgttgtatattcgcgaattgaccccagggaaatcaccaatgaacgtgatgaacgtggagaatccgttcattcgacgtcagattttccggtctatcaaagtgtttacccggggacgcaaccccatgaatgtggcaaatgttgagaaaccgtgccagaagagcgtcctcacggtgcatcaccgcacacacacaggcgagaagccctacgagtgtaatgagtgcggtaagacattttgtcataagtccaacctatcaacccaccaggggacacatagcggtgaaaagccttatgagtgcgatgagtgtcgtaaaaccttctatgataaaacagtgctgactattcatcaaagaacacacaccggagagaaaccttttgaatgcaaagaatgccgaaagacctttagtcagaaatccaagttgttcgtccatcacaggactcacacaggcgaaaagccattcaggtgcaatgagtgcaggaaaacctttagccagaagtctggcctatctatccaccagcgcactcacactggagagaaaccttacgagtgcaaagaatgcggcaaaaccttttgccagaaatcccatttgtccaggcatcagcaaacacacatcggcgagaagagtgatgtagccgaggcaggctacgtgtttcctcagaaccattcattcttcccatag

SEQ ID NO: 61358 - DNA, 381 bp, Artificial Sequence
  Description of Artificial Sequence: Synthetic coding sequence
atggggctcctgaccttccgagacgttgccatcgagttttcgcgagaagaatgggagcaccttgattctgaccagaagctgctctacggagatgttatgctggagaactacggcaacctggtgtctctaggcctggccgttagtaagcctgatctgatcacatttctggaacagcgaaaggagccgtggaacgtgaagagcgcagaaaccgtcgcaatacagcctgacatcttttcacatgacacccagggcctgctgaggaagaagttaatcgaggcctccttccagaaagtcattctggacgggtacgggtcatgtggcccacagaacctgaacctgagaaaagagtgggaaagcgagggcaagatcatcctgtggtag

SEQ ID NO: 61359 - DNA, 537 bp, Artificial Sequence
  Description of Artificial Sequence: Synthetic coding sequence
atggtgaatgtgcccgatatcttctctcacgatacacagggcctgctccgaaaaaaactaatcgaagcatcgtttcagaaagtcatcctggacgggtatgggagctgtggaccccagaaccttaacctcaggaaagaatgggaatcagaagggaaatgcgagggccacaatggatactacgatggtcatactaagtgtaaaaccacaacctataacaaaaaccttacggtgaccggagggcagaaacacgaaaaaacccagttcatgtctgtggctttttccaaaccctgtgtgtctgtcagcaaatgccagcatcagtttctcaaactcaccttcagctttaaaggaaatttggacaatcctaattccgatctggtgcatgtctctaacaaccacctcaaccagctgaagtaccggaccggagttaacgtgcagtcaaatatttctgagaaggagaggttcaagaacgaggaggtgattagtaagtacgaccaatttgatggctcactgctgaaggtgtgtttcaccaataagtag

SEQ ID NO: 61360 - DNA, 1428 bp, Artificial Sequence
  Description of Artificial Sequence: Synthetic coding sequence
atgtctctcgcaacagtggatactctgtacatattttcacacgacacccagggtctcctgcgcaaaaagctcatcgaagctagctttcagaaggtgatcctggatggttatgggagttgtggaccacagaatcttaatttgcggaaggagtgggagtctgaagaaaaaaaccaatataacaaaagtgataccactcttagccagggcatctcaccacgccgacatcaaaagacccattttctgcacaaccactgcaaaagaaagaagtgcgagaaggcgttccatgaatgcaccaatcacgtccaccagtcgatatttatacaggaaaaatccgctaagtgtaacaagtgcattgagacattcatccaaagctcgaagcacacccagccccagagaattcacatcggggagaaaagccatagatgcaataatggggagaagattttaagtaagctgtcttcattgaggaagcataaaatcattcataacgaggagaagccttacaagtgcaaggaatgtgataaggccttcaaccatcgttcccacctcacccagcaccagatcatacataccggtgaaaagccgtacaagtgcaaggagtgtggaaaggcattcaattccagctcctactttaccagacaccagagaattcatacgggcgagaaactttataaatgcaaagcctgttctaagtgctttacccacagcagcaacctgctggtgcatcaaagaatacacactggtgagaagccatataagtgtaaggagtgtggcaagtctttcaaagtctcctccgctctgacacaacacgagcggattcatacgggggagaaaccatacaagtgtaaggagtgcagcaaggcattcaactgcagaagctacctgactaaacatcaacgcattcacacgggcgagaaactctataagtgtaaatcctgctccaagagtttcagcaggagtagctccctgatcgtgcaccagcgtatacataccggtgagaaaccatataaatgcaaagagtgcggcaaagcctttaactgttcatctcgcctgacccagcaccagcggatacacacgggcgaaaaaccatacatttgcaaggagtgcgggaaggctttcaattgcagctcctccctgactaagcaccaacggatccacaccggggtgaaactctataaatgtaaggcatgttccaagagttttagccacagcagctgtctgagcgttcaccagatcactcacacaggaatgaagccctacatttgcaaggattgcggcatcagcttcaaccggtctagtaacttgcgcaggcaccaaatgattcatactggtgagaaaccatacaagtgtaaggaatgcggcaagctgttcaataggtgctctaccctgactagacataaatcaattcacacaagggagtttctgtag

SEQ ID NO: 61361 - DNA, 1860 bp, Artificial Sequence
  Description of Artificial Sequence: Synthetic coding sequence
atgggaccactgactttcatggacgtggctattgaatttagtgtcgaagaatggcaatgtctcgatacagcacagcaaaacctgtaccgtaacgtgatgctagaaaattaccgcaacttggtctttttagggattgcggttagcaaacctgatctaatcacatgcctggagcagggcaaggaaccatggaacatggagcggcacgagatggtggctaaacctcctgggatgtgttgttactttgcccaggatctgcgcccagaacagagcatcaaagcctcactgcagagaataattttacggaaatacgagaagtgcgggcaccacaatttgcaactgaagaaaggttacaaatctgtggatgagtacaaagtgcacaagggttcatataacgggtttaatcaatgcctgaccaccacccagtccaagatcttccagtgcgataaatatgttaaggatttccacaagttcagtaactctaaccggcacaaaaccgagaagaaccccttcaagtgtaaagagtgcggcaagtccttttgtgtcctgagccatttgacccaacacaaaagaatccataccacagtgaattcctacaagttagaggagtgcggcaaggcattcaacgtctcaagcaccctatcccagcacaagcggatccataccggccagaagcattacaaatgcgaggagtgcgggattgcctttaacaagagcagccatctgaacactcacaagatcattcacaccggggaaaagagctacaagagggaagaatgcggaaaggcgttcaacattagctctcacctcactacacacaaaattattcacacaggcgagaatgcgtacaagtgcaaggagtgcggcaaggccttcaaccagagcagcacactgacaagacataagattatccatgcgggtgaaaaaccctacatctgcgagcattgcggtagagccttcaaccaatccagcaatctgaccaagcacaagagaattcataccggggacaagccatataagtgtgaagagtgtgggaaggctttcaacgtgagcagcacactcactcagcataaacggattcacacaggcgagaagccatataagtgcgaggaatgcggaaaggctttcaacgttagctcaactctgacccaacataagcgaatccacaccggggagaagccatataaatgtgaagagtgtggcaaggctttcaacacttcttcccacctgactactcataagcggatacatactggagagaagccctataagtgtgaagaatgcggaaaggcattcaatcagttttcacaactgactacccataaaataatccacaccggagaaaaaccctataagtgcaaagaatgtggcaaagccttcaagagatcttctaacctgacggaacaccgtatcattcataccggagagaagccttacaagtgtgaggagtgcggaaaagctttcaatctttccagccatcttactacccacaagaaaattcacacaggtgagaaaccttataaatgtaaggaatgcggcaaggccttcaaccaatcaagcaccttggctagacataagatcatccatgcaggagaaaaaccgtacaagtgcgaagagtgcgggaaggccttctaccaatactccaacttaacccagcacaagattatccatactggtgagaaaccttacaaatgcgaagagtgtggaaaggccttcaattggtcctccaccctgacaaaacacaaggtgatccatacgggtgaaaagccatataagtgcaaagagtgcggcaaggcctttaaccaatgtagcaacctaacgacccacaaaaagatccacgccgtcgagaaatctgataaatag

SEQ ID NO: 61362 - DNA, 1500 bp, Artificial Sequence
  Description of Artificial Sequence: Synthetic coding sequence
atgagagtactgacctttcgcgacgtcgccgtggaatttagtcctgaggaatgggaatgcctggacagcgcgcagcagagactatatcgggacgtaatgctggagaattacggaaacctcttctctctggggctagcaattttcaagccagacctcattacttacctagagcaaaggaaagaaccatggaatgcgcgacggcagaaaactgtggccaaacacccagcaggttccctacactttaccgccgaaatattgcttgagcacgatatcaacgactcgtttcagaaggttatccttcggaagtctgggtcatgcgacctgaatacgctgcgcctgaaaaaagattaccagagagtcggaaattgcaagggccagaaatcatcctacaatggaattcaccagtgcctgagcgctacgcgctcaaaaacatgccagtataacaagtgtggcaaagccttcgggctgtgctcaattttcaccgaacataaaaagatattttcccgcgaaaagtgctacaagtgtgaggagtgcgggaaggactgcaggctatccgacttcaccattcagaagcgaatacataccgcagatcgaagctataaatgcgaggagtgcggcaaggcatgcaagaagttctcaaacctcacagaacataatcgtgtgcacaccggaaagaagccctacaagtgcgaggagtgcggaaaaacgttcacttgcagctccgctctcacgaaacataaacgaaaccatacgggtgaccgtccctacaaatgtgaggaatgtcataaggcatttcgttgttgcagtgatctcacaaagcacaagcgcattcacactggggagaagccctacaaatgtaaggaatgtcacaaggcgttccgctgctgtagtgacctcaccaagcacaagcggatccacacgggtgagaagccatacaagtgcaatgaatgtggtaaagctttcatgtggatatctgccctttcacagcataatcgcatacataccggggagaaaccttacatctgcgaggagtgcgggaaagcctttacctattcctccacactgataagtcataaacgcattcacatggagcttagaccatataagtgcgaggaatgtggcaaaacctttaaatggttttcagatctgaccaatcacaagcgaatccatactggagaaaaaccctacaaatgtgaagagtgcgggaagtctttcacatgctcatccaatctgattaaacacaaaaggattcacatggaggtgcggccatacaagtgtgaggaatgtgggaagaccttcaagtggttccctgatctcactaatcataaaaggatccacaccggtgagaaaccatacaaatgcgaggaatgcgggaaaaccttcacctgcagcagctcccttattaagcataagagatctcataccggagatcggcctactagcgccaaaaacgtcgctaagcccctcggcggttcccaaaccctgttgaatattcgctag

SEQ ID NO: 61363 - DNA, 1869 bp, Artificial Sequence
  Description of Artificial Sequence: Synthetic coding sequence
atggggagcctgacgttcagggatgttgctattcaattttcactggaagagtggcagtgcctagacaccgcccagcaaaacctctacaggaatgtgatgctcgaaaattataggaatttggtatttctggggatcgcggctcccaaaccggatctcatcatcttcctggaacaaggcaaagagccctggaatatgaaaaggcatgagttggtgaaggaaccccctgtgatttgttcacacttcgctcaagacctctggcccgagcagggtcgagaggacagcttccagaaggtaattctgcgcaggtatgagaagtgcgggcacgagaacttacagctgaaaattgggtgcacaaacgtggacgaatgtaaagtgcacaaaaagggatataacaaactcaatcagtccttgactaccacccagtccaaggtcttccaatgcggcaagtacgcgaatatttttcacaaatgctccaactcaaagaggcacaagatccgtcatactggcaagaaacttctgaaatgcaaggagtacgttcggtctttttgtatgctaagtcatctgtcccagcataaacgtatctataccagggagaacagctataagagtgaggagcacggaaaggcttttaattggtctagcgccctgacctacaagcgaatccatactggagagaaaccttgtaaatgcgaggaatgcggcaaagcgttttccaagttctctattctgacaaagcacaaagtcatccacaccggcgagaagcactacaagtgcgaggaatgcggaaaagcatttacacgttcttccagcctgattgaacacaaacggagccacgccggagagaagccctacaaatgtgaggagtgcggcaaggctttctcaaaagcatccactctgacggcccataagaccattcatgcgggagagaagccgtacaagtgtgaggaatgtggaaaggccttcaaccgctcctctaaccttatggaacataagaggattcacaccggagagaaaccatgtaagtgcgaagagtgtggaaaggcctttggcaactttagtacgctgaccaagcataaggtgattcacaccggggaaaagccctacaaatgcgaagagtgtggcaaggcttttagttggccctcaagtcttaccgagcacaaacggatccatgcaggagataagccatacaagtgtgaagagtgtggcaagacctttaaatggagctcaaccctgacaaaacataaaattatccacacaggtgagaagccctacaaatgtgaagagtgcgggaaggcctttacaacgttctcctcgctgaccaaacacaaggttatccatactggtgaaaaacactataagtgtgaggagtgtggcaaagtcttcagttggtcatctagtctcacaactcacaaagcaatacacgctggggaaaagctatacaagtgcgaagaatgcggcaaggcattcaagtggagctccaatctgatggagcacaaaagaattcatacaggggagaagccatataagtgcgaggaatgcggcaaggcatttagcaaggtggcaaatttgactaaacataaagtgatccataccggggaaaagcagtacaaatgcgaggagtgcggtaaggctttcatttggtctagccgactttccgagcacaaacgtattcacaccggagaaaaaccatacaagtgcgaagaatgtggaaaggctttttcatgggtcagcgtcctaaataaacacaagaaaatccacgcagggaagaagttctacaaatgcgaagaatgtggtaaggacttcaatcaatcatcacatttaaccactcataagcggatccacactggaggtaaaactctgcaaatgtag

SEQ ID NO: 61364 - DNA, 3522 bp, Artificial Sequence
  Description of Artificial Sequence: Synthetic coding sequence
atgcccggagcccctggatcattggaaatgggacccttgacctttcgcgatgtcacgatcgagttcagcctggaggagtggcagtgcctcgacacggtgcagcaaaacctgtacagagacgtgatgttggaaaattatcgcaatttggtcttcttgggcatggccgtctttaaacctgacctgataacctgcctgaaacaaggaaaggagccctggaatatgaaacggcacgagatggtgacaaaaccacccgtcatgaggagtcactttacgcaagacctctggcccgatcagtccaccaaagattccttccaggaagttatcctgcggacctacgcgaggtgcggacataaaaatttgcgtttgaggaaagactgcaaaagcgctaacgaaggtaagatgcataaggaggggtacaataaactgaatcagtgtcggactgctacacagcgaaagatctttcaatgcaataaacacatgaaagtcttccataaatacagcaaccgcaataaagttcggcacaccaaaaagaaaactttcaaatgcatcaagtgctccaagtccttctttatgctgtcgtgcctgatccgacataaaaggattcacatccgacagaatatatataagtgtgaggagagaggaaaagcctttaagagcttcagcactctgactaagcataaaatcatacacaccgaagacaagccgtataaatacaaaaaatgtggaaacgcattcaagttctctagcacgtttacaaagcataaacgcatacacaccggggagaccccttttagatgtgaagagtgcggaaaggcatttaaccagagttccaatttgacagaccataagcggattcacaccggagaaaagacctacaaatgtgaggagtgtggaaaggcttttaagggctcaagcaatttcaatgcccataaggtaattcatactgccgaaaagccatacaagtgcgaagactgcggcaaaacttttaaccacttttccgctcttcgaaaacataagattattcacaccggcaaaaagccgtacaaaagggaagaatgtgggaaggcctttagccagagtagtaccctgcgcaagcacgaaatcatccacacaggagaaaagccatacaaatgtgaggaatgcgggaaagcctttaaatggtcgagcaaattgaccgtgcacaaggtggtgcacaccggagagaaaccatacaagtgtgaagagtgtggcaaagcattttctcaattcagcacccttaaaaagcataagattatacacaccggtaagaagccctacaaatgcgaagagtgtggcaaggcgttcaactcctcgtcaacgctcatgaaacacaaaattattcatactggtgagaagccctacaaatgcgaagagtgcggtaaagcctttcgacagagcagtcaccttacccggcacaaggccatacatacaggcgagaaaccttacaaatgtgaagaatgtgggaaagccttcaaccacttctccgatttgagacgacacaagataattcacactggtaagaagccttataagtgtgaggagtgcgggaaggcgttctcccagtcaagcacactcaggaaccaccagattattcacacaggcgagaaaccttataagtgtgaagagtgcgggaaagctttcaaatggagcagcaaactgacggtgcacaaggtgatccacacaggagaaaagccctgtaaatgcgaagagtgcggcaaggcctttaaacacttcagcgctctgaggaaacataaggtgattcacaccagggagaaactttacaagtgcgaggagtgtggcaaagcttttaataactcatcaattctcgctaagcacaaaattattcacacgggtaaaaaaccatataagtgcgaagagtgtggaaaggccttcaggcagtcttcccatcttacaaggcacaaggccattcatacaggggaaaagccctacaaatgtgaagagtgtggcaaagccttctcacacttttccgccctgagacgacacaagattattcatacagggaaaaagccttacaaatgtgaggagtgcggaaaggcctttagccacttctccgcactgcgcaggcacaagattatccatactggagaaaagccctataaatgtgaggagtgtggcaaagcgttcaagtggtcttctaaactgacagtgcacaaagtgatccataccgcggagaagccttgcaagtgtgaggagtgcgggaaatccttcaagcacttctcagctctgaggaagcacaaggtgatccacacaagagagaagttgtacaaatgtgaagagtgcgtcaaggccttcaacagtttcagcgcacttatgaagcacaaagtcatacacactggtgagaagccttataaatgcgaggaatgcggcaaggctttcaagtggtcatctaaattaacggttcacaaggtgatccatacaggcgaaaaaccctgcaagtgtgaggagtgcggcaaggctttcaagcacttttcagctttaagaaaacataaggtcattcacacagggaaaaagccgtataagtgcgaagagtgtgggaaagcgtttagccagtcttcctccctgaggaagcacgaaatcattcactcgggcgaaaagccctacaagtgcgaagaatgtggtaaggcttttaagtggctatcaaaacttacagtgcataaaatcatacacaccggcaagaagccctataagtgcgaagagtgtggcaaggcctttaacgatagtagcactcttatgaagcataaaataattcacactggcaaaaaaccgtataagtgcgccgagtgtggaaaagcatttaaacagtctagccacctgactagacacaaggctatccacacaggtgagaagccatataagtgtgaagagtgcggaaaagattttaataacagcagcactctcaaaaagcacaagctcatccatacccgagaaaagctatacaagtgcgaagaatgcgtgaaggcattcaataatttttcggctctcatgaagcacaagattatccatacaggcgagaagccctataaatgtgaagaatgtggaaaagcttttaagtggagttccaagctcactgagcacaaggtgatccatacaggcgaaaagccctgcaagtgtgaagaatgcgacaaggcctttaagcacttttcagcgctaaggaaacataaagtgatccacacaggtaaaaagccttatcaatgtgacgaatgtggtaaggcttttaataacagctcaaccctaaccaaacataagatcatacacacaggcgaaaaaccatacaaatgtgaggaatgcggcaaagcatttagccaaagctcaatattgaccaagcataagataatacactcagtggagaaaccttacaagtgcgaagagtgtggaaaggcgtttaatcagagctcacatctgacgcggcataagacgatccacaccggcgaaaaaccctataagtataagacaatccatacgggcgagaagccgtataagtag

SEQ ID NO: 61365 - DNA, 3759 bp, Artificial Sequence
  Description of Artificial Sequence: Synthetic coding sequence
atgcccggtgcaccgggatccctggaaatgggcccattgacttttagggatgtaaccattgagttttccctggaagagtggcagtgcctagataccgtccagcagaacctgtaccgggatgtcatgctggagaactaccggaacctggtcttcctgggtatggccgtgtttaagccggatctcattacttgcctgaaacagggcaaagagccttggaatatgaagcgtcacgagatggttaccaaaccccctgtcatgaggtcccacttcacacaagatctttggccggatcaatccactaaggacagctttcaagaagttatcctgagaacctacgccaggtgcgggcacaaaaatctgcgcctgcgaaaggattgcaaaagcgctaacgaaggaaagatgcacaaagagggatacaataaactcaaccagtgtagaacagcgacacagagaaaaatttttcagtgcaacaagcacatgaaggtcttccacaagtactctaaccgaaataaggtccggcatacgaaaaagaaaacttttaaatgcattaagtgcagcaagtctttctttatgctgagctgtctaatacgtcataagaggattcatattagacaaaatatttacaagtgtgaggagcggggaaaggcgtttaaaagtttcagcactctcacaaagcataaaatcatccataccgaagataaaccttataagtataagaagtgcggtaatgctttcaaattcagcagcacctttaccaagcacaaaaggatccatactggcgagactccttttagatgtgaagaatgtggaaaggcattcaatcagagctctaacctgactgatcataagcgcatccacacaggagagaagacatacaagtgtgaggaatgtgggaaagcgtttaaaggcagttccaattttaacgcacacaaagtgatccacactgctgagaagccttataaatgcgaggattgtgggaagactttcaaccacttttccgctttaagaaagcacaagattatccatacggggaagaaaccctacaagcgcgaagaatgcggcaaggccttctcccagtccagcactctgcgcaagcacgagattatccacaccggggaaaaaccgtataaatgcgaagaatgtggcaaggcttttaagtggagtagcaaactaacagtgcacaaggtagtgcacaccggagaaaagccatacaagtgtgaggaatgtgggaaggcattctcacagttctctactcttaagaagcacaaaataatacatacaggaaagaagccctataagtgcgaggagtgcggcaaagcatttaactctagctccaccctcatgaagcacaagatcattcacacaggcgagaaaccatacaagtgcgaagagtgcggcaaagccttccggcaaagcagccatctcacccgacacaaagccatccacactggcgagaaaccttataaatgcgaggagtgcggaaaagcctttaaccactttagtgacttacgcaggcacaagataattcatacgggtaagaagccttacaaatgcgaagaatgcggcaaagccttctcccagtccagcacactgcggaatcaccagatcattcataccggcgagaaaccatataagtgcgaggagtgcggaaaagcattcaaatggtcctctaagcttaccgtgcacaaggttatccacaccggtgagaagccctgcaaatgcgaggaatgtggtaaagcatttaagcactttagcgctctgagaaaacacaaggtgatccatacccgagaaaagctctataagtgcgaagaatgcgggaaggccttcaacaatagttccatcctcgccaagcataagattattcatacaggcaagaagccatataaatgcgaggagtgcggcaaagccttcaggcagagttcacacctgacccggcacaaggcgattcacaccggagaaaagccgtacaaatgtgaggaatgcgggaaagccttctcccacttctctgccttacgcagacacaaaattattcacactggaaaaaaaccttataagtgtgaggagtgtggtaaggcctttagccacttttcagctctgcggagacacaagatcatccataccggagagaagccatataagtgcgaggagtgtggtaaggccttcaagtggagtagcaaactgacagtgcataaagtcattcataccgcagagaaaccttgtaagtgcgaggaatgtgggaagtcctttaagcacttctctgcgttgcggaagcacaaggtgattcacacacgggagaagttatataagtgtgaggagtgtgtgaaggcatttaactccttctctgcgctgatgaaacacaaggtaatacatacaggcgagaaaccttataagtgcgaggagtgcggcaaagcctttaagtggagctctaaactcaccgtccataaggtgatccataccggagagaaaccatgtaaatgcgaggagtgtggaaaggcttttaagcatttttccgccctgcgcaaacacaaggtgatccacacgggcaagaaaccatataagtgcgaggagtgcggaaaggcattctctcagtcaagttcactgcggaaacacgaaatcattcatagcggggagaagccatacaagtgcgaggagtgcggcaaggccttcaagtggctgtctaagctaactgtgcataaagtcatccatactgcggagaagccatgcaaatgtgaagagtgtggtaaggcctttaagcactttagcgcacttcgtaagcacaagatcattcacaccggaaaaaagccttacaaatgcgaggagtgcggtaaagccttcaacgattcaagtaccctgatgaagcataagatcatccatacgggaaaaaaaccctacaagtgtgcggagtgtggcaaagccttcaaacagtcgtctcacttgactcgccataaagccattcacacaggagagaagccttacaaatgtgaggaatgtggtaaggacttcaacaatagctccactctgaagaagcacaaattgattcatactcgagaaaaactttacaagtgcgaggagtgtgtgaaagcatttaacaacttcagcgccttaatgaagcacaaaataattcatactggcgagaagccctacaaatgcgaggaatgcgggaaggcattcaagtggagttccaaattgaccgagcataaagttattcatactggtgaaaaaccttgcaagtgcgaggaatgtgataaagccttcaaacatttttccgcactaaggaagcacaaagtgattcatactggaaaaaagccgtatcagtgcgacgaatgtggcaaggctttcaacaattcatccacccttaccaagcacaagattatccacactggagaaaaaccttataaatgcgaagagtgcgggaaggcgttttctcagtcctccatactcaccaaacataagatcattcactcagtggaaaagccctataaatgtgaagaatgtggaaaggcctttaatcagtcttcccatctgacccgccataagactatccacacgggtgaaaaaccatacaagtgcgaggaatgcggcaaagccttcattcagtgttcatatctcattcgacataagacaattcacacacgggagaagcctacaaacgtgaagaaggtccctaagctgctgagcaatccccacacactgctagataagaccatacacaccggagaaaaaccatacaaatgtgaggaatgtgccaaggctttttag

SEQ ID NO: 61366 - DNA, 576 bp, Artificial Sequence
  Description of Artificial Sequence: Synthetic coding sequence
atgacagaccccagcctgggcctgacagtcccaatggctccacccctggccccactcccaccgagggaccccaacggagcagggagcgagtggaggaagcccggagcggtgtcctttgccgatgtagcagtatatttttctcgggaagagtggggctgccttaggcctgcgcagcgggcactgtatcgggatgtgatgcgagagacttatgggcacctgggggctctaggcgaatctcccacttgtctgcccggaccctgcgcaagcacagggcctgcagcccctctaggcgctgcttgcggcgtgggcggacctggtgctggacaggcagcatcctctcagaggggcgtgtgcgttcttttgccacaggagagcgaggctgcttctcgacgttccagtcccggatggcgaagaagacctaactgcgggatcagattgcctcggattaggcggtggcgctcggtcagacaaaagcggacccagcagatcccagaaacaagaaagcgcaaggacaaggggaaaggtagagagccatggcgcagccccactctctggcctcccggattgctcggctag

SEQ ID NO: 61367 - DNA, 573 bp, Artificial Sequence
  Description of Artificial Sequence: Synthetic coding sequence
atgactgacccgagcctgggactgacagtgcctatggctcccccactagcacccctcccacccagagaccccaacggggcaggtagcgagtggcgtaagccgggagccgtctccttcgctgatgtcgcggtttattttagtcgcgaagagtggggctgccttcggccagcccagagggccctataccgggatgttatgagagagacttacgggcacttaggcgcacttggcgaatccccaacatgtctgcccggaccctgcgctagcacaggccctgcagcccctctcggtgccgcatgtggcgtagggggacctggagcagggcaggctgcctcctctcagaggggagtgtgtgtgttactaccacaggagagtgaagcggcttctagacgttcatccccaggatggcgacgcaggcctaactgcggcataaggctgccgaggatccgcagatggagatccgtgaggcaaaagcggacccaaattcccgaaactcgtaagagaaaggacaaaggaaagggaagggaaccctggcgatcccccactttgtggccaccgggtcttctgggctag

SEQ ID NO: 61368 - DNA, 993 bp, Artificial Sequence
  Description of Artificial Sequence: Synthetic coding sequence
atgacagacccttccctgggactaacggttccaatggctccacctctggcgcctctgcccccaagagacccaaatggcgcaggtagtgagtggcgtaagccaggagctgtgtctttcgcggatgtggccgtctacttcagccgtgaagagtgggggtgcctgaggcccgcacaaagggcactatatagagacgtgatgagggagacttacggacacttaggggcactgggggtaggaggctccaagccagccctgatatcatgggtagaggagaaggcagagctgtgggaccccgctgcccaggaccctgaagtcgctaagtgcccaacggaggcggacccagattcccgaaataaggaagaagaaagacaacgggaaggtactggtgcccttgaaaagcctgaccctgtggccgcaggaagccctggtctaaaggctccacaggccccattcgcaggtttagagcaattgtcaaaggcaaggagacggagtaggcccaggttttttgctcatccgcctgtgcccagggccgaccagcggcatggctgctacgtctgcgggaaaagctttgcttggcgaagtaccctggtagaacatatttattcacacagaggggagaagccattccattgtgctgactgcgggaaaggtttcgggcatgcaagcagcctctcaaagcatagagccatccaccgaggcgaacgacctcaccggtgtcctgaatgcggacgagcatttatgcgaagaactgctctcaccagccacctccgggtgcatactggagaaaagccataccggtgcccacaatgcggcagatgcttcggcctcaagaccggcatggcaaaacaccaatgggtccacagacctgggggtgagggccgaagaggtcgtcgtcccggaggactgagtgtgactctgacgcctgttaggggcgatttagacccccctgttggtttccaactctatcctgagattttccaggaatgcggctag

SEQ ID NO: 61369 - DNA, 2496 bp, Artificial Sequence
  Description of Artificial Sequence: Synthetic coding sequence
atggagaatcagaggagcagccctttatccttcccgtctgtccctcaggaggagaccctgcgtcaagcacccgctggtctgcccagagaaactctttttcagtcaagggtgctgccacccaaagagatccctagtctttcaccgacgattcctcgacaaggatcgctccctcagacaagctccgcgcctaagcaggagacatcaggacgtatgccacacgtgttgcagaagggccctagtttactttgttctgctgcttctgaacaggaaacatcactccagggcccattggcctcacaggagggcactcagtatcccccacctgccgcagccgaacaagaggtgtccttattgagccactcccctcaccatcaagaggctcccgtccactctcccgaagcaccggagaaggaccctctgaccctctcgccgacagtgcctgaaaccgacatggatcctttactccagtctcctgttagccaaaaggacaccccctttcaaattagttccgccgtgcagaaggagcagcccctgcctacggcagagatcaccagactggctgtgtgggctgctgtgcaggcagtggagcggaagcttgaagctcaagccatgagactgttaactctcgaaggcagaacaggaaccaatgagaaaaaaatagcagactgtgagaagaccgcagtagaattcgccaatcatcttgagtcgaaatgggtggtgctggggacactcctgcaggagtatggactattgcaacggagattggagaacatggaaaacctgctcaagaaccggaatttctggattttacgcctgcctccaggttccaatggggaggtacctaaggtccccgtgacatttgacgacgttgcagtgcactttagcgagcaggagtgggggaacctgtctgaatggcagaaggagctctacaagaacgtgatgaggggaaactatgaatccttggtgagtatggactacgccataagcaagcccgacctaatgtcgcagatggagcggggtgagcgcccaaccatgcaagaacaggaggacagcgaggagggcgaaactcctaccgatccttccgctgcccacgacggcatcgtaattaaaattgaggtacagacaaatgatgaaggcagtgagagccttgaaactcctgagccccttatgggacaggttgaagagcacgggttccaggactctgagttaggtgacccttgtggcgagcagcctgacctggacatgcaggaaccagaaaacacactggaggagtccaccgaaggttcaagtgagttcagcgaattaaaacaaatgctggtgcagcagagaaattgcacggagggtattgttattaaaactgaggaacaggatgaagaagaagaagaggaagaggaagatgagttgccgcaacatctacaaagcctgggtcagcttagcggacggtatgaagcaagtatgtaccagactcctctaccaggggaaatgagccccgaaggtgaggagtctccgccaccactgcagctaggcaatcctgctgtgaaaaggctcgcaccaagtgttcacggagaacggcacctgagtgagaaccggggagccagcagtcaacagcaaaggaatcggagaggcgaaagacccttcacttgcatggaatgtggcaagagcttccggcttaaaattaatctgatcatacatcagcgcaatcacattaaggaaggaccatatgaatgcgcggaatgcgagatctctttcagacacaagcagcagctgactctgcaccagcgcatccaccgcgtaagagggggatgtgtgtctccagagcgtggtcctacattcaatccaaaacacgccctgaagccgagacccaaaagtccctcctctggaagcgggggaggcggacctaagccctataagtgccccgaatgcgactccagctttagtcacaagagctccctgaccaagcaccagattacacacacaggagaaagaccttacacatgtccggagtgcaaaaaaagttttcggttacatatctcactcgtcattcatcagagggtccatgctggtaagcatgaggtctccttcatctgttccctctgtgggaagagtttctctcggccttcccacctcctgagacaccagagaacgcacactggcgagcgtcctttcaaatgtcccgaatgcgaaaaatcattctctgaaaagagtaaactgactaatcactgcagggtccattctagagagagaccccatgcgtgtcccgagtgcggcaagagctttatccgcaaacaccacttacttgagcaccgccgtatacataccggggagagaccctatcactgcgctgagtgtggcaaaaggttcacacaaaaacatcacttactggagcaccaaagggctcatacaggcgagagaccctacccctgtacccactgtgcaaagtgcttccggtataagcagtctctgaagtaccatctcagaacccacacaggcgaatag

SEQ ID NO: 61370 - DNA, 1575 bp, Artificial Sequence
  Description of Artificial Sequence: Synthetic coding sequence
atggagaatctgctcaagaatcggaacttctggatccttcggcttccacccggatccaatggtgaggtccctaaggttcccgtaacattcgatgatgtcgccgtgcacttctctgaacaagaatgggggaacctgtccgaatggcagaaggaattatacaagaatgtcatgcggggaaactacgaatctttggtgagtatggactacgccattagtaagcctgatctaatgtcgcagatggagaggggcgaaaggcccaccatgcaggagcaagaagatagcgaagagggcgaaacaccaacagacccaagcgcagctcatgatggaatcgtaatcaagatcgaagtacagaccaatgatgaaggaagcgagtccctggagactcctgaacctcttatgggtcaggtggaggagcacggatttcaggactctgaattaggagacccatgcggagagcagccagatctagatatgcaagagcccgagaacacgctggaagaatccaccgaagggagctctgagttctcggagctgaaacaaatgctcgttcagcagagaaactgcaccgaaggcatcgttatcaagaccgaggagcaagacgaagaagaggaggaggaagaggaggacgagctgcctcagcatctccagtccttgggtcagctctccggaaggtatgaggcctccatgtatcagactccgctccccggagaaatgagtcctgagggggaggaatcaccacctcctttacaactgggaaacccagctgttaagaggctggcaccatcagtgcatggcgagcgacatcttagcgagaaccgaggagcatcctcccagcagcagagaaatcgccgtggcgagcgtccctttacatgtatggaatgtgggaaaagcttcagactgaagattaacttgattattcatcaaaggaatcatattaaagaaggcccatatgaatgcgccgaatgtgagatctcgttcagacataaacagcagctgaccctgcaccagaggattcaccgcgtaagaggcggatgcgtctcgccggagagaggccctacctttaatcctaagcacgccctgaagccgcgaccaaaatctcctagcagcggaagcgggggtggtgggcctaagccatacaagtgtcccgagtgcgattcctcattttcacataagagttctctcacgaagcaccagattacacacactggcgagcgcccatacacgtgtcctgacgcggctgcaaggccaggcgctagggctgtgccacccctgggtcatagacaggctcgtgctcagagggcaggacgaggggctcctcaacctctgtgtagggagctacccctgagcagtcggccttccagccaggggcatggaggcagcgagacaaggagcctcgctgcagcttttccccgaggcccacagggcggtggcagggggcctggggaacccttcagagctgttaacttcctggacaacaaaatggatgagactaatcagcacgggggaagggatctcgctgccggacactcagaaggccgttgccgtgcacacctggtcggcgataggactctctag

SEQ ID NO: 61371 - DNA, 984 bp, Artificial Sequence
  Description of Artificial Sequence: Synthetic coding sequence
atgcagcggaatgcaatgtacctgaaaaatgtggccgaaactgcatgtaactttcagctgacccaataccaaatctcccatgcaaaccagaaaccatatgagtgccagatctgcggcaaacctttccggaaacgggctcacctgactcagcacaacagaattcacactggtgggaagccatacgagtgtaaggagtgtggcaaggtgtttatttgttgctctacccttatacagcacaaacggacacacacaagcgaaaaaccctatgagtgcctcgagtgtcgaaaaacatttcggagatcagctcatctgatcaggcatcaacgtatccatacaggagagaagccatacaagtgtaagcaatgctggaaagcttttgcttccgtcagcgatctcatagacattgggaaattcaccctcatgagagactttactaacgtgcagaatgtaggacggcacctgaccattgctcagctacttttttcgattcgggagttcacattggtgcggtcgcccctgaacgtgaggaatgtggctaaacactccattatcgcccaacacttactaaacacccgagaactgattctgatgcggaatctgatgaatgttaggaacgtgaagcgactgttggggaaagtgcacatactgctcaatataaaagagttcatccttgtgaggaaccatatgagcgtctcaaatgtcggtcggctgtccttggtgtttttgatccttatcgatataagagaatttactttggtgaaaaaccccatgaatgtgaagaatgtggtggagctgctcacaatcgttcagctcctttttaatactcgcgagttcactttagtcaggagactgatgaatatatcctccgtcgggaggttcttatcaccggtgcaacacctgttcaatataagggaacacatccttatgaaaaacctgatgaacgttagtaacgcccgaagacccagttctattatgcacatttag

SEQ ID NO: 61372 - DNA, 1062 bp, Artificial Sequence
  Description of Artificial Sequence: Synthetic coding sequence
atgcagcgcaatgcaatgtacctcaaaaacgtggctgagaccgcttgtaacttccagctgacccagtatcaaatctctcacgccaaccagaaaccatacgagtgtcagatctgcggaaagccgtttagaaagagggcgcacctcacacaacacaaccgcattcatactggaggcaaaccttatgagtgcaaggaatgcggtaaagtgttcatttgttgctcaactctgatccaacacaagcggacccacacgagcgagaaaccttatgaatgcctggaatgtcgaaagacattccgtcggagtgctcatttgattcgtcaccaaagaatccataccggcgaaaagccctacaagtgcaaacagtgctggaaagcttttgcctcagtttccgacctcattgacatcggcaagtttaccctgatgagggatttcactaacgtgcagaacgtggggagacaccttaccattgcccagctgctgttctccattagagaattcacgctggttaggtcccctctgaatgtcaggaatgtcgccaaacactccataatcgcacaacacctgctgaatacgcgagagctcattctcatgcgcaatctcatgaatgttaggaatgtaaaacggttattgggcaaggtgcatatcctcctaaatataaaggagttcattctggtccggaatcacatgtcagtcagcaacgtcggtagactctccctggtctttctgattctcatcgacattagggaattcactctagttaagaaccccatgaacgtgaagaacgttgtagagttgctgaccatcgtccagttactctttaacactcgcgagttcactctggtgcgccgacttatgaatatcagctccgtgggccgttttctcagcccagtgcaacacttgtttaatattagggaacatatcttgatgaagaatcttatgaacgtctcaaacgccagacgacccagcagcatcatgcacatcgatattcgggagttcacggtgggccgaaatccgatgaacgtcatgaatgttggcatgcccagttttgttttcctgatctag

SEQ ID NO: 61373 - DNA, 1122 bp, Artificial Sequence
  Description of Artificial Sequence: Synthetic coding sequence
ttggaatatcagatcccggtctcatttaaggacgtggtggtgggcttcacccaagaagaatggcaccgcttgtcgccagcccagagggcattgtacagggacgttatgctagagacctattccaatctggtgagtgtcgggtatgaggggacaaaacctgacgttatactgagattggagcaggaggaagcgccatggatcggggaggcagcttgccccggttgtcactgctgggaggacatctggcgagttaacatccagcgcaaacgcagacaggacatgctccttcgccctggcgctgccatatcaaaaaaaaccctgcccaaagaaaaatcttgcgagtataataaattcgggaagatttctctgctgagcacagatctctttagttccatccagtcgccctccaattggaatccatgtggcaagaatctgaaccataaccttgatttgataggatttaagaggaactgtgcaaagaagcaagacgagtgctatgcatacgggaagctcctgcagcggatcaaccatggccgaaggcctaatggcgaaaagcccagaggttgcagtcattgcgaaaaggccttcactcagaacccagccctgatgtacaagcctgccgtctccgacagcctcctgtacaagcgcaagcgcgtgccgcctactgaaaaacctcatgtttgttctgagtgtgggaaggctttctgttacaaaagtgaattcatccggcatcagcggagtcacaccggcgagaagccctacgggtgtactgactgcgggaaagccttctcacacaaaagtacactcattaagcaccagcgcatacacaccggcgtgcggccatttgagtgtttcttttgcggcaaggcctttacacagaagagccaccgcaccgagcaccagagaacacacaccggggagcgacctttcgtgtgctccgaatgtggtaaatccttcggcgaaaaatcgtatctgaacgtccatcgcaagatgcataccggggagagaccataccggtgccgggagtgcggaaagtccttcagtcagaaatcatgtctaaacaaacactggcgtacccactttggggaatcctcgctgcgatctaagtcgtccaatacatag

SEQ ID NO: 61374 - DNA, 1125 bp, Artificial Sequence
  Description of Artificial Sequence: Synthetic coding sequence
atgattgagtaccagattcccgtgtcctttaaggacgtcgtggtgggtttcactcaagaggagtggcaccgactgtctccagcccaaagagctctatatagggatgtcatgctcgagacgtactcaaatttagtgagtgtcggctatgagggcaccaagccggatgtcatcctgcggctcgagcaggaggaagcaccatggatcggcgaagcggcatgccccggatgtcactgctgggaggatatctggagagtgaatattcagaggaaaaggcgccaagacatgctgctgcggccaggagctgccattagcaaaaaaacattgccaaaggagaagtcttgcgagtacaacaagtttggcaagatctccttactgagcactgatcttttctcttcaatccagagcccttctaactggaatccatgcgggaagaacctgaatcataacctggacttgattggcttcaaaaggaactgcgccaagaagcaggacgaatgttacgcttatggaaagctgcttcagcgtattaaccacggaagaagaccgaacggagagaaacccagaggttgctcgcactgcgaaaaggcctttacccaaaatccagcactgatgtacaaaccagccgtatccgattcccttctgtacaagaggaagcgtgttcctccgactgaaaagccccatgtgtgttccgagtgtgggaaggccttctgttacaaaagtgagtttattaggcatcaacgttcccacaccggagaaaaaccttacggctgtactgattgcggaaaggctttctctcacaagtcaacgcttataaagcatcagcggattcacaccggggtgcggccttttgaatgcttcttctgtggcaaggccttcacacagaagagccatcggactgagcatcagcgcacccacaccggcgagaggcctttcgtttgcagcgaatgtggaaagtccttcggcgaaaagagctatctgaatgtccaccggaaaatgcataccggggagaggccgtacagatgtagggaatgcggtaagtccttcagccagaaatcctgtctgaataaacactggcggactcataccggagagtccctggaaccgcgacgccagagactccagtag

SEQ ID NO: 61375 - DNA, 1221 bp, Artificial Sequence
  Description of Artificial Sequence: Synthetic coding sequence
atgatcgaatatcagattcccgtctcattcaaagatgtagtagtcggctttacccaggaggaatggcacaggctttcacctgctcagcgggctctgtaccgcgacgtgatgctggaaacatatagcaatcttgtcagcgtgggctacgagggcacgaagcccgatgttattttgcgcctagagcaggaggaagccccttggattggggaggccgcatgccccggttgtcactgttgggaagatatctggagggtgaatatccaacgcaagagacggcaggacatgctgctgagacctggtgccgcaatctctaagaagactttgcccaaagagaagtcttgtgagtacaataaatttggcaaaatctctctcctgtccacggacctttttagctctattcagagccccagcaactggaacccctgtgggaaaaacctgaaccataatctcgacctgatagggttcaaaaggaattgtgccaaaaagcaggacgaatgttatgcctatgggaaacttctgcagagaatcaaccacggacgccgtcccaatggcgagaagccaagggggtgctctcactgcgagaaggcattcacccagaatcccgctttgatgtacaagccagcagtgagtgactctttattgtataaacggaaacgcgtcccacctaccgaaaagccacatgtgtgctctgaatgcgggaaggcattttgctataaaagcgagttcataagacatcagagatcacatacaggtgagaagccgtacggctgcacagattgcgggaaggctttttctcataaaagcaccctgatcaagcatcagcggattcacacgggcgtgagaccctttgagtgtttcttctgcggaaaagcctttactcagaaatctcatagaaccgagcaccagcggacacacacaggtgaaaggcctttcgtgtgtagtgagtgcggtaaatcatttggtgaaaaaagttacttgaacgttcaccgcaaaatgcataccggagaacgaccctatcgctgtcgggaatgcggcaagagcttcagtcagaagtcatgcctgaataagcactggagaactcacactggcgaaaagccgtacggctgtaatgagtgcggcaaagccttttatcagaaaccaaacctttcccggcatcagaaaatacacgccagaaagaatgcatatcgaaatgagaatctgatcatcgtggggaacacctag

SEQ ID NO: 61376 - DNA, 1221 bp, Artificial Sequence
  Description of Artificial Sequence: Synthetic coding sequence
atgatagaataccagatccccgtgtccttcaaggacgtggtggtgggcttcacccaggaggagtggcaccgcctgtcccccgctcagagagctctgtatcgggacgtcatgctggaaacctactctaacctcgtttcagtgggctatgaaggcactaagcctgatgttatccttagattagagcaggaagaagcaccctggattggcgaggcggcatgcccgggttgccactgttgggaggatatttggagggtcaatatccagagaaaaaggcgacaggatatgctactcaggccaggtgccgcaataagcaaaaagactctaccaaaagaaaaatcgtgtgaatacaataagtttggtaaaatctctctccttagcactgacctcttctcatctattcagagcccatcgaactggaatccttgtggcaaaaacttaaatcataacttagacctgatcggttttaagagaaactgcgccaaaaagcaggacgagtgctatgcatacgggaaacttctgcagcgaattaatcacggccgaaggccgaatggagagaaaccaaggggatgtagtcactgcgaaaaggcatttacgcaaaatcccgcattgatgtataaaccagccgttagcgattccttattgtataaacgaaagagggtgccgcctacagagaaaccccacgtctgcagtgagtgcgggaaagcgttttgttacaaaagcgaatttattagacatcaacgaagccacaccggagaaaaaccctatggctgcactgactgcggaaaggccttttcccataagagcacactgattaagcatcagcgcattcacactggcgtgaggccatttgagtgtttcttttgcggcaaagccttcactcagaaaagccatcgtacagagcatcagcggacccataccggcgagcgtccttttgtgtgcagcgagtgcggtaaatcattcggcgaaaaatcatacctgaacgtgcacagaaaaatgcacacgggggaacgaccataccgctgtcgcgagtgcgggaagtcattttcacagaaatcatgtctgaacaaacactggcggacccatactggagaaaagccgtatggctgcaatgagtgtgggaaggccttctaccagaaacctaatctatcgaggcaccagaaaatacacgctaggaaaaacgcatacaggaacgagaatctgatcatcgtcggcaatacatag

SEQ ID NO: 61377 - DNA, 4050 bp, Artificial Sequence
  Description of Artificial Sequence: Synthetic coding sequence
atggcgtgttaccttgtgatctcgtcccggcacctcagtaacggccattatagaggcatcaaaggcgtcttccgaggcccactctgcaagaacggaagcccctcccctgatttcgccgagaaaaagagtactgccaaggcactggaagatgtgaaggccaacttttattgtgaactctgtgataagcaatatcataagcaccaggaatttgacaaccacattaattcatatgaccacgcacacaaacagcggctgaaggagctgaagcagcgggaatttgctcgcaatgtcgcatccaagagttggaaggacgagaagaaacaggaaaaggctctcaagagactccaccaactggctgaattgaggcaacagtctgagtgtgtgagtggtaacggtccagcgtacaaggcaccacgcgtagcaatcgaaaaacagctgcagcaaggcatcttcccgattaagaacggtcgcaaggtgagctgcatgaaatccgcccttctcttgaaaggcaagaacctgccccgaatcatttcagacaaacagagatccactatgccaaatagacaccagctccagagcgaccggaggtgcttgttcggcaaccaggtgttgcagacaagctctgatctgtccaacgcgaaccaccgcactggagttagttttaccttctcaaagaaggtgcatttgaaacttgagtctagtgcatctgtcttcagcgaaaatactgaagaaacccatgactgtaacaaatcccccatttataagaccaaacagaccgctgataagtgtaagtgctgtagattcgcaaataaagacactcatctgaccaaggagaaggaagtaaacatatctcccagccatcttgagagcgttttgcataataccatctctattaactcaaagattctgcaggataaacatgattccattgacgaaactctggaggatagtatagggatccatgcgtccttctccaaatctaatatccacctcagtgatgtggacttcacgcctactagtagggaaaaggagaccagaaacaccttgaagaacactttggaaaattgcgtgaatcacccctgccaggccaacgcatcattctctccgccaaacatttataaccattctgacgccaggataagtgagtgcctggacgagttctctagtcttgagccctctgagcaaaaaagcacagttcacctgaacccaaattcacggatcgagaatagagagaaaagcctcgacaaaacagagagggtttcaaagaacgtccaacggttggttaaagaggcctgcactcacaatgtggcgtctaaaccgctgcctttcctccatgtacagtctaaagatggccatacaacactccaatggcctaccgaactgttgctttttaccaagacagagccttgcatcagttatggatgcaatcctctttactttgactttaagttatcccgaaatacgaaagaggatcacaatcttgaggatctgaagaccgaactgggaaagaagcctttggagttgaaaactaaacgggagagccaagtcagtgggttgaccgaggatcagcagaaattaatccaggaggattaccaatatcccaaaccaaaaacaatgatagccaacccagactgggaaaagtttcagagaaagtacaatctggactactcggacagcgagcccaataaatcagagtacacttttagtgcgaatgacctcgagatgaaaaatccaaaagttcctctgtacctgaacacatctctcaaggattgcgccggtaaaaataacagttccgagaacaaactgaaagaagcttcccgtgcccactggcaaggctgtaggaaggcagtcctcaatgatatcgatgaagatctatcattcccttcctacatcagccggttcaaaaaacacaagctcattccgtgttctcctcacttggagttcgaggacgaaagacagttcaactgcaagtcatctccctgtaccgtcgggggacactccgatcatggcaaagatttttctgtgatcctcaaatccaatcacatctcgatgacaagtaaggtttctggctgcgggaatcaaaggtacaagagatattctccacagtcgtgtctgagcagatacagctcttccctggacaccagcccctcttctatgtccagcctgaggtccacatgtagctcacatagattcaatggcaattctcgcggaaacttgctttgcttccataagcgtgagcaccactctgttgagcggcacaaacgcaaatgtctgaagcacaactgtttctatctgagcgacgacattaccaagtcaagtcagatgcaatcagagccgcagaaagaaagaaattgtaagttgtgggagagtttcaagaacgagaagtatagcaagagacggtactgccattgcagggagaggcagaagctgggaaagaaccagcagcagttttcaggcctgaagtcaacccgcatcatttactgcgactccaactcccagatctcatgcacaggttcttccaagaagccacctaactgccaaggcactcagcatgatcgcctggactcatattccattgagaaaatgtattatctcaacaaaagtaagcggaaccaagagtcactcgggagcccacacatttgcgacttgggaaaggtgcgtcctatgaaatgcaactccggaaacatcagctgcttgcttaagaactgttcaagtggcccttcagagacgacagagagtaataccgccgagggggaaagaacccccctcacggccaaaattctgctggaacgagtgcaggcaaaaaaatgtcaggagcagagttctaatgtagaaatctcaagtaacagttgcaagtccgaactggaggcccctagccaggttccctgcactattcagctggccccttctggatgcaataggcaggccctcccgttgtctgagaagatccagtacgccagtgagagccggaatgaccaagacagcgccatcccacggacaaccgaaaaggacaagagcaagagttctcacacaaataactttacaatcctcgcggatactgactgtgacaatcatttaagcaaaggtatcatacacctcgtcaccgagtcccagtctctcaacatcaaacgtgacgccaccaccaaagagcagtccaaacccctgatctcggaaatccagccattcattcaatcttgcgaccccgtgcctaacgagttccccggagccttcccctccaacaaatataccggtgtgactgactccaccgaaactcaggaagaccagattaacctagatctgcaggatgtctctatgcacattaatcatgtggagggtaatatcaacagctactatgatcgcactatgcagaagcctgacaaggtggaggatgggctggagatgtgccataagagtatcagtccacccctcatacagcagccaattaccttctcaccagacgagatcgataagtataagatcctccagcttcaggctcaacaacatatgcaaaaacaattgttgagcaaacacctgagggtccttccagccgctggtccaaccgccttcagtcccgctagcactgtgcagacagtgcctgtacatcaacatacttctatcactacaatccaccacaccttcctgcagcacttcgctgtctcagcttccctgtcatctcactccagccacctgcctattgctcatctgcatccactctctcaagcccactttagtcctatttcgttctctacccttactcctacaattatccccgcacatccgacatttttggccggacaccctctgcacctggtggcggcaacgccgttccacccttctcacatcacccttcagccattaccccctacggcctttatccccaccctattcggtcctcaccttaatcccgcaactacatccatcatccacctgaatcctttgattcagcctgtattccaaggccaggatttctgccatcactcgtgcagcagtcagatgcagcagctgaatgaagttaaagaggctctgaacgtcagcacgcacctgaattag

SEQ ID NO: 61378 - DNA, 1986 bp, Artificial Sequence
  Description of Artificial Sequence: Synthetic coding sequence
atgcctgcgaacgaagacgcgccacagccaggtgagcacggtagcgcctgcgaggtcagtgtgtcttttgaagatgtgactgttgacttttcccgagaggagtggcagcagctggatagcacccagagacgcctttatcaagacgtgatgttagagaattattctcacctcttaagcgtcggattcgaagtgcccaagccggaagtaatcttcaagttagagcagggtgaagggccatggaccctggaaggtgaagccccacaccagagctgtagcgacggcaaattcggaattaagcccagtcagagacgaattagcggaaagtcaacttttcacagcgagatggaaggcgaagacacaagggatgattctctgtacagcatcctggaggagctttggcaggacgccgagcagattaagcgctgtcaggagaaacacaacaaactcttgtcaagaaccacctttctgaacaaaaaaattctgaacacagagtgggactatgaatataaagacttcggcaaattcgtgcacccttccccaaatctgatcctcagccagaaaagaccacacaaaagggactctttcggtaagtcatttaaacacaatctggatttacacattcacaacaaatccaacgctgcgaagaacctggataagacaattggccacggacaagtgttcacccaaaactcctcgtattctcaccatgagaatacccacacaggggtgaagttttgcgagcgcaatcagtgtggaaaggttctgtctctcaagcatagcctttcacagaacgtcaaatttcccatcggggagaaagccaacacctgtacagagttcggtaagatctttacgcagcgatcacatttctttgccccacaaaagatccacacagttgagaaaccccacgaattgtcgaaatgtgtgaacgttttcacacaaaaacccctgctgagcatttacctgagggtccaccgggatgagaaactttatatatgtacaaaatgcggtaaggctttcatccagaattctgaactcatcatgcacgagaagacacacacgcgtgaaaagccgtacaaatgtaatgagtgcggcaagtcgttcttccaggtttcctcactcctgcgccatcagacaacacacacaggggaaaagctttttgagtgctctgaatgtgggaaagggttctctttaaacagtgccttgaatattcatcagaagatacacacgggcgaaagacatcataaatgcagcgaatgtggaaaagccttcacccagaaaagcactctgcgcatgcatcaaaggatccatacgggcgaacggtcttacatttgtacccaatgcgggcaggctttcatacagaaagctcacctgattgcccaccaacgaattcatacaggcgagaagccctacgagtgttcagactgcggcaagagttttccgagcaagtcacaactccagatgcacaagcggattcatactggggaaaagccctacatctgtaccgagtgtggcaaagctttcacaaatcgatccaacctgaatactcaccagaaaagtcacaccggcgagaagagttatatctgtgcagagtgtgggaaagcctttactgatcgctctaactttaataaacaccaaacaatccacacaggagaaaagccttatgtgtgcgctgattgcgggagggccttcatccagaagagcgaactgattacacaccagcgcatccatacgacggagaagccttataagtgccccgactgcgagaagtcattttctaaaaaacctcacttgaaagtgcaccagagaattcacactggggaaaaaccatacatttgcgccgagtgtggtaaggcattcaccgatcgatccaattttaacaagcaccagacaatccatactggcgacaagccttataaatgtagcgactgcggcaagggcttcactcagaaatctgtcctatcaatgcataggaacatccatacctag

SEQ ID NO: 61379 - DNA, 1365 bp, Artificial Sequence
  Description of Artificial Sequence: Synthetic coding sequence
atggccgtaactgacctgtcacacggcttctttcccagagagcctatatgtcccttcgaggagaaaacaaaaatcgggacaatggtagaagactacctagcgaattcctaccaagactcggtcaccttcgatgacgttgcagttgagttcacccctgaggagtgggcattactcgacactaccgagaagtgcctatacagagatgtcatgctcgagaactatgtgaacctggcttcagtcgaagccacggttgacggcaacagcgaaaactgcggtgaggtcttttctgagtggttctgcctgaaaacacatatgcgcgcacaaaatggcggaaacatcttcgaaggaaactgctatggaaaagacattctgagcgtgcacaaagaagcgagcatcgggcaagagctgtcgaagttcaatccttgcggcaaagtatttacactgactcccgatctggctgcacaccttggtatcctgaacgccagacaaccgtataagtgcaaggaatgcaggaaaggatttaagtattttgcctccctggataaccacatgggcatccacatcggcgaaaagttctgtgaatttcaggaatgcaggagagctattacccattcatcccatttaaaacagtgcgtaaccgttcatacgggcaagaagtctaaaaagacaaagaaacacggcaagtcatttacaaacttttcgcagctgagtgcccatgtgaagatacataaaggggagaagagctttgagtgtaaagagtgcggcaggtcattccgtaactcgtcgtccttcaatgtgcatattcagattcataccgggatcaaaccccacaagtataccgaatgcgggaaagcctttacccgctccacccatctgactcagcatgtccggactcataccggaattaagccctatgagtgcaaagaatgcggacaggcatttacccagtacacagggctcgccatccacattcgaaatcataccggggagaaacattaccagtgcaaagagtgcggcaaagctttcaacggatcttcaacactgacacagcataaaatcatacacacaggggagaagccttacggatgtgtggagtgtgggaaaacttttatcaccagtagctacagatcaaagcacctcaagactcaccacgaagaacggcctttcgtgtgtaaaatatgtggcaaagcattcttgtatagttcccctctcaacgtccacttacagactcatacaagagagaaggccttaatttgcaaggaatgcggcaaagccttcgccgttagcagtcatcttagcagacacgaacgaatccataccggagaggaaccttacgagtataagggtatgaatgtcaccatatag

SEQ ID NO: 61380 - DNA, 1734 bp, Artificial Sequence
  Description of Artificial Sequence: Synthetic coding sequence
atggcagccgcagccaccttaaggctatccgctcagggcaccgtaacgtttgaggacgttgccgtgaattttacatgggaggagtggaatctgctaagcgaggctcagcgatgcctgtatcgcgacgtcactctggagaatcttgctctcatctcgtcactgggatgctggtgtggcgtggaggatgaggctgcgccatcgaaacagtcaatttacatacaaagggagacgcaggtgcgcactcccatggctggcgtctcacctaagaaggcgcatccttgtgaaatgtgcggtccgattctgggagacatattgcatgtagctgatcaccaggggacgcatcacaaacagaaactccatagatgtgaggcttggggcaataaactctatgattcaggcaatttccatcagcatcagaacgagcacattggcgaaaagccctacagaggcagcgttgaagaggccctgttcgctaagaggtgtaaacttcacgtgtcaggtgaaagcagcgtctttagcgagagtggtaaggacttcctccctagaagcgggcttttgcagcaggaagcatcacatacgggagagaagtctaatagcaaaacggagtgcgtgtcacctatccaatgcggcggagcccactattcttgcggcgagagcatgaagcatttttctacaaagcatatcctgtcacagcaccagagactgctgacacgggaggagtgttacgtgtgttgtgagtgcggaaagtctttttcaaagtatgcttcatttagcaaccaccaacgggttcacaccgataagaagcattacgagtgtggcgagtgtggtaaatccttttctcagaagagcagtcttattcaacatcagcgttttcataccggcgagaagccttacggctgcgaggagtgcggaaagagtttcagccataagaggtcactggtgcaccatcaacgcgtgcattccggcgagagaccatatcagtgcggcgaatgtggtaagagcttttcacagaaaggtaatctggtgttacaccaacgtgttcataccggtgcacggccatatgaatgtggtgagtgtggtaagagcttctcccacaagcggagtctggtccaccaccagaggatgcacaccggtgaaaggccttacaagtgcggtgactgtgggaagagttttaatgaaaagggacacttgaggaatcatcagcgggtccacactaccgagaggcctttcaagtgcggggagtgcgggaaatgttttagtcataaaggtaacctgatcttacatcaacacggccacacaggcgaacgaccgtacgtgtgtagagagtgcggaaagttatttaagaagaaatctcatctgctcgtgcaccaacggatccataacggggaaaagccttacgcctgtgaagcctgtcagaaatttttccggaacaattccactttctgcgtccataagcgcatacatactggggagaaaccatatgaatgttcagaatgcggtaagtctttcgccgagagcagtagttttactaaacataagagagtgcacactggcgagaagccctacgagtgctcagagtgtggcaaaagcttcgccgagagctcttcccttacaaagcataagagggtgcataccggtgaaaaaccctacaagtgcgaaaagtgtggcaagctgtttaataagaagtcacacctcctcgtgcaccaaagctcccactggcgcaaggccatttag

SEQ ID NO: 61381 - DNA, 2568 bp, Artificial Sequence
  Description of Artificial Sequence: Synthetic coding sequence
atggcagccgcagctactctgagactttctgcccaggggacagtaacattcgaagacgtggccgtcaactttacctgggaggagtggaatcttctatccgaagcccagaggtgtctttaccgggacgtgacactggagaacctggcactgatctctagccttggctgttggtgcggggtcgaagatgaggccgcacccagtaaacagtccatctacatacagcgggaaacccaagtcaggactcccatggcaggagtttcaccaaagaaggcccacccttgcgagatgtgtggcccaatcctaggagacattttgcacgtcgcagatcaccaggggacccaccataagcagaagctgcaccgctgtgaagcctgggggaataagctgtacgattctggtaattttcatcagcatcagaacgaacatattggggagaagccctacaggggcagtgttgaagaggccctgttcgctaaacggtgtaagctgcacgtctctggcgagtcaagtgtgttctctgagtctgggaaggattttcttcccaggtcaggcctactgcagcaggaggcgtcacatacgggagaaaagagcaatagcaagaccgagtgtgtatcgcctattcagtgcggaggggcacattattcctgcggggaaagcatgaagcattttagtacaaagcacatcctttcccaacatcagaggctactcactcgagaagaatgttatgtctgctgcgaatgtggtaaaagcttcagcaaatatgcctccttgtcaaatcaccagagggtgcacactgagaagaagcacgaatgtggcgagtgcggcaagagttttagcaagtacgtgagcttctccaaccatcagagagttcatactgagaaaaaacatgagtgcggagaatgtggcaagtccttctccaaatacgtttccttctctaaccaccagagagtgcatacgggtaaacgaccatatgagtgcggagagtgcggtaaatcttttagtaaatatgcctccttttccaaccatcagagggtgcatactgagaaaaagcattatgagtgcggagagtgcgggaaaagcttcagcaagtatgtgtctttctccaaccaccaacgagtccatacgggcaaaagaccgtacgaatgtggcgaatgcggcaagtccttttctaaatatgccagcttctcaaatcatcagcgggttcatactgacaagaaacattatgagtgcggggagtgcggcaagtcctttagtcagaagtcttctcttatccagcatcaacgctttcataccggggagaagccttacggctgcgaagagtgtggaaagtctttctcctcggagggtcacttgcgttcgcaccagcgggtgcacgctggcgagcgcccattcaagtgcggcgagtgcgtgaaaagtttctcccataaacgatccctggtgcatcaccagagggtgcattctggtgagaggccataccagtgcggggaatgtggcaagtcctttagccagaaaggtaatctcgtactgcatcagagagtgcatacgggcgctagaccatatgaatgtggggaatgtggaaaatcattttccagtaaaggccacctcaggaatcaccagcaaattcacaccggtgaccgtctctatgagtgcggagagtgtgggaagagctttagccataagggcacactgatcctgcatcagcgagtccaccccagggagcgctcttatggatgcggagaatgcgggaaatcattctctagtatcgggcatctgaggtcccaccagcgggtgcacacgggggagcgtccttatgaatgcggtgagtgtggaaagagtttttctcataaacggtccctggtgcatcatcagcggatgcacaccggcgagcgaccatataagtgtggtgattgcggaaaatcattcaacgagaaaggccatctacgaaatcaccagcgagtccacacaaccgagagaccctttaaatgtggcgagtgcggtaaatgcttttctcataagggcaatctcatcttgcatcagcatgggcacacgggcgaacgcccttatgtgtgtcgagagtgtggtaagctcttcaaaaagaagtctcacctgttggtccaccaacggatccacaatggtgagaagccatacgcatgtgaggcatgtcaaaagttctttcgaaataaatatcaactgatcgcgcatcagagggtacacaccggcgagcggccatatgaatgcaatgattgcggaaagtccttcacccacagcagtactttctgtgtccacaagcgcatacatactggggagaaaccatacgagtgctccgaatgcggaaaaagtttcgccgaaagttcttccttcaccaagcacaaacgagttcacacaggagagaagccttacgaatgcagtgaatgcggaaagagcttcgccgagtcatcttcattgacgaaacacaagagagtccacacaggcgaaaaaccctacaaatgtgagaagtgtggaaaactcttcaataaaaaatctcacctattggtccatcaaagttcgcattggaggaaagcgatatag

SEQ ID NO: 61382 - DNA, 1113 bp, Artificial Sequence
  Description of Artificial Sequence: Synthetic coding sequence
atgagcaggagaaagcagaccaaccccaataaggtacactgcgattcagagggcgacgaagaggagacaactcaggacgaggtcagttcacacacctcggaagaggacggaggagttgtgaaggttgaaaaggagctcgagaacacagaacagccagtgggaggaaacgaggtggttgaacatgaggtcactggcaaccttaatagcgatccgttactcgaactctgtcagtgcccattatgtcagttggactgcggaagtcgggaacagttaatcgcccacgtgtaccagcataccgctgctgtcgtgtcggccaaaagctatatgtgcccagtttgcggacgcgctcttagctcacctggttcgttaggcaggcatctgctgatccactctgaggaccagcggtcaaactgcgccgtgtgcggggctagattcacatctcatgccacttttaatagtgagaaactcccagaggtcttaaatatggaaagcttaccgactgtgcacaacgaggggccatcgagcgccgaaggtaaagacattgcattctcacctccagtttaccccgcaggtattctgctcgtttgcaataattgcgcggcttatcggaagctattagaggcacagaccccctctgtgaggaaatgggccctgagaagacagaatgagcctctggaagtccgattacagaggctcgagcgggagagaacagcaaaaaagagtcgacgggacaatgaaacacccgaggagagggaagttaggaggatgagggatcgtgaggccaaaaggctccagcggatgcaggagaccgacgagcaacgggctcgcagattacaaagagatcgtgaagcaatgagacttaaaagagcaaatgagacacccgaaaaacgtcaagctcgcctgataagagagcgggaggctaagcgattgaaacgaagattggaaaagatggacatgatgctgcgcgcacagtttggacaggacccaagcgcaatggctgctctggccgcagaaatgaatttcttccagttgcccgtatccggagtagagttagactctcagcttctcggtaaaatggcgttcgaagagcaaaactcatcctctctacactag

SEQ ID NO: 61383 - DNA, 1239 bp, Artificial Sequence
  Description of Artificial Sequence: Synthetic coding sequence
atgtcccgtcgaaaacagacgaaccccaacaaggtccactgggatcaggtgtttgctggattagaagagcaagcccgacaggctatgatgaagacagattttccaggcgacctggggtctcagaggcaggccatccagcagctcagggaccaggacagctcgtcgagtgactcagaaggcgatgaggaggagaccactcaggatgaagtcagtagccacacatccgaggaggacggtggcgtcgtcaaggtcgaaaaagagctggaaaatacagagcagccagttgggggtaacgaggttgtggaacacgaagttacaggcaatttgaatagcgacccgcttctggagctgtgtcaatgtcctttatgtcaattggactgcggttcgagagagcagctaatcgcccatgtctatcagcacacggccgcagtggtgtctgccaagagctatatgtgccccgtgtgtggccgagcattatcttccccagggagcctaggtcgccatctgctgatccatagcgaagaccagcgctctaactgtgccgtctgcggcgcaagatttacttcccatgctacttttaactcagaaaagctgcctgaggtgctcaatatggagagtctcccaactgtccacaacgaggggcctagcagcgctgaagggaaggatattgcattctcgccccctgtgtatcccgctgggatactccttgtgtgcaacaactgcgctgcttatagaaagttgctggaagcccaaacaccaagcgttcgaaagtgggcgctccggagacagaatgagcccctggaggtgcggctgcagagactagagcgggagagaactgcgaagaaatcccgtcgcgacaatgagacgccagaggagcgggaggtgaggcgcatgcgagatcgtgaggctaagagactgcagcggatgcaggagaccgacgaacagcgcgctagacgactgcagcgggaccgggaagcgatgcgtctcaagcgcgcaaacgagactcctgaaaagagacaagctcgcctcattcgcgaacgagaggccaagcgtttgaaaaggagactggagaaaatggatatgatgttgcgggctcagttcggccaagatccatctgccatggctgcactggccgctgagatgaacttttttcagctgccagtttctggggttgaactggactcccaactcctgggtaaaatggcttttgaggaacagaacagcagcagtctccactag

SEQ ID NO: 61384 - DNA, 1113 bp, Artificial Sequence
  Description of Artificial Sequence: Synthetic coding sequence
atgtccagacgcaagcagacaaatcctaacaaggtccactgtgattcagaaggcgatgaagaagagaccacccaagacgaggtgagcagccacaccagcgaagaggacgggggagtcgtcaaggtggagaaggagctagagaacacggagcaacccgtgggtggcaacgaagttgtggagcacgaggtaacaggcaacctgaactctgaccctcttctggagttgtgccaatgtcctctgtgccagcttgactgtgggagtcgggaacagttgatagctcacgtctaccagcacaccgctgctgtggtcagcgcaaaaagttatatgtgtccagtctgcggccgtgcattatctagccccggttcccttgggcgacacctgctgatccattctgaagaccagcgctctaattgcgcagtatgcggcgcacgctttacttctcatgctacattcaattccgagaaactccctgaagtgctaaacatggaatcccttcctaccgtgcacaacgaggggccttcttctgctgaagggaaggacatagcgttctcccccccagtttatcctgccggaatactgctcgtgtgtaataattgtgcagcttataggaagctgctggaggcccagaccccttccgtgcggaagtgggccttgaggcgacagaacgaacctctggaggtcagactgcagaggctcgaacgggaacgaacagcaaagaagagtagacgggataatgagactccagaagagagggaagtcagacgtatgcgggaccgggaggccaagcgcttgcagcggatgcaagagaccgacgagcaacgagctagacgactccagagggacagagaagccatgaggctgaaacgcgcaaatgaaaccccagagaaacggcaggcaagacttatccgagaacgggaggcaaagcgtttgaagcgaaggctggagaagatggacatgatgctccgggcacagtttgggcaggacccttctgcaatggctgccctcgccgcagagatgaattttttccagctaccagtgtctggggtggaactggattcccagctgctggggaagatggctttcgaagaacagaattctagcagcttacactag

SEQ ID NO: 61385 - DNA, 417 bp, Artificial Sequence
  Description of Artificial Sequence: Synthetic coding sequence
atgtctaggcggaagcagaccaaccctaacaaggtgcattgggaccaagtgttcgccggacttgaagagcaggcaaggcaggcgatgatgaagacagatttcccgggagatttggggtcacagcgacaggcaattcagcagctgagagaccaggatagctcttcctccgattcggaaggggacgaagaggagaccacacaggatgaggtctcaagtcacacaagcgaggaggatgggggagtcgtgaaagtcgaaaaggaactcgaaaacacagaacaacctgtagggggaaatgaagtggttgaacacgaagcacggaacctaaatagcgatccactgcttgagctctgtcagtgtccactgtgtcagctggattgcggatctcgggagcagctcatcgcgcacgtgtaccagtag

SEQ ID NO: 61386 - DNA, 1239 bp, Artificial Sequence
  Description of Artificial Sequence: Synthetic coding sequence
atgagtagaaggaaacaaacaaatcctaacaaggtgcactgggaccaagtttttgccggactggaggaacaagctcgacaagctatgatgaaaactgactttccaggggacctaggatcccaacgtcaggctatccagcagttgcgagatcaggactcttcctcttccgactcagagggcgatgaggaggaaacaacacaggacgaagtgtctagccatacctccgaggaggatggcggagtggtgaaggtcgagaaagaacttgaaaataccgagcaacccgtgggaggaaatgaggtggtcgaacacgaggtgacaggaaatctgaactccgacccactgctggaactctgccagtgtcccctttgccaactggactgcggttctcgagagcagcttatagcacacgtttaccagcacacggctgccgttgtgagcgctaaatcctacatgtgtcctgtgtgcggaagggccctgagttcacctggcagcttaggccgacacctgctgattcactctgaggaccagcgctctaattgcgctgtctgtggcgctaggtttacaagtcacgctaccttcaacagtgaaaagctgccagaggtgctcaacatggagagcctcccaaccgttcataatgaaggaccttctagtgccgagggcaaagacattgcattttcccctcctgtttacccagcaggcatcttactcgtctgtaataactgcgcagcttataggaagctgctggaggcccagacccctagtgtccgtaagtgggccctgaggcgacagaatgagcccctggaggtgaggctacagaggttagagcgcgagcgaacagcgaagaagtcccgcagggacaacgagacgcctgaggagagggaggtccgacgaatgcgtgatcgagaagccaaaaggctgcagagaatgcaggaaactgacgagcaacgggctcgccgattgcagcgtgatagggaagcgatgagattgaagcgggctaacgaaacaccggaaaagcgacaagctagactgattagggaacgcgaagctaagcggctgaagcgtcgactggagaaaatggacatgatgttaagggcgcagtttggacaggatccaagtgcaatggctgctcttgcagccgagatgaatttctttcagctgcccgtctcgggtgtggagttggactcacagctcctcggcaaaatggcctttgaggagcagaacagcagttctcttcactag

SEQ ID NO: 61387 - DNA, 1680 bp, Artificial Sequence
  Description of Artificial Sequence: Synthetic coding sequence
gtgcccggtagccagtgcgaccctgagaagaggtgtgagatcaaaacagccgcacagggtagtcgtatggaaggcctcctctctgtggccctgcagggagcagagctcgagggaaattggaagcacgagggtcaggtcgaggatctccaggaaaatcaggagtcttgcccggaacctgaagccgtggcttgtaagggggaccccgctggggattccatgcaggagagagacgagtttagcaggattcctcgtactattagctcgccggctgccacccaggcgtccgttcccgacgattcttcgtcccgaaggtgtagcgccccaggcgaaagcccaaaggaaagacatcccgactctcgccagagagagcggggaggtgggccaaagaaaccctggaagtgtggggattgtggaaaggccttcagctactgtagtgcctttatccttcatcagagaatacacaccggagaaaagcccttcgcatgccccgaatgtggcaaggccttttcacagtcagtgcacttgaccctgcaccagagaacacataccggtgagaaaccgtacgcctgccacgaatgtggcaaggcctttagccagggaagttatcttgccagtcattggagaacccacactggagaaaagccccacagatgtgccgactgtggcaaagcgttcactcgggtcactcacctcacccaacatagacgcgtgcacactggcgagagaccgtacgcctgtgctcagtgtgccaaagcgttccggaacaggagttctctaattgagcaccagcgaattcatactggggagaaaccctacgaatgctctgcctgcgctaaggctttcagatttagcagcgctctaattcggcaccagcggatacacaccgaggagaagccttatcgatgtggtcagtgtgctaaggctttcgcccagatagcccacctcacccagcatcgacgagtgcacactggggagaagccgtatacctgccaagactgcggagccctcttttctcagtccgcaagcctcgctgagcatcggagaatccacactggggagaagccttacgcctgcgggcagtgcgctaaagcatttacccaggtttcgcatctgacgcagcaccagcgtacacataccggggagaggccatacccttgtcacgattgcgggaaacgtttcagcaaccgctcacatcttctgcagcaccgtctggttcatactggagagagaccctatagatgtctgcaatgcggcgcagctttttctcatgtgagcagcctgatagagcaccaaaaaatccacactggcgagcgaccttataagtgtggggaatgtggaaaagcattcagtcaggggtcctcactggctttgcatcagcggacacataccggcgagagaccatacacctgccccgagtgcgggaaagccttttctaataggtcctacctgatccaacaccacatcgtacacaccggcgagaaaccctatgagtgttctggctgcggcaaggctttttccttcagctccgctttgattcggcatcagagaacacatgctgatagctctggcagactgtgcccagctcctactcccgactcaactcccggactgtctcagggcggtgaaacctgtcagcaaggctgtccaggaagaaatcctagaggaccagctgaagactag

SEQ ID NO: 61388 - DNA, 1614 bp, Artificial Sequence
  Description of Artificial Sequence: Synthetic coding sequence
atggagggactactcagcgtggcactgcagggggctgagctggaagggaattggaagcatgaggggcaggtagaagacttgcaggagaaccaagagagttgccctgaacccgaggccgtagcctgcaaaggggatccggctggcgacagtatgcaggagagggacgagttcagccgaatccccaggacaatctcatctccggcagcgactcaggcctcagtgcccgatgactcatcgagccgcaggtgctccgctcccggagagagtcctaaggaaagacatcctgactcacgtcaacgggagagggggggtggcccaaagaagccatggaaatgcggtgattgtggaaaagcattctcttattgctcagcttttattttgcaccagcgcatccacacaggggagaaaccctttgcctgcccagagtgtggaaaggccttttcccagtcagttcacctcacccttcatcaacgcacccacacaggtgaaaagccctacgcatgccatgagtgcggcaaagccttttcacagggtagctatctggcctcccactggcggacacatactggcgaaaaacctcatcgatgtgccgactgcggtaaagcgttcacgcgcgtaactcacctcactcagcaccgaagggtgcatactggtgagcgaccttacgcgtgtgctcagtgcgctaaagccttccgcaatcggagctcattgatagagcaccaacggattcatactggggagaagccttatgaatgttcagcatgcgccaaagcttttagattctcttctgctctgataaggcaccagcgcatccataccgaagaaaagccttaccgctgcggtcagtgtgcaaaagccttcgctcagatcgcacacctgacgcagcatcggagagtccatacgggagaaaaaccctatacatgccaggattgcggcgcactcttctcccagtcagcatctcttgccgagcatcggcgtattcacacaggagagaaaccatacgcctgcggccagtgcgcgaaggcttttacccaggtgagtcacctgacacagcatcagcgtacacacactggggaacggccttatccgtgccatgattgcggaaaaaggttttccaataggtcccacttgctgcaacaccggctcgtacatacgggcgagcgaccctaccggtgcttgcagtgtggtgcagcatttagtcacgtttcgagtctcatcgagcatcagaagatacacactggagaacgcccttacaaatgtggggagtgcggaaaggctttttcccaggggtccagcctggccctgcaccaacggacccacaccggagaaagaccatacacctgccccgaatgcggaaaagctttctcaaaccggtcctatctgattcaacaccacatcgtgcacactggtgaaaagccttacgaatgttcagggtgtgggaaagcctttagcttttcatcagccctcattcgccaccagaggactcacgccgatagttcaggcaggctgtgccccgctcctactcctgactctaccccaggtctgagccagggcggtgagacatgtcagcaggggtgtcctgggaggaatcctcggggtcctgccgaagattag

SEQ ID NO: 61389 - DNA, 2442 bp, Artificial Sequence
  Description of Artificial Sequence: Synthetic coding sequence
atgttacttcccaccacaatacagccgcaaactgcacgcaaatcccagcttccccgaggcaatagctgtctggtaggcttacacatcgccagtcctcaacttcttagggttcagcctctggttaggactgagcctcagagttgttttctgagtgacttatgtcaaccacctgcacaggggtttgtccagaggcccctgcccgctctgcaggtcgtgcctgccaagcgagtacccgcacccaaagcccctgatgaacagggatctatgctgacgcctttatctgccagcgacccactggcagtgacttcgcttagttcgagctctgcccatcccttcattagcaaccttcacacaagacatactgaaaagctgaagaagtccttgaaagttaagacccggtctgggagagtgtcaaggccgcctaaatacaaagctaaggactataagttcatcaagactgaggatctggccgacggacacctttcagactcagacgactattccgaattatgcgtcgaagaggacgaagaccaaagggagaggcatgccttattcgacctgtcttcctgtagcctgcgaccaaagtctttcaagtgtcagacatgtgagaaatcctatattggaaagggcggattagcacgacacttcaaattgaatccaggtcacggacagctagaccctgaaatggtccttagcgaaaaagccagcggctcaacgctgcgaggatgcaccgaggaacggactcttagccttaccagccttggactgtctatgccggctgacccctgtgaaggcggtgctcgcagttgcctcgtgacagaaagcgctagagggggtctacaaaatggccagtccgttgatgttgaggaaactttaccctccgaacctgagaacggcgcattattacggagcgagagataccagggccctagaagacgggcttgctctgagacactagcggagtcgcgcacagctgtcctacagcagagacgagccgcacaactaccagggggtcctgcagccgctggggaacaaagggcgagcccaagcaaagccaggctcaaggaattccttcaacaatgcgatagagaggatttggtggagttagcccttccccagctcgcgcaggtggtgactgtgtacgagttccttctcatgaaagtcgaaaaagaccatctcgcaaaacccttcttccccgctatttacaaagagtttgaggaactgcataagatggtgaagaaaatgtgccaggattacctgagctccagtggcctctgctcgcaggagacgctcgaaattaataatgacaaggtcgcagagagtctgggcataacggagtttctcaggaagaaggaaattcatccagacaacttgggtcctaaacacctgagccgtgatatggatggggaacagctcgagggagcttctagtgaaaaacgggaacgcgaggctgctgaggagggccttgcttctgtcaaaagaccacgccgtgaggccttgtctaatgacacgaccgagtctcttgcagccaactccagaggcagggaaaagccacgtcctctccacgccctggcggcaggcgagggtttctctcccccagtcaacgtcaccgtgagcccccgttcagaagaatcccacacaacaacagtatcaggtggaaacggcagtgtgtttcaggccggtccacagctgcaagccttggctaatttagaggctcgtaggggcagcatcggggcagctcttagtagcagggacgtgtccgggctgcctgtgtacgcccagtctggtgagcccaggcggctgactcaggcccaggtcgcagcgtttccgggagagaacgccctggagcattcttcagatcaggatacatgggactcgctgagaagtcccggtttctgctccccgctttcatctggcggtggggctgaatcactgcctcctggcggaccaggccacgccgaagctggccacctcggcaaagtctgtgatttccacttgaatcaccaacagccctccccaacgtccgtgttaccaactgaagtcgccgctccacctcttgagaaaatactgtccgtggatagcgtggcggtcgattgcgcttaccggaccgttcccaagcccggaccccagccaggccctcatggaagcctgcttactgaagggtgcctccgttccctttctggggacctcaatcgtttcccctgtggcatggaggtacacagcggacaacgagagctcgagtcagtcgtggccgtgggagaagcaatggcgtttgagatcagtaatgggagccatgagcttctcagtcaggggcagaaacagatttttatccagacgtctgatggactgatcctttcccccccaggaacaattgtcagtcaggaggaggatatcgtaacagtgactgacgccgagggaagggcctgcgggtgggcgcgatag

SEQ ID NO: 61390 - DNA, 1368 bp, Artificial Sequence
  Description of Artificial Sequence: Synthetic coding sequence
atgccagccgatccttgcgaaggtggagctagatcttgccttgtaacagagagcgctcgcggagggctccagtttctccagcagtgcgatcgagaagatctcgtggagcttgccctcccccagttagcacaggtggtgactgtgtacgagttccttttaatgaaggtggaaaaggaccacctggccaaacctttcttccccgcaatctataaagaatttgaagagttacacaaaatggtgaagaaaatgtgtcaggactatctgtccagcagtgggctctgctctcaagagaccctcgagatcaacaacgataaggtggcagaaagcttggggatcacggagttcctgcgaaaaaaggagattcatcctgataacctcggaccaaagcacctgtcgcgtgatatggacggagagcaattagagggggcaagtagtgagaagagagaacgggaagctgctgaagagggcctcgcaagcgtgaagcggcctagaagagaagcgctgtctaatgacacaactgagagtttggctgcaaactctcgcggaagggaaaagcctaggcccttgcatgctcttgcagctggttttagtccccctgttaacgttactgtttctccacgcagcgaggagagccacaccacaaccgtgagcggtggcaacgggtcggtcttccaagccggtccccagcttcaagccctcgccaatttggaggcaagacgtggctccatcggcgcagccttatcgagccgagacgtaagtggattgcccgtgtacgcccagtcaggcgaacccaggcggctcacccaagcacaagttgccgcattccccggtgagaacgcactggagcattctagtgaccaggatacatgggacagtctccgttcacccggtttctgctcacctctaagcagtgggggtggcgcagagtctctgccacccggtgggccaggacacgctgaggccggtcatctgggaaaggtgtgcgactttcacctaaaccaccagcaaccctccccaacttccgtgttgccaacagaggttgcggctccccctctggaaaagattctgtccgtcgactcagtcgctgttgactgtgcttatcgtacggtgccgaaacctggcccacagccagggccacacgggtccctgctcacagaggggtgtttaaggagtctgtccggagatcttaatcgcttcccctgcgggatggaggtgcactctggccagcgagaactagaatctgtggtggccgtcggggaagccatgctcaaattccctatgggagctatgagttactgtctgcgtgaccgctcccgatttctgttccggctacccatgggcctgtcatgtccactgcaggtgcagtag

SEQ ID NO: 61391 - DNA, 2784 bp, Artificial Sequence
  Description of Artificial Sequence: Synthetic coding sequence
atggctgatgcagaacccgaagccggagggggaagcgaggacggtggcggaggaggcggaccagccccacctgggcaatctggtagtgtggccagagtggcccctctgggtcctgaacagctccgccaggttctcgaacaggttacaaaggcccaacctccaccaccacctccccctttcgtgctgagggatgctgcccgacgtctaagggatgccgctcagcaagccgcactgcagcgcggtcggggaaccgagcctcctcgacttcctcggctccttccgcctcaacaacttgaagcaatttgcgtcaaagtcacgtccggcgaaaccaaaggccaggaaagaccaatgctcctgcctactacgatccagcctcagacagcacgtaaatcccagctgcctcggggaaattcgtgcctggtcgggttgcacatcgcctcccctcagcttttacgggtgcagcccctggtgagaaccgaaccgcagtcttgctttctgtcggatctgtgccaaccgccagctcagggcttcgtccagaggccgttgccagccctgcaggtggtgcccgcaaagagggtcccggcacctaaggcaccggacgagcagggatccatgttaactccgctgagcgcctccgatcctctcgctgttacatcactgagctcttcgtccgcccaccctttcatctcaaacctgcacactaggcatactgaaaaactgaagaaaagccttaaggtaaagacgcggagcggccgagtctcccgtccaccgaagtacaaagccaaggactacaagtttatcaaaacagaggatctagccgatggacacttgagcgacagcgatgattacagtgagctgtgtgtggaggaagacgaggaccaacgtgagagacacgccctgtttgatctgtccagttgcagcttgaggccaaagtccttcaagtgccaaacttgtgagaagagctatatcggcaaggggggactggccagacactttaaattgaaccccggacacggccaacttgatcctgagatggtgctgtcagaaaaggccagtggctccacactgaggggctgcactgaggaaaggaccctgagcctgacatccttaggattatctatgccagctgatccctgcgagggtggcgcaaggagctgcctcgtaaccgagagcgcccgaggaggattgcagaacggtcagtccgtcgatgtggaggagactctacccagtgagcccgaaaacggcgctctcttaaggtctgagcgataccaaggcccacgccgtagagcttgctcagagaccctggctgagtccagaactgccgtgctccagcagagaagagccgctcagttgccaggcggtcctgccgcagcgggtgagcagagagctagccccagtaaagcccgactcaaagagtttcttcagcagtgcgatcgggaggatctagttgaactggccttgccacagctcgcacaagtggttaccgtttacgagtttctgttaatgaaggtggaaaaggaccacctggccaagccctttttccctgctatttacaaggaatttgaggagcttcacaaaatggtgaagaagatgtgccaagactatctatcatctagcggtctttgctcccaggagactcttgagataaacaacgacaaggtggccgaatctcttggaatcacagagtttcttcgaaagaaggaaattcacccagacaacttagggcctaaacacctgagccgggatatggatggcgagcaacttgagggagcctctagcgaaaagagagaacgcgaagccgcagaggagggtctcgctagcgtgaagcgaccccgtcgcgaagcattgagcaacgacacaactgagtcacttgcagccaactccagaggcagagaaaagcccagacccttgcatgccctggcagcaggatttagcccaccagtcaatgtcacagtttcaccacggtctgaggagtcacacacgacaacagtgtccggcggaaacggaagcgtgtttcaggctgggccacaattgcaggcgcttgcaaacctggaggctaggcgtggatctattggtgccgcactgagctctcgggacgttagcggcttgccggtttatgcccaatctggagaacccaggcgtctgacccaggcacaggtggcggctttcccaggcgagaatgctctggaacacagcagtgatcaggatacttgggactctctgagaagcccaggtttctgcagccctttgtcctcagggggtggtgctgagtctttgcctcctggaggtccgggacatgccgaggctggtcaccttggaaaagtctgcgatttccacttaaaccatcagcagcctagtccgacttcagtgctgcctactgaggtcgcggcaccaccccttgagaagattctcagcgtggacagcgtggccgtggattgcgcttatcgcaccgtgcctaagccaggcccacagcctggtcctcacgggtcactattaaccgaggggtgtctgcgctcactgagtggagacttgaaccggtttccatgtgggatggaggtacattccggccaacgggaactcgagagtgtggttgctgtcggcgaggccatggcctttgagatcagcaatggctctcacgagctgttgtcacagggccagaaacagatttttattcagactagcgatggccttattctgtcacccccaggcactattgtgtcacaggaagaggacatagtcactgtgacagatgcggagggacgggcatgcggctgggcaagatag

SEQ ID NO: 61392 - DNA, 2436 bp, Artificial Sequence
  Description of Artificial Sequence: Synthetic coding sequence
atgctgttaccgacaacgatccagccacagacagccagaaaatcacagttacctaggggaaactcctgcttggtgggcctccacatcgccagcccacagcttctgagggtgcagcctctggtgcgtactgaaccacagtcatgctttctgtctgacctgtgccaacccccagctcagggattcgtacaaagaccactgcccgctctgcaggttgtgcccgcaaaacgcgtccccgctcccaaggccccagacgaacagggctccatgttaaccccattaagcgcttccgatcctcttgcagtaacatcattaagctctagctcggctcacccattcattagtaacttgcatacaagacataccgaaaaacttaagaagtccctcaaagtgaagacccgcagcggcagggtctccagaccgcctaaatacaaggcgaaggactacaaatttatcaaaaccgaagacttagccgacgggcacttgtccgatagcgatgattactccgagctctgtgttgaagaagatgaagaccagagggagaggcacgcattgttcgacctgtcatcctgcagccttcgtcctaaaagctttaagtgtcagacatgcgaaaaaagttacatcgggaagggaggattggctaggcatttcaagctaaaccccggacatgggcagctagaccccgagatggtgttgtctgagaaagcaagcgggtccaccttgcggggatgtacggaggaaaggacactgagcctgacaagtctgggcctctcaatgccagccgacccttgcgagggtggggcaaggtcgtgtctagttacagagtcagcgaggggcggtctccagaatggccaatctgtagacgttgaggagactttgccctctgagcccgagaatggagcgctgctgcgatccgaaaggtatcagggacccagacggagagcttgctccgagacgctggccgaaagtcgcaccgcagtcctccagcagaggcgagccgcacagctccccggtgggcctgctgcagcaggtgaacaacgcgcatccccatccaaggctcggttaaaggagtttcttcaacagtgcgatcgggaagacctggtggagttagctcttcctcagctggcgcaagttgtcacagtgtatgaatttctcctgatgaaagtagaaaaggaccacttggctaagcctttctttccagctatctacaaggagttcgaagagctccacaagatggtgaaaaagatgtgtcaggactacctttcctcttctggcctgtgctcgcaggaaacattggaaattaacaacgacaaagtggctgagtccctgggcataacagaattcttgcgaaagaaggaaattcatcccgataaccttggccctaaacacttgtcccgagacatggacggggaacagttggagggagcatcctccgaaaagagggagcgcgaggccgcagaggaagggctggcgagtgtgaaacggcctcgcagggaagccctgtcaaatgatacgaccgagtcactggcggcaaactcccggggacgggagaagcccagaccccttcacgctctggctgccggattctcccctcctgtcaatgtaaccgtttcccctaggagcgaggaatctcacacaacaactgtgagcggaggcaacggatcggtttttcaggccggaccacagctacaggctctggcaaacctcgaagctcgacgtggcagcattggagccgctctgtcaagtcgggacgtgtccggtctgcccgtttatgcccagtctggcgaaccaaggaggttgacccaggcccaggtagccgctttcccaggagagaacgccctcgagcactcctctgatcaggacacttgggattcactgcggagtcctggcttctgctcccccctgagcagtgggggaggcgctgaaagcctgcccccaggaggcccaggccatgccgaggccggtcacctcgggaaggtttgcgatttccacctcaaccatcaacagccttcccctacttctgtacttccaaccgaagtcgctgctcctcccttagagaagatattgagcgttgattctgtggccgttgattgcgcgtaccggaccgtacctaaacccggtccgcagcccggaccacatggttcgctactgaccgaaggatgcctgaggtcgctgagcggcgatttgaaccgctttccctgtggaatggaagtgcacagtggacagagagagcttgaatcagtagtcgcggtgggcgaagcaatggctttcgagatttccaatggctcgcacgagctgttgagccagggacagaaacagattttcatccagacctccgacggattgatcctgtcaccccctggcacaattgtgagccaagaggaggatattgtaactgtgactgacgccgaggggagggcctgtggatgggctagatag

SEQ ID NO: 61393 - DNA, 2436 bp, Artificial Sequence
  Description of Artificial Sequence: Synthetic coding sequence
atgctgctccctaccactattcagccacagaccgccagaaaaagccaacttcccaggggaaacagttgtctggtgggcttacacatagcgagcccgcaactccttcgggtacagcctctggtaaggactgaaccgcaatcgtgtttcctgagcgatttgtgtcagccaccagcccaggggtttgtgcagcgaccccttcccgctctgcaagttgtgcctgctaagcgagtcccagctccgaaagctccagatgaacagggtagtatgctgacccctttgagtgcctcagaccccctcgccgtcacttctctgtcctctagttcggctcatccatttatctcaaacctgcacaccagacataccgaaaaactcaaaaagagcttgaaggtcaagaccagatctggccgagtcagccgacctccaaaatacaaagctaaggattataagtttattaaaacagaggacctggcggacggccatctttccgattctgacgactactctgaactgtgtgtggaggaagatgaagaccaacgtgagagacacgccctctttgatctctcttcctgctcattgagaccaaaaagctttaagtgtcaaacatgtgagaaatcatacatcgggaaaggcggattggcaagacattttaagttgaatccaggccatgggcaactagacccagagatggtgctgagtgagaaggcttctggctcaactctccgtgggtgtacggaagagcgcacactgagtctcacgtcgctgggtcttagcatgcctgcagatccttgcgaaggcggtgcgaggtcatgccttgtaactgagtcagccaggggcggtctgcagaatgggcagtcagttgatgtggaggaaaccctccctagcgaaccagaaaatggagcactgctgaggtctgaacgataccaggggcctcgcagacgcgcttgctccgaaactctagctgaatcccgcacggcggtgctgcagcaacgccgtgctgcacagctccccggtggaccagccgctgccggagagcagagggcatccccgtccaaggccaggcttaaggaattcctgcaacagtgcgaccgggaagatttggtcgaactcgctttgccacagctggcccaggttgttacagtttatgaatttctgctcatgaaagtagagaaagatcatctggctaagcccttcttccctgctatttataaagagtttgaggagttgcacaagatggttaaaaagatgtgtcaggattatctgagttcaagcggtctttgtagccaggaaaccctggaaatcaacaatgacaaggtggccgaatctctcgggataactgagttcctgaggaagaaagagattcaccccgacaatttaggacccaaacacttgagtagggacatggatggcgagcagctcgagggagcctcaagcgaaaagcgcgagcgcgaagcagctgaggagggcctcgcatccgttaagcggccacggagagaagccctgtcgaacgacacaactgagtctctcgccgcaaactcaaggggacgtgagaaaccacgccctctgcatgccctcgctgccggatttagccctccagtgaacgtgaccgtgagcccccgttcagaggaatcccacaccactactgtttccgggggtaacggaagcgttttccaggcaggccctcaactccaggcactggctaacctcgaggcccgtcgaggtagtataggcgctgccttgtcttctcgtgatgtgtccgggctgccagtgtacgctcagagcggcgagccaaggaggctgacgcaggcccaagtggcagcctttccaggcgaaaatgcactggagcactctagcgatcaagatacctgggattcccttagatccccaggcttctgttcccctttatcttcaggcggaggagcagaatccctgccgcctggcggtcctggccatgcagaggccggacatctggggaaggtctgtgattttcatcttaaccaccagcagccatcacccacctctgtgctgccgactgaggtggccgctccccctctggaaaagattctttcggttgacagcgtggccgttgactgcgcttatcggacggtgccgaagcccggaccccagcctggaccgcacggcagtctgctgacagagggatgcttgcgcagcctgagcggcgatctgaatcggtttccttgtggcatggaggtgcattccgggcaacgtgaactcgagagcgttgtggccgtgggagaggccatggcctttgaaatctcaaacggttcacacgaactcctctcacagggtcagaaacaaattttcatccagaccagcgatgggctcattttgagccctcccggaaccattgtctcacaggaggaggatatcgttaccgtgactgatgctgagggtagagcgtgcgggtgggcgagatag

SEQ ID NO: 61394 - DNA, 1047 bp, Artificial Sequence
  Description of Artificial Sequence: Synthetic coding sequence
atgcgtagtcttcctttcgccctgacagtggaatccgtaagcgctcgcgcaccgacctgctgctcaactggcaggttcactcaggggaggcagccttgtaagtgcaaagcgtgtggccgaggcttcacccagtctgcctccctcctgcagcactggcgtgtgcactccgattggagagagacgctatcactttcgcctgtgagacaagatctcctgtggcccctgcagccccaccaggcccctgccagtccactgggacgctcccactcctccgctggagtgcggcagggattttctggccagttgtgctgctggcttacaaaggagcacaccttggcagaggccctgcgactgtcccctgttcctgctgggttttggggacctgtggaagcagacaggccacctgccaatagccatcgccgtgtttgtccgttttgctgctgttcttgcggagattccgttaacgagaaaaccagtcttagtcagagagtgctccctcaccctggtgagaaaacatgtcggggtggctcagtcgagagcgtcagtttagcccctagttcagtggccccagatagcacttcagggctgagaccttgtggctcccccggtagttttctccagcacttgcctcccagtaccttgctgcctcgccctcccttcctgtatccagggcctccacttagtctgcagcctctggtaccctctggtcttcccgctgttcccgcagtgcccctgggcggactagaagttgcccaggtgcccccagctacacagcccgcagcgcagcaggagggggcaatgggtcccaggagctgcgcttctgcagggagagacagccgcgaagccgtgcaagcgcctgggtatcctgagcctgcccgtaaggcatcccaacaccgggctgcaggacccctaggagaagctcgagctcggctgcagaggcagtgccgcgctcccccacccccttcaaacccgcactggcggggtgccttgcctgtttttccagtgtggaaggccagttcccggagaagtaatctggccaggcactag

SEQ ID NO: 61395 - DNA, 1788 bp, Artificial Sequence
  Description of Artificial Sequence: Synthetic coding sequence
atggggcctctcacttttcgtgacgtggccatcgagtttagcctgaaggaatggcagtgtttagacactgcccagcgcaatctgtaccggaacgtcatgctcgaaaattatcggaatctcgtatttttgggcatcactgtgtcgaaaccagacttaataacctgcctggagcagggcaaggaggcctggtctatgaagagacacgagatcatggttgctaaacctacggtgatgtgctctcatttcgcacaggacctgtggcccgagcagaatatcaaggacagcttccagaaagttaccctcaagaggtatgggaagtgccgacacgaaaacctgcctctgagaaagggatgcgagtctatggacgaatgtaagatgcataaggggggatgtaatggtctcaaccagtgtctaacagcaactcaatctaagattttccagtgcgataaatacgtgaaagtcgcccataagttctcgaactctaaccgccacgagattaggcataccaaaaaaaagccattcaagtgtaccaagtgcgggaaatcctttgggatgattagctgtctaacagaacatagccgcatccatacccgagtgaatttttacaaatgtgaagagtgcgggaaggctttcaattggagtagcacactcaccaaacacaagagaattcacaccggagagaaaccatataagtgtgaagaatgtggaaaggccttcaaccagagcagtaacctaattaaacacaagaaaattcacactggcgagaagccatataaatgtgaagagtgtgggaagacatttaatcgcttctcgaccctcaccacacacaagataatacacacaggcgagaagccatataaatgtaaggagtgtggaaaagcctttaatagatctagcactctgacgacacacagaaaaatccacacaggggaaaaaccttataaatgcgaagaatgtggaaaagcctttaaacagtctagtaatctgacaacccataaaataattcacacaggcgagaaaccttacaaatgcaaaaagtgcggcaaggcattcaatcagagcgcccacctgacgacccacgaggttatccacacaggtgagaagccctacaagtgtgaaaagtgcgggaaggcgtttaaccatttttctcatctaacgactcacaaaatcatacacaccggggaaaaaccgtataaatgtaaagaatgcggaaaggccttcaagcattcctccactctcacgaaacacaaaatcatccacaccggcgaaaaaccctataaatgtaaggagtgcgaaaaagcttttaatcagtccagtaaactgacagagcacaagaagatccatactggagagaagccctatgagtgtgagaagtgcggaaaggcctttaaccagagcagcaacctgacacggcacaagaaaagtcacacagaggagaaaccatacaagtgtgaggagtgtggtaaaggtttcaagtggccgtccacacttaccatccataaaatcatacacacgggagagaagccttacaagtgtgaagagtgtggcaaagcatttaaccagtccagtaagcttaccaaacacaagaagatccacaccggtgaaaaaccctatacatgcgaagagtgtgggaaggcctttaaccagagcagtaaccttaccaagcacaaacgtatacacacaggtgaaaagccttacaagtgcgaggagtgcgataaggctttcaagtggtcgtctgtcctgaccaaacacaagatcatccacactggcgagaagctgcaaatttag

SEQ ID NO: 61396 - DNA, 3273 bp, Artificial Sequence
  Description of Artificial Sequence: Synthetic coding sequence
atgaacatggaaggactggtgatgttccaggatctgtcgattgacttttcccaagaggaatgggagtgcctggatgctgcgcagaaggatctttaccgcgacgtgatgatggaaaactactccagcttagtcagtcttggcttgtcaattccgaaacctgacgtaatttcattgctggaacaaggcaaggagccgtggatggtcagtagggatgttttgggcggatggtgtagagattccgaattccgatgcaagactaaggattcttgcctccctaaggaaatctacgaggtgacctcctctcagtgggtcagaatggagaagtgccactcactggtcggttcctccgtcagggatgattgggagtgtaaagggcagtttcagcaccaagacattaaccaggagcgctatttagagaaggcgataatgacatacgagactactcccactttttgccttcagacctctcttaccttacatcaccgtatccatcctggcgagaagctgtacaaatccacggaatgcatggcatttaaatacggctccgaactgacgcaacagcaggaaactcataccggggaaaaactatacaagtgtaaggagtgtgggaaggcctttcatcatttcagctatttggttaagcaccaacgaatccacacgggtgagaagccctgcgcgtgcaaggaatacggcaaggctttcatcagcgggtcacacctgatacagcaccagaagatgtacaccgatgaacggcctcacgaatgccaagaatcagtaaaagcatttcggcctagcgcccatctcattcagcattggagaattcacaccggtgacaagccctatgagtgtaaggagtgcggaaaatcctttaccagcgggtccacactgaatcagcatcagcaaattcataccggcgaaaagccttatcactgcaaacagtgcgggaagagctttacggtgggatctacactgattcggcaccagcaaatccacaccggtgagaagccatacgactgcaaggaatgcggaaagtcattcgcttcaggaagtgccctaatacgtcaccagcgaatccataccggcgagaagccatatgattgtaaagagtgcggcaagagcttcaccttccatagcgctctgattagacaccaacgaatccacaccggagagaagccttatgactgtaaggagtgcggaaagagctttacattccgcagcggcctcataggccatcaggccatccatacaggcgagaaaccctacgactgtaaagagtgtggcaaatcttttaccgcaggaagcactcttatccagcaccagcgtatacacaccggggaaaagccatacgattgtaaagaatgtggcaagtcatttgcaagcgggtccgccctcttgcagcaccaacggatacacacaggagagaaaccctattgttgcaaagaatgtgggaagtcatttacctttcggtcaacacggaaccgtcatcagcggatccacacgggggaaaagccctataactgtaaagaatgtggaaagagcttcgcaagcggcagcgctctcctgcagcatcaacggatacacaccggcgagaaaccttaccattgcaaggagtgcggcaaaagcttcacattcaggtcgggcctaatcggccatcaggcggtccacactggcgagaaaccttatgattgcaaggagtgcggaaaatcattcacatctaggtcagcacttatccagcaccagagaatccacaccggagagaaaccataccattgtaaagagtgcggtaagtcctttacagtgggatctacacttctccagcatcagcagattcatacaggcgaaaagccatatgattgcaaggagtgcggaaaggcctttcggcttcgtctccgacttacccagcatcagcagatccatacaggcgagaaaccctaccagtgtcaagagtgcgggaaggcattcgtaagcgtctctggtttgacgcagcatcatcgtatccacacaggagagaagccctatgagtgtcccgattgcggcaaagccttcagacagagaacttaccttaaccaacatcgccgaatacacaccggagaaaaaccatatgagtgtaaagaatgcggtaagtccttcaccttttgttccggcctgattcagcaccagcagaatcatacggacgagaagccctacgatggaaaagagtgtggcaaatcctttacctctcacagcactctcattcagcaccaacagattcacactggcgagaagccctatgattgcaaggagtgcggtaaatcgtttacaagccacagcacccttattcagcatcaacagatacataccggtgaaaaactgtacgattgcaaggaatgtggaaagagctttacctcccactccacgctgatccagcaccagcctctgcacactggagaaaaaccctaccattgtaaagaatgtggcaagtcctttactctaaggagcgcccttatccagcaccgcccagtacacacaggcgaaaaacgctactcgtgcaaagagtgtgggaagtcttttaccagccggtccacgctgattgagcatcagcggatccacactggcgagaagccataccattgtaaggagtgcggtaagtccttcgccttccgaagtgccattattcagcaccgcagaatccatacaggtgagaagccttacgactgtaaggagtgtggaaaggccttccgcaggcggtctaaactgacccaacaccaaagaattcatactggcgagaagccctacagatgtcacgaatgtggaaaagcctttgtgaggttcagtggcctgacaaagcatcactctatccacaccggggagaaaccctatgagtgcaagacttgcggcaagtcatttcgacaaaggacccatcttaccctgcaccagcggatccacacgggagatcgcccatacgagtgtaaagaatgtggaaaatcattcacctgcggaagcgagctgatacgccatcagcggactcacacaggcgagaagccgtacgattgcaaggaatgtgggaaggccttccgttgtccctcccagctgtcacagcacaagcgcattcacacaggagaaaaaacctaccagtgtcccgaatgcggtaaagcttttttctacgcctccggattaagcagacaccagagtgttcacactggagagaaaccgtatgaatgcaagacctgtggcaaggcctttaagcagcttacacagttaacaagacaccagcgaatccacgatctgacatag

SEQ ID NO: 61397 - DNA, 1593 bp, Artificial Sequence
  Description of Artificial Sequence: Synthetic coding sequence
atggtaagacctcaggacactgttgcctatgaggacctgtcagaagattacacccagaaaaagtggaaagggctcgccctcagccagcgagccctgcattggaatatgatgttggagaatgacagatcaatggcttcactgggcagaaatatgatggaatcaagcgagctaacgcccaagcaggagatctttaaggggtctgaatctagtaattccacatcaggcggtctgtttggggttgtgcctggcggaaccgagaccggagacgtctgcgaggacaccttcaaggagctcgaaggtcagccaagtaacgaggaaggcagtaggcttgagtcagactttcttgagatcatcgatgaggacaagaaaaagtctacaaaggatcggtacgaagagtataaagaagtggaagagcatccccctctgtcctcaagtccagtggagcatgaaggggtgcttaagggacaaaagtcgtatagatgtgatgaatgtggaaaggcattttactggagctcccacctgatcggccaccggcgtatacacacaggagaaaagccatacgagtgtaacgagtgtgggaagaccttccgccagacatctcagttgatcgtgcatctgagaacccatacaggggaaaaaccctatgagtgtagcgagtgtgggaaagcttaccgtcattcctctcatctgatacaacaccagcggctgcacaacggggagaagccgtataagtgtaacgagtgtgcaaaggcatttaatcaatcttccaagcttttcgaccaccagcgcacgcataccggcgaaaagccttatgaatgcaaagaatgcggagccgcttttagccgttctaagaatctcgtaagacatcaattccttcataccggtaagaagccttacaaatgtaacgaatgcggcagggcattctgtagcaaccgcaacctcattgatcaccagcggacacacaccggtgagaagccttacaaatgtaatgaatgcggaaaggcctttagtaggtccaagtgtttaattcggcaccagtctttgcatactggcgagaagccctataagtgctcagagtgtggtaaagcgtttaatcagatatctcagctggtcgaacatgagcggatccatacaggagagaaacccttcaagtgttcagagtgcggaaaggccttcggactctctaaatgtctgatccgccatcaacgcttgcatacgtccgagaagccttacaagtgcaacgagtgcggaaagtccttcaaccagaactcatatctgatcatccaccaaagaatccatacgggagagaagccgtacgaatgtaatgagtgtggcaaagtgttctcttacaatagtagtctgatggttcaccaaaggacccacactggggagaagccttacaaatgcaattcctgtggcaaggccttctctgattctagccaactcacggtgcaccagcgagttcatacaggggagaagccttatgaatgcatagagtgcggtaaggcctttagccagagatcgaccttcaaccaccaccagcgtacccatgccggagaaaagccaagcggcttagctaggagttcatcatag

SEQ ID NO: 61398 - DNA, 1632 bp, Artificial Sequence
  Description of Artificial Sequence: Synthetic coding sequence
atggtccggcctcaagataccgtggcctatgaagacctgtccgaagattacactcagaaaaagtggaaaggcctcgccttgagccagagagcactgcactggaacatgatgctcgagaacgacaggagtatggcctccctcggtagaaatatgatggagtcctcggagctcacccccaagcaggaaattttcaagggcagcgaaagcagtaactcaacctctggcggattattcggggtcgtcccagggggaactgaaacaggggacgtgtgtgaagacacatttaaggagctagagggccagccttccaacgaggaggggtctaggttggaaagcgattttctggaaattattgacgaggacaagaagaaatccaccaaagataggtatgaagagtacaaggaggtcgaggaacacccaccattgtcctcttcgcccgtggaacacgagggcgttcttaaggggcagaaaagctacaggtgtgacgaatgtggtaaggctttctactggtccagtcacctaatcggacaccgtcgtatccataccggcgaaaagccctacgagtgtaacgagtgcgggaaaaccttccgccaaacctcacaattaatagtccatctcagaacccatacgggggagaaaccctacgagtgttccgagtgtggcaaagcttacagacactcctctcaccttatacagcaccaacgcctgcataatggcgagaagccctataaatgcaacgaatgcgccaaggcattcaatcagagcagtaagctctttgatcatcagaggacacacactggagaaaaaccctatgagtgcaaagaatgcggggctgccttttcccgctccaaaaacctcgtaagacatcagtttctacataccgggaagaagccatataaatgcaacgagtgcgggagagcattttgcagcaatcggaacctgattgatcaccagcggacccatacaggtgagaaaccctacaagtgcaacgaatgcggaaaggcctttagcaggtcaaagtgtctcatacggcatcagagcctgcacacaggcgagaagccctacaagtgctctgaatgcggaaaggccttcaaccaaattagtcagcttgtggaacacgaaaggatccatacaggggagaagcctttcaagtgctctgaatgcgggaaagcattcggtcttagcaagtgtttgatacgccatcagagactacatacaagcgaaaagccctataagtgtaatgagtgtggaaaatcattcaaccaaaatagttacctgatcatacaccagcgcatccacactggagaaaaaccttacgagtgcaacgaatgcggaaaggtgttctcatacaatagttctctgatggtgcaccagaggacgcacaccggggaaaaaccttataagtgcaacagttgcggtaaggccttctctgatagtagccagctgaccgtccatcagagagtgcacacaggggagaagaacttgatgaatgttttgtcagtcggcaagcctttggtgtccgtaccgcttctcatcaccaccagcgagctaatgttagagaggtcaccacaggtgtggcttggccacctgctcaaggcttggtttagtgaaaccgattccaaagacctgtag

SEQ ID NO: 61399 - DNA, 1980 bp, Artificial Sequence
  Description of Artificial Sequence: Synthetic coding sequence
atgctacaccagcccaccccaggcaaccgtggcctgacagcccgtatggaggttggtcccgcaaccgagacatttgtcctggaactgcagtgcctggaagatggcggtcctggacctgataccctatccggcggatcgggcggttccgagagtcaggaagaggaggaacctcaagagaggaattctagtcctcaacgtcccgctgtgtctgccccagtgggggcttcagaaatcgctgaggaaacccggcctggccagcgcgagctgcaactgcagcagctggagcagcagccggagcctcagcagcaaccccagcacgagcagctccagcagccacagccacatctggagctccagcagcagccgcagcaggacggtcagcaacagctgagccagctgcagcaggaaaaacaccagtcagtgcaccatcaggagctgaagccagaacttcaacttatgcaccaacagcaacaattgcagccccagcaggtgcaggagcaacagaggctgcagcagcagcaggagcaactgcaaacacagcaggcgcaggagcagcaggtgctgcagcagcaggaacaactgcagcagcaggtgcaggagcagcagctgttgcagcagcagcaggagcagttgcaacagcagcagttgttgcagcaacaagagcagcttcagcaacagcagttccagcagcaacaggagcaattgcaacagcagcagcagctgctgttgctgcagcagcagggtcagctgcaacagcagctcctccagcagcagcaagcccagctgcaacagcagctgctggagcagcagcaggcacagctccagcaacagctcttattacagcagcaagagcagttgcaacagcaacaacagcagcagctcctgcagcaacagcaggagcaactgcagcagcaacaactccagcctccgccactcgaacctgaggaggaggaggaagtagagcttgagttgatgccagtggacctaggcagcgaacaggaactcgaacaacagcgacaggagttagagagacagcaggagttggagcgccagcaagaacagcgtcagctgcagctgaaattgcaggaggagctccaacaactagagcagcagctcgagcagcagcaacagcagcttgagcagcaagaagtgcaactcgaattgactccagtcgagcttggggcacagcagcaggaggttcagttagaactgactccagtacagcctgaattgcagctggaactggtcccagctgcaggaggtggtggagctgcggtgcctggcgcacccgctgccgtggtagtcgcacccccaggctacgtcgttgtccaggaacttatggttttgcccgcagttgccgcacctgcagttgtggcgatccctggacccgcaggttctgcagcgctcacacccgctaggcagcgcaggagacgtagggccagagatagaccaactatctgcggcgaatgtgggaaggggttctcccgttcaactgacctggttcggcaccaggccactcataccggggagcgtccccatagatgcggggagtgcggaaaaggattctctcagcatagtaatctggtcacgcatcagaggatccataccggtgagaagccatacgcatgcagctattgtgctaagagattcagcgaatcatcagcgctggtgcaacaccagcggacccacacaggggagcggccatacgcatgcggtgattgtggcaagcggttctctgtctcatctaatctactgagacaccgacgcactcattccggcgagcgcccttatgtttgcgaagattgcggagaaaggttccgccataaagtgcagatccggaggcacgaaaggcagctacatggggcaggaagaagccgcggtctgggccttttacgggcatcccggcctgcagcactgggcggtccagcgcgagccgaacaggccgcaaccgccacagcacccgcagataaggcactgtag

SEQ ID NO: 61400 - DNA, 3180 bp, Artificial Sequence
  Description of Artificial Sequence: Synthetic coding sequence
atggaggccaacccagcagggagcggtgccggaggcggaggaagtagtggcattggcggtgaggatggcgtccattttcaaagctatccattcgacttcctagagttcctaaaccatcagaggtttgaacccatggagctttacggtgagcacgccaaggcggtggcggcactcccctgtgcccctggtccacctcctcagccacctcctcagcctcccccaccgcagtatgactaccccccacagagcacctttaagccgaaggctgaggtgccaagctccagttcctcgtcttcctcatcatcttcatcatcctcaagctcctccagctcgtctagtagttctagttctcaggcaaagaaacccgacccaccattgccacccgcattcggcgcaccaccacctccactctttgacgctgcattccccacaccccagtgggggattgtggatttatctgggcatcagcacttatttgggaatttaaagcggggtgggccagcttccggcccaggtgtaacaccaggactcggtgcgcctgctggtgccccagggcctctgcctgccccatcgcagacacctcccggaccaccggcagctgcagcctgtgatcccactaaagacgataaaggatactttagacgattaaagtacttaatggagcgcaggttcccctgtggcgtgtgccaaaaaagtttcaagcaaagctcacatctggttcaacatatgctggtgcattctggcgaaagaccttatgaatgtggagtatgtggaagaacatataatcacgtaagctcactgattcggcataggagatgtcacaaagacgtgccacctgctgctgggggtcctcctcagcctggccctcatcttccccctctcggactgcccgcacccgcagcaagtgccgcaacagctgctgcccctagcactgtctcctcaggcccaccagccacgccagtcgctcccgcacctagtgccgacggttcagccgcacctgcaggcgtgggagtcccacctcccgcaacagggggtggcgatggcccatttgcttgcccgctgtgctggaaggtctttaagaagccatcacaccttcaccagcatcagatcatccataccggggagaaacccttttcctgctcagtgtgtagcaaatctttcaatcggagggaatcccttaagcgtcacgtgaagacacacagtgccgatctcttgaggttgccttgcggcatttgtggcaaagcattcagagacgctagttaccttctgaagcaccaggcggctcacgcaggggctggcgcagggggtcccagacctgtttatccctgtgacctgtgcggcaaaagttacagtgcccctcagtccctactgcgacataaagcagcacatgcaccccctgccgcagccgctgaagcccctaaggacggtgctgctagcgctccacagcctccaccaactttccctcccggtccgtacctgctgccacctgaccccccaacgacagactccgagaaagccgctgccgcagccgcagccgtggtttatggcgcagtgcctgtcccattgctgggcgcacatccgttgttactggggggtgctgggacctcaggcgctggcggatcaggagcgtcggtacctggaaaaacattctgttgcgggatttgtggccgtgggttcggccgacgggagacattgaaaaggcatgaaagaatccacaccggggagaaaccccatcaatgccctgtctgcggcaaacgttttagggagtcgttccaccttagtaaacaccacgtggtccataccagagagagaccttacaagtgcgaactctgtggtaaagtgtttgggtatccccaaagtttgacacggcaccggcaagtacacagactgcagctgccatgtgcacttgctggtgcagctggcctgccatcaactcaaggtacacccggtgcatgcggcccaggtgcaagcggaacgagcgccggtcccacagatggactctcttacgcatgctctgactgcggagaacactttcctgacttgtttcatgtaatgtcccataaagaagtccacatggccgaaaagccctacggctgcgatgcatgcggcaaaacttttggcttcatcgagaatctgatgtggcacaagctggttcatcaggccgctcctgaaaggctgctgccaccagccccagggggattacagccacccgatgggtcttcaggaacggatgcagcctctgttcttgacaatggcctcgccggagaggtgggcgcagcagtcgcagccctggcaggtgtttcaggaggggaggacgctggaggcgcagccgtggccggtgctggcggtggggcatctagcgggcctgaacgcttcagctgcgcaacatgtggccagtcctttaagcactttttgggccttgtgacccacaaatacgtgcacctggtgcgacggaccctcggttgcgggctgtgtggccagtcgtttgcgggagcctacgatcttcttttgcaccgccgtagtcacagacagaaaagaggattccggtgcccagtgtgtggcaaacgcttttgggaggctgcactgttgatgaggcaccagcgttgtcacacagaacagagaccctaccgatgtggcgtgtgtgggcgaggttttttgaggtcttggtacttgcggcaacatcgcgtggtgcacacaggggaaagagctttcaagtgtggcgtgtgtgccaaacgctttgcacagagtagttcactggccgaacaccgtcggcttcatgccgttgccaggccccagcggtgttctgcctgcggcaaaacttttcggtaccgaagcaacctgctcgagcatcaaagactgcatttgggtgaaagggcttacaggtgcgaacattgtggaaagggatttttttacctgagttctgtcctacgccaccaacgggcacatgaaccgcctagaccggagctgagatgcccagcatgtcttaaggcattcaaggaccccggttatttcaggaagcatctcgccgctcatcagggaggaagaccttttagatgttcatcctgcggggaagggtttgccaacacatacggactgaaaaagcataggctcgcccacaaggcagaaaacctgggaggaccaggggctggcgctgggactcttgctgggaaagacgcttag

SEQ ID NO: 61401 - DNA, 1596 bp, Artificial Sequence
  Description of Artificial Sequence: Synthetic coding sequence
atggattctgtggccttcgaggatgttgctgtgaactttacgcaggaggaatgggccttactggatccatcccagaagaacctgtaccgcgaggtgatgcaggagacgctgcggaaccttaccagcattggtaagaaatggaacaatcaatatattgaggacgaacaccagaaccctcgtcgcaatctgaggcggctgatcggggagcgcctaagcgaatccaaggaatctcaccagcatggggaggtgctcacccaagtaccagatgacactcttaagaaaaagactcccggagtccagtcatacgaaagcagtgtttgcggcgaaataggaattggactgagctcactgaacaggcatctgagggcttttagttactcttcatcactggcaatccacggtagaacccacacaggagaaaagccatacgagtgcaaagagtgcggcaaagcctttcggttcccttcatcggtgcgcaggcacgaaagaattcactccgcaaagaaaccgtacgagtgtaagcagtgcgggaaggcgtttagcttcccgtcatcagttcgcaggcatgagcgtatccacagcgccaagaagccctatgagtgtaagcagtgtggcaaagcactcagttacctagtttcttttcagacgcacatgaggatgcatacaggggaacgaccccataagtgtaatatctgcgggaaggccttcttcagtcccagctcccttaagcggcacgagaagtcgcatactggtgaaaaaaggtataaatgtaagcaatgcgataaagccttcaattgtccgtcttcctttcagtaccacgagcggactcatagtggagagaagccctacgaatgcacacagtgtaggaaagcatttcgttcagtgaaatatttgcgcgtccatgaacgtaaacataccggcgagaaaccctacgagtgcaagctctgcgggaaagggttcatcagcagcacctcatttagatatcacgagaagactcacaccggagaaaagccttatgagtgtaagaagtgcgtgaaggctttctcctttgtgaaagacctgaggattcacgaaagaacacacactggagagaaaccttttgaatgcaagcagtgcgggaaaaccttcacctctagcaacagtttccactatcacgagagaacgcataccggcgaaaagccatacgagtgcaaacagtgcggaaaggcgtttcgctcagccagcgtgctgcagaagcatattcgaactcatacaggagagaaaccttacgggtgcaaacagtgtgggaaggtattcagggttgccagccagctcaagatgcatgagcgtacacatactggggagaaaccgtacgaatgcaaacagtgcgggaaagcgtttattagctcaaatagcatccgatatcataaaaggacacacaccggcgaaaaaccatataaatgcaaacagtgtggaaaggccttcatcagctccaattccttcctgtaccacgagaggattcatacaggagaaaagccctatgagtgcaaacagtgtggaaaggccttccgtagtgcgagcatcctgcagaaacacgtgagaactcacgctggttag

SEQ ID NO: 61402 - DNA, 297 bp, Artificial Sequence
  Description of Artificial Sequence: Synthetic coding sequence
atgctcagaagaggccacctggcgttcagggacgtggctattgagttccctcaggaagagtggaagtgcctggacccagcccagcggacactttaccgggaggtgatggtggaaaattacaggaacttggtgttccttggcatttgtcttcctgatctgagcgtaatctcaatgctagagcagaggcgcgatccccgtaacctccagtccgaagtgaagattgcgaacaaccctggatcctgttcggtgacccaggcagtagtcgaatggcaaagttcagtggcaatcgtggcttag

SEQ ID NO: 61403 - DNA, 1734 bp, Artificial Sequence
  Description of Artificial Sequence: Synthetic coding sequence
atgttaagaagagggcatttagcatttagagacgtggcaatcgaattccctcaggaagagtggaaatgcttagatcccgcacagcgaacattgtacagagaagtcatggtcgaaaattatcgtaatcttgtctttcttggaatctgcctgcctgatctctcagtcatttctatgttggagcagcggagagatccacgcaacttgcaatctgaggttaaaatcgccaacaatccaggaggcagggagtgcatcaagggggtcaacgctgagtcatccagcaaactcgggtccaacgcaggcaataagtctcttaagaatcagctgggccttactttccagcttcatttgtctgagttgcagcttttccaagccgaaaggaacatcagcggatgcaagcacgtcgaaaaacccatcaacaacagcctggtttctcccctgcaaaaaatttatagcagcgtcaaaagccacattctgaataagtaccggaacgattttgatgatagcccctttctgccccaagagcagaaggcgcaaattcgcgaaaaaccgtgcgagtgcaacgagcatgggaaggcctttagggtatcctccaggttggctaataaccaggtcatccacacagctgacaacccctacaaatgcaatgagtgcgacaaagtattctctaacagctcaaacctggtgcaacaccaaagaattcatactggtgaaaagccgtataagtgccacgagtgcgggaagctgttcaatcgaatatcactgctcgcccgtcatcaacggatccacacaggagaaaagccctataaatgtcatgagtgtgggaaagtttttacccagaatagtcacctggcgaatcaccatagaatccataccggagagaaaccctataagtgtaatgaatgcggaaaggtgtttaatcggaatgcccatttagcgagacaccagaaaattcattctggagagaagccatataaatgtaaggaatgtggcaaggctttctctggaggtagcggccttaccgctcacttggtgatccacactggcgagaaactctataagtgcaataaatgcgggaaggtcttcaaccggaacgcacatctgaccaggcaccaacgtatccacactggagaaaaaccctacgagtgtaaggagtgtggtaaggtgttcaggcataaattctgcctgacgaatcatcatagaatgcacaccggcgaacaaccttataagtgcaacgagtgcggaaaagcctttcgtgattgttcaggacttaccgctcaccttcttatccatacaggagagaagccttacaagtgcaaggagtgcgccaaggtattcagacaccgtctgagcctatccaatcaccagcgattccacaccggagagaaaccctacagatgtgacgaatgtggaaaagactttactaggaacagtaacctggcaaatcaccaccgcattcatactggcgagaagccatataaatgttcagaatgccataaagtatttagtcacaattcacatcttgcgaggcaccggcagatccacacgggcgagaaatcatacaaatgtaatgagtgtggcaaagttttcagccacaagctgtatttgaagaaacacgagagaatccacacaggggaaaaaccttaccggtgccatgaatgcggtaaagatttcacaagaaacagtaacctcgcgaaccatcacaggatccatacaggcgaaaaaccctatagatag

SEQ ID NO: 61404 - DNA, 1635 bp, Artificial Sequence
  Description of Artificial Sequence: Synthetic coding sequence
atggcggtgatggatctctccagtccctgggctctcactaagcaggattctgcttgttttcacttgcgcaatgcagaggaagagcggatgatagctgtctttttgacaacatggctgcaggaacccatgacattcaaggatgtggcagtggagtttactcaagaagagtggatgatgctcgactccgctcaacgaagtctttatcgtgacgtgatgctggagaactatcggaatcttacaagtgtagaataccagctgtataggctaacagtaatctcccccctggatcaagaggagatccgcaacatgaaaaaaaggattccgcaggcgatatgtcctgatcagaaaatacagccgaaaactaaggaatccaccgttcagaaaatcctctgggaagagccttcaaacgcagtgaagatgattaagctgacaatgcacaattggtctagtaccctgagggaggattgggaatgccacaagattcggaagcaacataagattccaggaggacactggagacaaatgatctacgccccaaagaaaacagtgccacaggaactttttagagactatcacgagctggaagaaaacagcaagctgggctctaaactcatttttagccaaagcatcttcactagtaagcactgccagaagtgttattcggagattggatgtcttaagcataattctatcattaataattatgttaaaaatagcatatcagagaagctgtacgagtcccacgagtgtgacaccaccctgtggcacttccagcgaaatcaaacagtgcagaaagagtacacctattcaaagcacgggatgcactttactcataatatgtttcctgttcctaacaacctccatatggcacagaacgcatgcgagtgcaataaggacgagacactttgtcatcagtcctccctgaagaagcaggggcaaactcacacagaaaagaaacatgagtgcaatcagtgtgggaaggcgttcaagcgcatctccaatcttacactatacaagaaaagtcacatgggcgagaagcaatacgaatgtaaagaatgcggtaaggtatttaacgatagctctaccctgagacgacatgtccgcacacacactggcgaaaagccctatgagtgcaaccagtgcggcaaagccttctcccagaaaactagcctcaaagcccacatgagaacccacacgggggaaaaaccgtatgagtgtaaccagtgcgggaagagcttcggtacatcaagctatcttatcgtccacaaacgcatccacaccggcgaaaagttgtatgaatgctccgagtgtgggaaggctttcaacacttcgagtcatctcaaagtgcataaaaagatccacaccggggaaaacgtatacgagtgttctgactgcggaaaggtgttttccggcgtctcgtcactccggatgcatatccgaacccacactggagagaagccatatgagtgtaaagaatgccgcaaggctttttccgtgtcttctagcctccgacggcacgtgcgcatccacacaggcgagaaaccatacgagtgcattcagtgtggaaaagccttctctcaaagcagcagcttgatcatccataagagaattcacaccgagagggagactctgtag

SEQ ID NO: 61405 - DNA, 2820 bp, Artificial Sequence
  Description of Artificial Sequence: Synthetic coding sequence
atggccacaagtcaatattttgattttgctcagggtggcggacctcagtattccgcacaaccccctacactgcccctccctaccgttggcgctagctatacagcccagccaaccccaggcatggatcccgcagtgaaccccgcatttccacctgcagctcctgctggctacggcggataccagcctcacagtggtcaggattttgcgtatggcagcaggccccaagaaccagttccaacggccacaactatggccacataccaagacagctactcctatggacagtccgcagctgctaggtcttatgaggacaggccgtatttccagagtgccgcattgcagtctggtcggatgaccgccgctgatagcggtcagcccggaacccaggaggcttgtggtcagccatccccacatggttcacatagccacgcacagcctcctcaacaggcgcctattgtggaaagtggccagcccgcatctacattgagcagtggctacacctatcctactgcaacgggggtacagccagaaagttccgctagcatcgtcacttcctatccacccccatcctacaatcctacttgtactgcctacacggctccaagttatccaaattacgacgcctccgtgtacagcgccgcttccccattttacccgccagctcagcccccacctcctcccggaccgcctcagcaactgcccccacccccagcccctgcaggttctggctcatccccacgggcagactcaaaaccgccactgccctcgaaactacctaggcctaaagcagggcctcgacagctgcagctgcactactgtgatatttgcaaaatctcttgtgcgggaccgcagacttatagagaacatctggggggtcagaaacataggaaaaaggaggcagcccagaagacaggcgtgcagcctaacgggtcacctcgcggagtgcaagcgcagctacactgcgacctgtgtgccgtaagctgcacgggcgcagatgcatatgctgcccacatacggggaagcaaacatcaaaaagtgttcaaactgcacgccaaactgggcaaaccgatccccaccttggaacccgcactcgcgaccgagagcccgccaggcgcagaggcgaagcctacatcacccaccggtccaagtgtttgtgccagctccagacctgcactggctaaacgcccagtcgcaagtaaagctctgtgtgagggacctccggagccccaggccgcaggatgcagacctcaatggggcaagccggctcagcctaaacttgaaggccctggggctccgacacagggcggttcaaaagaggccccagcaggatgttctgatgctcagcctgttggaccggagtatgtggaagaagtgtttagcgatgaaggcagggttctcagatttcactgcaagctgtgtgaatgttcctttaatgacctcaacgcaaaggacttacacgtgaggggcaggaggcatcggctacaatacagaaaaaaagtaaaccccgacctgcccatagccacagaacccagctcacgagccagaaaagtcctggaagagcggatgcgcaaacagcggcatctcgccgaagaaaggctggagcagctgaggagatggcatgccgaaagacgacgactggaggaggagcctcctcaggacgtcccccctcacgcccctcccgactgggcccagcccctgctgatgggacggcctgagagtcccgctagcgctccgcttcagcctggcaggcgaccggctagctctgatgatcggcacgttatgtgcaaacacgccactatatacccaacagaacaggagctgcttgccgtgcagagggctgtgagtcatgctgaaagggccctgaaactcgtgagtgacacgctggccgaggaagatcggggacgcagggaggaagaaggtgataagcgatcgagtgtagccccacagactcgcgttctgaaaggtgttatgcgggtgggaatactcgccaaaggcttgcttctccgtggggatcggaatgtgcggctcgccctgctatgctcagaaaagccaactcactctctcttgagacgtatcgcccagcagctgccacgccagttacagatggtaacagaggatgaatacgaggtgtcgtccgatccagaggccaacatcgttatttcgtcgtgtgaagagccgaggatgcaggtgaccatctctgtgacgtccccactgatgcgtgaggatcccagtaccgacccaggagtggaagagccgcaggcagatgcgggagacgttctctctccaaaaaaatgtctcgaatccctggctgccctgcgtcacgcgagatggtttcaggccagagctagcggtctgcaaccttgcgtgattgttattcgggttcttcgggatctttgccggagagtgccgacttggggcgcactgccggcatgggcaatggagttgttggtggagaaggcagtctcgtccgctgccggaccactgggcccaggtgatgccgtaaggcgggttcttgagtgtgtggccaccggaacactgctgactgatggacccggactccaggatccatgcgaacgggaccaaactgacgccctggagcccatgacattgcaggaaagagaggatgtaaccgcttcagcccaacacgccctgcggatgcttgcatttcgtcaaacccataaagttctgggaatggacctcttgcccccaagacatcgcctgggggcacggtttcgcaagaggcaacggggaccaggcgaaggtgaggaaggtgctggagagaagaagagggggagaaggggaggagaagggctggtgtag

SEQ ID NO: 61406 - DNA, 1101 bp, Artificial Sequence
  Description of Artificial Sequence: Synthetic coding sequence
atggctacctcacagtactttgacttcgcccagggtggcggaccacagtacagtgcgcaaccgcctactcttccacttccgaccgtcggagcatcatacactgcccagccaacacccggaatggatcctgccgtgaacccagcctttccgccagccgcaccagctggctacgggggataccagcctcattccgggcaggatttcgcctacgggagtcgccctcaggagcctgtacccactgccactactatggcgacttaccaggattcgtacagctacgggcagagtgcagccgcaaggtcatatgaggaccgcccatacttccaaagcgccgctctacagtcaggtagaatgactgcggctgatagtggacaaccgggtacacaggaggcttgtggacagccctccccacacggctctcactcccatgctcagcccccacagcaggctccaatagtggagagcggtcaacccgcaagcacactgagtagtggctacacataccccaccgccacaggcgtgcagcccgagagtagcgccagcattgtgacttcataccccccaccctcctataatcctacatgtactgcctatacagccccaagctaccctaactacgacgcttcggtgtattctgctgccagcccattttaccccccagctcagcctcctcccccaccgggaccccctcagcaattgcctccaccaccagcccctgccggaagcgggtcaagcccaagagcagactccaagcctccattaccatccaagctgccccgacctaaggccggtccgagacagctgcagctgcactactgcgacatttgtaagatctcttgcgccggaccgcaaacctatcgcgaacatttagggggtcagaaacatcgcaagaaggaggctgctcagaaaacaggcgttcaaccgaacggatcgcctagaggtgttcaagcgcaacttcactgcgatctgtgcgcagtgtcctgcactggggctgacgcatatgcggcacatattagggggtccaagcatcaaaaaggccttttgtctcacaggcaacaagctgcggacccatccgggggaaatcaaccaaacctcaattag

SEQ ID NO: 61407 - DNA, 213 bp, Artificial Sequence
  Description of Artificial Sequence: Synthetic coding sequence
atggccacttcgcagtatttcgacttcgcacagggaggtggccctcagtattcaccagaagtcgagactacgccgccagccctggcgtctgggctgccttgtgcccttccatggacggtgggatgcagcgggtctgatgcagtcacagccctgtgcccttccctccgcggactggcctgtatctgcagcattctatgggaccccgcttggtag

SEQ ID NO: 61408 - DNA, 843 bp, Artificial Sequence
  Description of Artificial Sequence: Synthetic coding sequence
atgttgagctgtaatatttgtggtgaaacggtgacttccgaacctgacatgaaggctcacttgatcgttcacatggagtctgaaatcatctgcccgttttgtaagctgtcaggtgtgaattacgatgagatgtgctttcacatagagactgcacatttcgaacagaataccctggagagaaacttcgagaggatcaacacagtgcaatacggaacctccgacaacaaaaaagataataccctgcaatgtggaatggaggttaatagtagtatactgtctggatgcgcctcaaaccaccctaaaaattcagcccagaatctgacaaaagacagtactctgaaacatgagggattttattcagagaatctgacagagtctcgcaagttcctgaagtcacgggagaagcagtcctcactaacagagatcaaagggtctgtctatgagacaacttatagcccacccgagtgtcctttttgcgggaagatcgaagaacattctgaggacatggagacccatgtgaaaactaagcatgccaacctgcttgacatccctctggaagactgtgaccagccattgtacgattgtccgatgtgtggcctgatttgtaccaactatcacatcttgcaggaacacgtcgatttgcacctggaagaaaattcttttcagcagggaatggaccgggtccagtgtagtggcgacttacagctggctcatcaattgcagcaggaagaggatcggaaacgccgaagtgaagagtcacgccaggagatcgaggaatttcaaaaattacaggagctcctgaaacatttcatcggaataatacgtatgctgccccagatgtag

SEQ ID NO: 61409 - DNA, 1737 bp, Artificial Sequence
  Description of Artificial Sequence: Synthetic coding sequence
atgttaagctgcaacatctgtggcgaaactgtcaccagcgagcccgacatgaaggctcatctgattgtccacatggagtccgagattatctgccccttctgtaagctctccggagtcaattatgatgagatgtgcttccacatagagaccgcccatttcgagcagaacacattggagagaaatttcgaacggatcaacaccgtccagtacggaaccagcgacaataaaaaagataacactctccagtgcgggatggaagttaactcatccatcttaagcggctgtgcaagcaaccacccaaaaaattccgcccaaaacctgactaaggacagcaccctgaagcatgaaggcttctacagcgagaatctgactgagtcccgtaagtttttaaagtcccgtgagaagcagtcctcattaaccgagatcaaaggaagtgtctatgaaaccacatactctcctccagagtgccccttctgcgggaaaatcgaggaacactcagaggacatggaaactcatgtgaaaactaaacacgcgaatctgctagacattccattggaggactgtgatcagccgctctacgactgtcctatgtgcgggttgatttgcaccaactaccatatcctccaagagcatgtcgatctccatctggaagaaaactctttccagcagggaatggaccgcgtgcagtgctcaggcgacctgcagctggcccaccagcttcagcaggaggaggaccgcaagagaagaagtgaggagtccaggcaggaaatcgaagagtttcagaagctccagaggcagtacggactagacaactccggcggttataagcagcagcagctgcgaaacatggagattgaggttaaccggggtaggatgcccccatctgagtttcaccgacgcaaagccgacatgatggagtcgctggcactggggtttgacgacggtaagactaaaacttcaggcattatcgaggctctgcaccgctattatcagaatgccgctactgatgtgcggcgtgtctggctgagctctgtcgtggatcattttcactcttctctgggcgataaaggttgggggtgtggatataggaacttccagatgctactatctagcctgttacagaatgatgcctacaatgattgccttaagggaatgcttatcccttgcattcccaagattcaatcaatgatcgaagatgcctggaaggagggttttgatcctcagggggctagccagctgaataacagactgcagggaacaaaagcgtggattggcgcatgtgaggtctacattttgctgacgagtctgcgtgtgaagtgccatatcgtggatttccacaaaagtacaggtcctctgggtacacatccccgattgttcgaatggattctcaattactactcgtccgagggggaagggtcccccaaagtggtttgcacaagtaagcctcccatctaccttcagcaccaaggacacagcaggaccgtcattggcatcgaggagaagaaaaatcgtacgctgtgtttgcttattctggaccctgggtgtcctagccgtgagatgcagaaactgcttaaacaggacatcgaggcaagcagcctcaagcagctgagaaaaagcatgggaaaccttaagcacaaacaatatcaaattctcgccgtagagggcgcactgagcctggaagaaaaattagccaggaggcaggcctcacaggtattcactgcagagaagattccttag

SEQ ID NO: 61410 - DNA, 1260 bp, Artificial Sequence
  Description of Artificial Sequence: Synthetic coding sequence
atgcccggtcgaggcaggtgccctgattgtggttccaccgagcttgttgaagatagtcattattcacagtctcaactggtctgttctgactgtggatgcgtggtcacagaaggggtccttactacgactttctcagacgaggggaatctgcgggaagtgacctatagccgtagtacgggcgagaacgagcaagtgagcagatctcagcagagaggcctccggcgagtgcgcgatctctgccgagtgttacagcttccacctaccttcgaggacacagccgtggcctactatcaacaggcgtaccgtcactcggggatccgggctgctagacttcaaaagaaggaggtccttgtgggctgttgcgtactgatcacctgtcgccaacacaactggcctctgaccatgggagcaatttgtaccctgctatacgctgatctggatgttttctcctcaacctatatgcagatcgtgaagctcctagggcttgatgtgccaagcctgtgcctggcggaactggtcaaaacctattgttcttcgttcaagctgttccaggcttccccttctgtgccggcaaagtatgtggaagacaaagagaagatgctgtcccgaacaatgcaactcgtcgagcttgctaacgagacctggctcgtcactggacgacaccctctgcctgtgattaccgccgcaacattcttggcctggcagagcctacagccagccgaccggctaagctgttcattagcacgtttttgcaagttagccaacgtcgacttgccataccctgcctcatctcggcttcaggaactgttggccgtcctgcttcggatggcagaacaactggcctggttaagggtgctcaggctggacaagagaagcgtggtcaagcatatcggtgatttactgcagcataggcagagcctcgttcgttctgccttcagggatgggactgcagaggtcgagacaagggagaaagagccgcctggatggggccaggggcagggcgaaggggaggtcggcaataattctctggggctgccccaaggaaagaggccagcctcccccgctctgctcctgcctccctgtatgctcaagagcccgaagcggatttgccctgtgccacccgtgagcacagttacgggcgacgaaaatatctcagactccgagatcgagcagtacttaaggaccccccaagaggttagagatttccaacgtgcgcaggccgctagacaggcggctacctctgtccccaatcctccctag

SEQ ID NO: 61411 - DNA, 162 bp, Artificial Sequence
  Description of Artificial Sequence: Synthetic coding sequence
atggccgctacacaaaaactcgtgaaggatattatcgactcaaagaccggtgagaccgcctccaaacgatggaaaggggcaaagaatagtgaaactgccgctaaagtggctcttatgaagctcaaaatgcacgccgacggcgacaagtcccttcctcagtag

SEQ ID NO: 61412 - DNA, 132 bp, Artificial Sequence
  Description of Artificial Sequence: Synthetic coding sequence
atggctgccacacaaaagctagtaaaggatatcatcgattcaaaaacgggcgagacagcaagcaaaagatggaagggagcgaaaaacagtgaaactgccgcaaaggttgcgctcatgaaactgaagatgtag

SEQ ID NO: 61413 - DNA, 129 bp, Artificial Sequence
  Description of Artificial Sequence: Synthetic coding sequence
atggcagccactcagaagctggtgaaggatataatcgacagtaagacaggggaaactgcttcaaaaagatggaagggcgctaagaattctgaaaccgcagctaaggtggccctgatgaaattgaagtag

SEQ ID NO: 61414 - DNA, 294 bp, Artificial Sequence
  Description of Artificial Sequence: Synthetic coding sequence
atggcggctacccaaaaattagtcaaagatataattgactccaaaacaggagagactgcttccaaaagatggaagggcgcaaagaattcagagaccgcggctaaggtcgctctgatgaaactcaaaatgcacgctgatggtgataagagtcttcctcagactgaaagaatctactttcaggtctttctgccaaagggaagcaaagagaagagcaaacctatgtttttttgccaccggtggagcattggcaaggccatcgatttcgctgcctctctggctcgtcttaagaactag

SEQ ID NO: 61415 - DNA, 360 bp, Artificial Sequence
  Description of Artificial Sequence: Synthetic coding sequence
atggcggctacccagaaactggtgaaggacatcatcgattcgaagacaggcgaaaccgctagcaagcgctggaagggcgctaagaacagtgagacagcagcaaaggtggccctgatgaaattaaaaatgcacgctgatggcgataagtctctgccccagacggaacgaatttatttccaggtttttctgccaaaggggagtaaggagaaatcaaaacccatgtttttctgccatagatggtctataggcaaggcaatcgatttcgccgcatccctggcacggctgaagaacgataacaataaatttacagctaagaagctgcgcctttgtcatatcacctccggcgaagccttgccctag

SEQ ID NO: 61416 - DNA, 486 bp, Artificial Sequence
  Description of Artificial Sequence: Synthetic coding sequence
atggccgcaacccagaagttagtgaaggacattattgacagcaagaccggggagactgcaagcaagcggtggaaaggagccaaaaatagtgagacggctgccaaggtcgccctgatgaaactgaagatgcatgctgacggtgacaaatctctgcctcagactgagagaatctacttccaggtcttccttccaaaggggtcaaaggaaaaatccaagcccatgtttttctgtcacagatggagcatcggcaaggcaatagacttcgcagcatccctggcgcgactgaaaaatgacaacaataagtttaccgcaaagaagttgaggctgtgccatatcacatcaggagaggccctgcccctagatcacacccttgagacatggattgccaaggaggactgccccctgtataacggcggaaatattatacttgaataccttaatgatgaagagcagttctgcaagaatgttgaatcatacctcgaatag

SEQ ID NO: 61417 - DNA, 162 bp, Artificial Sequence
  Description of Artificial Sequence: Synthetic coding sequence
atggccgcaacccaaaaactggtcaaggatatcattgatagcaagaccggtgagactgcatccaagaggtggaagggagcgaagaactcagagacggcggcaaaggtagctctaatgaagctgaagatgcatgccgatggtgacaaaagccttccacaatag

SEQ ID NO: 61418 - DNA, 486 bp, Artificial Sequence
  Description of Artificial Sequence: Synthetic coding sequence
atggcagcgacccagaagctggtgaaagatataatcgattcaaaaactggggagactgccagcaagcggtggaagggagcgaaaaattcagaaaccgctgccaaagtggcactcatgaaactcaagatgcacgccgacggcgacaagagtttgccacagacagaaagaatttacttccaggtcttcctgccgaaaggctccaaggagaagagtaagcctatgttcttctgtcaccggtggagtattggcaaagccatagactttgcagccagtcttgcaaggctcaagaacgataacaataagtttacagctaaaaaactcagactttgtcatatcacttctggcgaggctctgccattggaccacaccctggagacttggatcgcaaaagaggattgcccattgtacaacggcggtaacatcatcctggaatatctgaacgacgaggaacagttttgtaaaaacgtagagtcttaccttgagtag

SEQ ID NO: 61419 - DNA, 186 bp, Artificial Sequence
  Description of Artificial Sequence: Synthetic coding sequence
atggcggcaacacaaaagctggtcaaagacataattgactccaagaccggcgaaactgcttccaagagatggaaaggggctaagaattctgagacagcagcaaaggtggcactcatgaaacttaagatgcacgctgatggcgacaaatccctgccccagaccgagcggatctattttcaggtgtag

SEQ ID NO: 61420 - DNA, 348 bp, Artificial Sequence
  Description of Artificial Sequence: Synthetic coding sequence
atggacaatcgcaaagagccacccttcttcaacgacgataacatggggcctttctactatcgcttgcacttctgtgacacgatggaattattcatagagacgctgacaggtacctgcttcgagctccgggtctctccctttgagacagttattagcgtgaaggccaagatcaggcgattagagggaatccctatctgccgccagcacttgatttggaacaacatggaactggaaaacgattactgtctgaatgattacaatatttccgaaggctgcaccctgaagcttgtgctggcaatgagagggggacccatcaacacacgtagagacttgcagatccctagatag

SEQ ID NO: 61421 - DNA, 2184 bp, Artificial Sequence
  Description of Artificial Sequence: Synthetic coding sequence
atggataatagaaaggagccaccctttttcaacgacgataacatgggccctttctattatcgactacatttctgtgacactatggagctgttcatcgaaacacttaccggaacatgctttgagctccgggtgtcccctttcgaaacagttatatctgtgaaggccaaaatccggaggttggaaggcatcccgatctgtcgccagcacctgatctggaacaacatggaactggaaaacgattactgtttgaatgattacaatatcagtgagggctgcacactgaagctggtgctggcgatgcgcggaggaccaattaatacgcgacgggtccctacagacgacccccttcgtaagatggcagagtacctggattccagtcgagtggaggtgtgggaaaagaccagctgcagcaaacaggtcacgtttctggtgtatcaggaaggggaccagttgaacttcttccctgcggtagatagaggtgacggcactctaactccccttagcgattcttccaaaaaaatcgacttccaccttcacgtcctcaggcggaaaggcgagcacagaatgtctgggggatccatgtacaactctgatacggacgaggacgaggaaaccgagccctctagtagcggacagcagatcatcgagaattccattacgatgaataaaatgaagttacttaaggccaagatgaaaaatatgaacctctcaaaaaaaccaaaaaaggccgtcaaaatcaagccacaccctcctgtggccccacgcccttcgtcgggttctaccgctccttcccgccaccggctgctgagagtgttgcccaacatcggacagtcctgcagtcccgctttcggcaacgcttacccccctgaaatttctcgcaacgggattagttctctggctacccagctctctgctgagcgttacatctcatcaatcactggcgagtttctcaaagaagataacagctgggagaacaacacactgtcccatttctcgtcaaacgtcaaactgcctccacagatccctcatctcgagttgggtaatgatcaagagttggccgattccgtgcttcatctcggctcatcactgccacggcagactaagcactttctaggcaatctcccatcttcgaacggaaacatcgtgttaccgagtgaagaatgcgtgacagagcaatctctgctgcccaaggtggggagcctggccagttttgccgaggggaacgcagatgaacaatcctcgggccttgagggagcgtgcaaagtgaacctggaattgctgttgaccaacgcggataaaggactgaaggccccagaacagcaccttaagcatgttgccggagttctgaacggagaatcggttgaaacatccgttctgaattatcgggagctttcccctcataaaaacaggctgctcagcccgctgcggtgcagtgcaccaatgtcgcttcacaactcactagtgaagcccgagcgtcaatccaagtgctttgaatttggaaagctccagccttcatcttcgcagagcctggacgtacagaatattaccgatagctccttcagccgcacgacttgtttccagggggtgaaggttgattcattgggaaagaggtccgacgttatttctaaggtggaggcacgagacattaccgagatgaccaataaggcgagcaaggagccggtcggttgtgtgaacaatatctcattcctcgcatcgcttgctgggtctacttcccggaatcgcctgcagagcacccggggtgccggtcgcctgcaaaattcagggaccggcctgtccacaaatcttcaacatttccaggaggaaaacttccgaaagtcatccccacaacttgagcacaccggcgtctttctgagcactcatggggtggggatgaacgggaataatgccgctgcaggaaagtctgtaggggaatgcaccactcaccacttgccgcctgtgaaggctccactgcagacgaagaagaagactacaaaccactgctttctttgcgggaaaaaaactggcctggctagctcatatgagtgtagatgcggaaacaacttttgcgcttcgcaccgatatgcagaaacccatgggtgtacctatgattataaatcggcaggcagacgctatctgcacgaagccaatcccgtagtcaacgctcccaaacttcctaaaatatag

SEQ ID NO: 61422 - DNA, 1962 bp, Artificial Sequence
  Description of Artificial Sequence: Synthetic coding sequence
atggagctagagaacgactattgtctcaacgattacaacatttccgaggggtgcacacttaaactggtgctcgctatgaggggcggtcctatcaacaccagaagagtgccaacagacgaccccctgcgtaagatggccgaatacctcgactcttctcgggttgaagtctgggagaagacatcctgctctaagcaagtgaccttcctggtttaccaggaaggcgaccagcttaatttctttccggcagtagacagaggagatggtaccctcaccccactgtccgactcgtccaaaaaaattgattttcacctacacgttttgaggcggaagggcgagcaccggatgagcggaggttcaatgtataatagcgataccgatgaggacgaagagacagaacctagcagctccggacagcagattatagaaaatagcataacaatgaataagatgaagctcttgaaggcgaagatgaaaaacatgaatctgagtaagaagccaaagaaggccgttaagatcaagccccatccgccagtcgcccctagaccttcttccgggtcaaccgctccctcgcggcatcgattgcttcgagtgcttccaaatatcggtcagtcctgctcgccagccttcggcaacgcttatcccccagagatttctcgcaacgggatctccagcctggccactcagctctcagcggagcgctatattagctccatcacaggcgaatttctgaaggaagataattcctgggaaaataacactctgtcacatttttctagcaacgtgaagctgccccctcagattccacatctagaactgggaaacgaccaggagctggcagactccgtgttacatttgggcagttccctgccgaggcaaaccaagcatttcctgggcaatctgccatccagcaatggaaatatcgttctgccctccgaagaatgtgtgacagaacaatctctgctcccaaaggtgggaagcctggcctctttcgcagagggcaacgccgacgagcaatcatccgggcttgagggagcttgcaaggtgaacctggagctgcttctgacaaacgctgacaaaggattgaaagcaccagagcagcaccttaaacacgtggccggagtgctgaacggtgaaagcgtcgagactagtgtgctaaactaccgggagttatcaccgcacaaaaacagactactaagtcccctcagatgctctgcccctatgtctttacataactcacttgtgaaacctgagcgacagtccaaatgcttcgaattcggcaaactacagccctctagctcacaatccctggatgtgcagaacatcaccgacagtagcttttcaagaaccacttgtttccagggcgtgaaggtggacagtcttggcaaaaggagtgatgtgatttcgaaggttgaagcacgggatatcaccgaaatgactaacaaggcaagtaaggaaccagtggggtgcgtgaacaatatcagtttcctggcatcgctggcaggtagcacgtcacgcaaccggctccaatcaacacggggtgctggcaggctccagaacagcggtacaggattgtcgactaatctgcagcactttcaggaggagaactttagaaaatcctccccacagctggaacatacaggtgtgttcctatctactcatggcgtgggtatgaacggcaataacgcggcagcagggaagagcgtgggagagtgcaccacccaccatctacctcctgtgaaggccccactgcagaccaaaaagaaaaccactaatcattgcttcctctgcggcaaaaagactgggcttgcctctagttacgaatgccgttgcgggaataatttctgtgccagtcatagatatgcggagacacacgggtgtacttatgattataagtcggcaggcagaagatacctccatgaagcgaacccagtagtgaatgcgcctaagctgcccaaaatctag

SEQ ID NO: 61423 - DNA, 1830 bp, Artificial Sequence
  Description of Artificial Sequence: Synthetic coding sequence
atggcagagtacctagactctagcagggtggaggtttgggaaaaaacatcttgctccaagcaggtgacatttctggtgtaccaagagggggaccagttgaatttctttccggctgtagacaggggcgatggaacgctcaccccacttagcgacagctcgaagaagattgacttccacttgcatgtcctgaggcggaaaggagaacaccggatgtccggtggatctatgtataatagtgatacggacgaggacgaagaaactgagccatcatcatccgggcaacagatcatcgaaaattcaatcactatgaacaagatgaagctgctgaaggcaaagatgaaaaatatgaacctgtcaaaaaaaccaaagaaggctgtgaaaatcaaacctcaccctcctgtggcccctcggcctagctccggatcgacagccccttcgcgtcaccgtctcctaagggtgctccctaacattggccagtcttgtagccctgcattcggcaacgcttatccacccgaaataagtcgaaatgggatttccagtcttgccacccaactttctgcagaacggtatatcagcagcattacgggagaattcctgaaggaagacaacagctgggaaaataatactctgagccatttctcatccaatgtgaaactgccaccgcagattccccatctggaacttggcaacgaccaggaactagctgactcggtgcttcatttgggaagctccctcccacgccaaacgaagcattttttaggaaatctcccatcttctaacggcaatattgtgctgccatcggaagaatgtgttaccgagcagtcacttctgccaaaagtggggtcattggcctcgttcgcagagggcaacgcggacgagcagtcaagtggactggaaggggcttgcaaggttaacctggaacttctgctgaccaatgctgacaaggggctgaaggcacccgagcagcacctcaaacatgtcgccggagtgttgaacggcgaaagcgtcgaaacaagtgtactcaattatcgagagcttagtccgcataaaaatagactgcttagccctctgcgctgcagcgccccaatgagcctgcataatagtctggtgaaacctgagagacagtcgaagtgtttcgaattcggaaaactgcagcccagcagcagtcaaagcctggatgtgcaaaatatcaccgactctagcttcagtaggacaacttgttttcagggcgtcaaagtagacagcctaggaaagagatcagatgtgatctcaaaggtagaggccagggatatcaccgaaatgaccaataaggcaagtaaagagcccgttgggtgcgtaaacaacatcagttttctggcatccctagctggaagcacttctagaaaccggctccagtcaacccggggagctggtcggcttcagaactcaggtacaggcctgtcaactaacctccagcacttccaggaagaaaattttagaaaaagctcaccgcagctggagcacacaggagtgtttctgtccacacacggcgtgggtatgaacgggaacaatgctgccgcagggaagagcgttggcgagtgtacaacccatcacttaccacccgttaaagcgcctcttcagaccaagaagaagacgaccaatcactgctttttgtgcgggaagaagacgggcctggcgtcctcatacgagtgccgatgcggtaataacttttgtgcgtcccacaggtacgccgagacacacggctgtacctacgattacaagtctgccggtaggcgctacctccacgaggcaaatcctgtggtcaacgcacctaaattgcccaagatctag

SEQ ID NO: 61424 - DNA, 675 bp, Artificial Sequence
  Description of Artificial Sequence: Synthetic coding sequence
atggataatcggaaagagccacccttttttaacgacgacaacatgggccctttttattataggctgcacttctgcgatactatggagctgttcatcgagacccttactggcacttgtttcgaactgcgcgtgtccccattcgagaccgtgatcagtgtaaaagccaagatcagaagactcgaggggatcccaatctgtcgccagcacttgatttggaataatatggaactggaaaacgattattgcctgaatgactacaatatctcggaaggttgcacactcaagttggtattggccatgcggggaggccctatcaacacaagacgggttccaacagatgatcctctgcggaagatggctgagtatctggacagctccagggttgaggtctgggaaaaaacatcctgcagtaaacaggtcaccttcttggtgtaccaggagggagaccagctgaactttttccctgcggttgatcgtggcgatggaactctcacacctttatccgattcttccaaaaaaattgactttcacctacacgttcttcggagaaaaggggagcaccgaatgcggcgaatgtattattctagcccacctacctgcgaatcgccctcatcagataaggaggagaacaacaaatctctgttctccctgtggaaagaaaatcgtacagggtag

SEQ ID NO: 61425 - DNA, 675 bp, Artificial Sequence
  Description of Artificial Sequence: Synthetic coding sequence
atggacaaccgcaaagagcctccttttttcaatgacgataatatgggccctttctattaccggctgcatttttgcgatacaatggagcttttcattgaaaccctcaccggcacctgctttgaattgagggtgagcccattcgagacagtgatctctgtgaaggccaaaattcggagattggagggaatccccatttgtcgtcagcatctcatttggaataacatggaactggagaatgactactgccttaatgactataatatcagcgagggctgcacgctgaagctcgtgcttgcaatgcgcggagggccaattaacacaagaagagtgcccacagacgatccactgcggaaaatggctgaatacctggacagctctagggtggaagtgtgggagaaaacctcttgtagcaaacaagttacattcctggtctaccaggagggtgaccagctcaatttcttcccagcggtggataggggcgacggaactctgacccccctctccgactcttcaaaaaagatcgacttccacctccacgtccttagacggaagggcgagcatcggatgaggagaatgtactattcaagcccaccgacctgcgagagcccttcctccgacaaagaagaaaataataagagccttttcagtctttggaaagagaacagaacgggttag

SEQ ID NO: 61426 - DNA, 627 bp, Artificial Sequence
  Description of Artificial Sequence: Synthetic coding sequence
atggcccaggagactaatcatagccaggtccccatgctctgcagcactggctgcggattctatggcaaccccagaacgaatggcatgtgttctgtgtgttataaagagcacctgcagcggcagaactcaagcaacgggaggatttctcctccagctaccagtgtaagctcactgtcagagtcactcccagtgcagtgcacagatgggtccgtgccagaagcccagagtgcgctggattctacctctagcagcatgcagcccagccctgtgtctaaccaatcactcctgtccgagtctgtcgcttcatcccaacttgattcaacctcagtggataaggctgtgcctgagaccgaggacgtgcaagcatctgtctctgatacagcacagcagccctccgaagaacagtccaagtccttggagaagccaaagcagaagaagaacagatgcttcatgtgccggaaaaaggttggattgaccggctttgaatgcaggtgcggcaacgtgtactgcggcgtgcaccggtattcagacgtgcataattgctcttataattataaagctgacgctgccgaaaaaataaggaaggaaaacccagtcgtagtcggcgaaaaaattcagaagatctag

SEQ ID NO: 61427 - DNA, 2520 bp, Artificial Sequence
  Description of Artificial Sequence: Synthetic coding sequence
atgaacagaaaggatttcgtcgtccttccttggggcaagccgggtaactctgttaaactcaaatacagaaatgcccaggagctccgaatggaaaaagtgcagttggaatttgagaatcaggaaatggagaagaaactgcaggagttccgctccacccggaacaaagagaaggaggatcgcgagtcctccgagtactattggaaaagcggcaaggtgggcaagctggtaaaccagagctacatgatgtcccagaataaaggcaacgtggtgaagttcagcgcgggtaaggtcaaacttaaactgttgaaggagcaaatccaggaacccgtgaagcccacggtcaattacaagatggctaacagctccgaatgtgagaagcccaagataaacggcaaagtgtgcggtcaatgtgagaacaaagcagctcttcttgtgtgtctcgaatgtggagaggactactgctcaggctgttttgcaaaggtgcatcagaagggtgccttgaaactccacaggactactctgttacaagcaaaaagccagatcctgtttaatgtgttggacgttgcgcaccaatttattaaggatgtgaacccagacgaacctaaagaggagaacaactccacaaaggaaactagtaagatacagcataaacccaaaagcgtgctgctgcagcggagttcaagcgaagtggagattacaactatgaaacgcgcacagaggacgaagcccaggaaatccctcctgtgtgaggggtccttcgacgaagaggcaagcgctcaatcgttccaggaggtgctcagccagtggcggactgggaaccacgacgacaataagaagcagaacctgcatgccgctgtcaaggattctctggaggagtgtgaagtccaaaccaacctgaagatctggcgcgaaccactgaatatcgagttgaaggaggacatactgtcgtacatggagaaactgtggctaaaaaagcaccggaggactccacaggaacagctgtttaagatgttacccgacactttccctcacccacacgagaccactggagatgctcagtgctcgcagaacgagaacgatgaggactctgacggtgaggaaaccaaagtacaacacactgccctgctgcttcctgtggagaccctgaacatagagcgcccagagcctagccttaaaatcgtggagctcgacgacacctacgaagaggaattcgaggaggccgagaacatcgtgccttataaggtcaagctggccgacgcagatagccaacgatcatgtgccttccacgattgccagaaaaactctttcccctatgagaacggcattcatcagcatcacgtgttcgataaaggcaaacgtgattttcttaatctctgcctacggaacagctctacctattataaagataacagtaaggccgagacctccaacactgacttcgacaacatagtcgatccagatgtgtactcatctgacattgaaaaaatagaagaatctacctcattcgaaaggaacctgaaggagaaaaatattggcctagagtcgaaccagaaaagcgacgatagctgtgttagcctggagagcaaggataccctgctcggacgggacttggagaaggcccctattgaggaaaaactgtcccaggacatcaaggaaagcctggagctatctaatttatataagcgtccttccttcgaagaatccaagactacaaagtcatctctcttgctccaggagatagcttgtagatccaagcccattacaaaacaataccaggggctcgaacgcttttttatcttcgacactaatgagcgccttaatctgctcccctcccatcggctggagtgcaataactcttctacacgcatcaccctcgccgaggaccgcgaatggattcctgaccacagtctgtcagagtatgctgataatgctatagtgctgggagtgctgcagggggctcagtcccctagttctagcaggaaacagcagaaaatgggccagaaatctcagagaccgagtactgctaactttccactgtcgaatagtgtgaaggagagtagtagttgtcttagtagcagccatcctagaagccggtcagccgcagcacaaagcagctctagggctgcatccgagatatccgaaatagaatatattgacatcaccgatcaaaacgagctgtccctggatgataccaccgaccagcataccctggataatctggagaaagagctgcaggtgctccggtcactggcggacactagtgagaaactgtattccctcacaagcgaagagttcccagacttctcctcccagagtcttaatatcagccaaatctccactgacttcctgaagacgtcccatgtgaggggcccatgtggcgtcgaagaactgagctgctccgggagggacactaagatccagtccctgctcagcctctctgagtcttctacggacgaggaggaggaggattttttaaacaaacaacacgtgattaccctaccctggtctaaatcaacttag

SEQ ID NO: 61428 - DNA, 2403 bp, Artificial Sequence
  Description of Artificial Sequence: Synthetic coding sequence
atgaatcgcaaagacttcgtagtgctcccatggggcaaaccaggcaatagcgttaaacttaagtatagaaacgcccaggagctcagaatggagaaagtgcagctggaattcgagaatcaggagatggaaaaaaagctccaggaattcagatccacccgtaacaaagagaaagaagaccgcgaaagcagcgaatattattggaagtccggtaaggtgggaaagctggtcaaccagagttacatgatgagccaaaacaaagggaacgttgtaaagttctccgccggtaaagtgaagctgaagcttttaaaagagcaaatccaggaacctgttaaaccaactgtgaattacaagatggctaattcgtccgagtgtgagaagcctaaaatcaacggtaaggtgtgtggacaatgtgaaaacaaagccgcactgctcgtctgcctggagtgtggggaagactattgctccggatgcttcgctaaagtgcatcagaaaggcgctctgaaactgcatcgtaccacactcctacaggccaaaagtcagatcttgttcaatgtactcgatgtagctcaccagtttattaaagatgtgaatcccgatgagccaaaggaagaaaacaacagtaccaaggaaaccagtaaaatacagcataaaccaaagtctgtactcctccagcgctcaagctctgaggtcgaaatcactacaatgaagcgggcacagcgaaccaaacctcggaaaagcctgttgtgtgaggggtctttcgacgaggaggcctccgcgcagtcattccaggaggtgttgtcccaatggcgaacagggaaccacgatgataacaagaagcagaatctgcacgcagcagtgaaggactccctggaggagtgtgaagtccagacaaacctgaaaatctggagggagcccctgaacattgagctaaaagaagacatcctctcgtatatggaaaaactctggttgaagaagcataggcgaactccccaggaacagctgttcaagatgctgccagacaccttcccacatccccacgaaaccactggcgatgcgcagtgctctcaaaacgaaaatgatgaggattccgatggtgaagagactaaagtgcagcatactgccttactgctcccagttgagactctcaacatcgagaggccagagccgagccttaaaattgtggaactggacgacacatacgaggaagaattcgaggaagccgagaacattgtcccatacaaagtaaagttggctgacgccgactcccagaggagttgtgccttccacgactgtcagaagaacagtttcccttacgagaatggtattcatcagcaccacgtgtttgacaaagggaaaagggattttctgaacttgtgtctgagaaatagctctacttattataaagacaacagcaaggctgaaaccagtaacaccgattttgacaacatcgttgaccccgatgtttattctagtgatattgagaaaattgaagaaagcacatcttttgagagaaacctgaaggagaagaacatagggctggaatcaaatcaaaagtcagacgattcctgcgtgtctctggaaagcaaggatactctgctcggaagggacctcgaaaaggcccctatagaggagaagctcagtcaggacataaaagagtccttagagctgagcaacctatacaagcggccaagcttcgaggaatccaagacaaccaaaagctctcttctgctccaggaaattgcctgtcgctccaagcctattacgaagcagtatcagggcctggaaaggttctttattttcgacactaacgaacgactgaacctattaccctcccatcggttagaatgcaacaattcctctacgaggataactctggcaggtcaaaagtcacaaagacctagtacagcaaatttccctctgagcaactccgtaaaggagtcaagcagttgcctgtccagttcgcatcccaggtctagatccgctgcagcacagtcttcatcacgggcagcatctgaaatatccgaaattgaatacatcgatattactgaccagaatgaactgagtctggatgacaccacggaccagcacacactggacaatctggagaaagaactgcaggtactgcgatcactagctgacacatccgaaaagctctactcactcacaagcgaggaatttcctgatttctcatcccagtcgctcaacataagtcagatttctacagatttcttaaagacatctcatgtacgtggcccatgtggtgttgaggaactgtcttgctctggcagggacactaaaattcagtcactcttaagccttagcgagtcttctaccgacgaggaggaggaagactttctaaataagcagcatgtgatcactcttccatggtctaagagtacatag

SEQ ID NO: 61429 - DNA, 2403 bp, Artificial Sequence
  Description of Artificial Sequence: Synthetic coding sequence
atgaatcgcaaagattttgtggtcctaccctggggaaagcccggaaactcagttaagctcaaataccggaacgcccaggaactgcggatggagaaggttcagctagagttcgaaaaccaggagatggaaaagaagctgcaggaattccggagcacacgcaataaagagaaagaagaccgcgagtcctcagaatactattggaagagtggcaaggtcgggaagctggtcaaccagtcttacatgatgtcacagaacaagggtaacgtggtaaaattttccgcgggtaaagtgaagcttaagctgctcaaggaacagattcaagagcccgtgaagcctaccgtgaactataagatggcaaacagcagcgagtgtgaaaagccaaaaatcaatggaaaagtttgcgggcaatgtgagaacaaagccgctctccttgtctgcttggagtgtggtgaagattattgtagcgggtgtttcgcaaaggttcaccaaaagggcgcattgaagctgcatagaaccaccctgctgcaggccaaaagtcaaatccttttcaatgtcttggacgttgcccaccagttcattaaagatgtaaacccggatgagccaaaggaagagaacaactccactaaggaaacttccaagatacagcacaaaccaaaatccgtgttgctgcagagatcctccagtgaggtggagattaccaccatgaaacgtgcacagcggaccaagccacgaaagtcacttctgtgcgaaggctctttcgacgaagaggcctctgcgcagagctttcaggaggtgttatctcagtggcggaccggcaatcatgatgataacaagaagcagaacttgcacgctgccgtcaaagactctctagaagaatgcgaggtccaaacaaaccttaaaatctggagggaacctctgaacatagaactgaaggaagacatcttgtcttacatggagaagctttggctgaaaaagcaccgccgaaccccgcaagaacaactctttaagatgctcccagataccttccctcacccgcacgagacgaccggagatgcgcagtgttcacagaacgagaatgatgaagactcagacggcgaggaaactaaggttcaacacaccgccctgttgctgcccgttgagactctcaatattgaacgccctgagccgtcacttaagatagttgagctggacgacacttatgaggaagaattcgaggaagcagagaatattgtcccttacaaggtaaagttagctgatgcagactctcagaggtcatgcgccttccatgactgtcagaagaactcatttccttacgaaaacggaattcatcaacaccatgtgtttgataaaggaaagcgggacttcctgaacttgtgcctgcgcaattccagcacgtactataaagataacagtaaggctgaaacgtccaataccgacttcgataacatcgtggatccagatgtctatagctcagacatcgaaaagatagaagaaagtacttccttcgaaagaaatttaaaagagaagaatattggccttgagagtaatcagaagtctgatgacagctgcgtctccctggaatccaaagatacccttctgggcagagatttggagaaggcacccatagaagagaagctgagtcaagatattaaagagagcctggaactgagtaacctttacaagagaccatcatttgaggagtccaagactactaagagttctcttctgctgcaggagatcgcttgcagatcaaagcctattacaaagcagtaccaaggcctggaaaggttcttcatttttgacactaacgaacgtctgaatctgcttcccagtcaccgcctcgaatgtaataattcaagcacaagaatcaccttggccggtcaaaagtctcaaaggccatcgactgctaacttcccattgtcaaacagtgtgaaggaatccagtagctgtctcagcagctctcacccacgcagtaggtccgccgcagctcagtcttcatccagagcagcatccgagatctccgagatcgagtacatcgatattaccgaccaaaatgaactttctctggatgacacaactgatcagcacactttggacaatcttgagaaggaactgcaggtgctacggtcactggccgacacttctgagaagctctatagcctcactagtgaggaattccctgactttagctcacagtcactgaatataagccagattagtaccgactttctgaaaacctcccacgtgagaggcccatgcggcgtcgaggaactgtcatgcagtggccgagacaccaaaatacaatccctgctcagcctgtcagaatcctctacggatgaagaggaagaggacttcttgaacaaacagcacgtgattacacttccctggagtaagtcaacttag

SEQ ID NO: 61430 - DNA, 2520 bp, Artificial Sequence
  Description of Artificial Sequence: Synthetic coding sequence
atgaataggaaggactttgtggtgctgccatgggggaaacccggaaactcagtgaagttgaagtaccggaatgcccaggaattgcgtatggagaaagtacagctggaattcgaaaaccaggagatggaaaaaaagcttcaggaatttcgatctaccagaaataaagaaaaagaggatcgtgaaagctctgaatactactggaaaagtggcaaggtcggcaagcttgtcaatcaatcttacatgatgtctcagaacaaaggaaatgtagtgaaattctctgccggtaaggttaagctcaaattattgaaagagcagatccaagaacccgtcaaaccaaccgtgaattataagatggccaatagcagcgaatgcgagaagcccaaaattaacgggaaggtgtgcggacagtgtgaaaacaaggcagcactcttagtgtgcctggagtgtggcgaggactattgctccggctgcttcgccaaggtgcatcaaaaaggcgcactgaaactgcacaggaccacactccttcaggctaagtctcagatcctgtttaacgtgctcgatgttgcacatcagtttatcaaggatgtaaaccccgacgagccaaaggaagaaaacaatagcaccaaggagacaagtaagatccagcacaaaccaaagtcggttctgttacagcgaagctcctcagaggtcgagatcactacaatgaaacgtgctcagagaaccaagcccaggaaatccctgctctgcgaggggagcttcgacgaggaagcctccgcacagtctttccaggaagtgctgtctcagtggcggactggaaatcatgatgacaacaagaagcaaaacctccatgccgctgtaaaagatagtttagaagagtgcgaagtccagactaaccttaaaatttggagagagcccttgaatatagagcttaaagaggatattctctcgtacatggagaaactctggttaaagaagcatcggcgtacaccgcaggagcaactgttcaagatgctgccagatacctttccccatcctcatgaaaccacaggcgatgcacagtgttcccagaacgagaatgatgaagacagtgatggggaagagaccaaggtgcagcatactgcactcttgctccccgtggagacacttaatatcgagcgccctgaacccagtcttaagatcgtggaattggatgatacatatgaagaggagtttgaggaggcagagaacatagtgccctataaagtcaagctggccgacgctgactcacagaggtcctgtgcgtttcatgattgtcaaaagaactctttcccttatgagaacggaattcaccagcatcatgttttcgacaagggcaagcgggatttccttaacctgtgcctccgtaattcatcaacgtactacaaagacaacagcaaagctgagacctccaacaccgactttgataatatagtggacccggacgtgtactcctcagatatcgaaaagatcgaagagtccacttccttcgagcggaatctcaaggaaaagaatattggcctagagtcaaaccagaagagcgacgacagttgtgtttccttagagagcaaagatactcttttgggcagggacttggaaaaagccccaatcgaagaaaagctaagtcaggacatcaaggagagtttagagctgtctaatttgtataaacgccctagttttgaagagtccaaaactaccaagtcgagcctgctgctgcaggagatcgcttgccggtccaaacctatcactaagcagtatcaaggcctggagcggttctttatttttgatactaacgagcgactaaatctcttaccgagccaccgattagagtgcaacaacagctctactcggattacactggccgaggatagagaatggatcccggaccactcgctcagtgaatatgccgataacgccatcgtactaggcgtactgcagggcgctcagagccccagttccagtaggaagcagcagaaaatgggacagaagagccagcggccatccactgccaatttccctctctccaactccgtcaaggaatccagctcatgcttatcttcatcccaccctaggtctagaagcgctgcagcacagtcctcttcacgcgctgcatctgagatttccgaaatcgaatacatcgacatcactgatcagaatgaactgtcgctggatgacacaaccgaccagcacaccctagataatctagagaaagaactgcaggttctgagatcgctcgctgacacttccgaaaagctctactctctcaccagcgaagagtttccagatttctccagccagagcctcaacatctctcagatatccacggacttcctcaaaacatcgcacgtcagagggccatgtggggtagaagaactcagctgttccggtcgagacaccaagatccagtcactgctatctcttagcgagtcctccactgacgaggaggaggaggatttcttaaataaacaacatgtgattactctgccgtggtccaagagtacctag

SEQ ID NO: 61431 - DNA, 492 bp, Artificial Sequence
  Description of Artificial Sequence: Synthetic coding sequence
atgaataggaaggatttcgttgttcttccttgggggaagccgggaaattccgtcaagctgaagtacagaaacgcccaagaactgcggatggaaaaagtacagctggagttcgaaaaccaggagatggagaagaaactgcaggagttccgctctacccgcaataaagagaaggaagaccgggagagctcagagtattactggaagagcggcaaagtgggtaaactggtgaaccaaagctacatgatgtcccagaataagggtaatgtagtaaaattctccgcgggtaaagtcaaactgaagctgttgaaggaacaaattcaggaacctgtgaagccgacagtgaattataagatggccaattccagcgaatgtgagaaaccgaagatcaacggaaaagtttgtggccagtgtgagaataaagcggctctcctcgtgtgcctggaatgcggcgaggattactgctccggctgctttgccaaagtgcaccagtag

SEQ ID NO: 61432 - DNA, 657 bp, Artificial Sequence
  Description of Artificial Sequence: Synthetic coding sequence
atgatgcgcagagaggacgaggaggaggaggggacgatgatgaaggccaaaggcgacctcgagatgaaggaagaggaggagatcagcgaaaccggcgaactggtgggacccttcgtgtccgcgatgccgaccccaatgccccacaataaggggacccggttttccgaagcctgggaatacttccatctggcccctgcaagagcaggtcaccaccccaaccaatacgccacatgtcgcctgtgcggcaggcaggtgtcccggggtccgggtgttaacgtgggtactaccgcactgtggaagcatctgaagtcgatgcatcgcgaggagctggagaagtccgggcacggacaggctggtcagagacaggatcccaggccccacggcccacagctgccaactggcattgaaggcaattggggccgactcttagaacaggttggcaccatggctctctgggcctcccagcgggagaaagaagtgcttcgaagggaaagggccgtcgagtggagagaaagggccgtggaaaagagagaacgcgcactcgaggaggtggagcgcgcaatcctggaaatgaagtggaaggttcgcgctgaaaaggaggcttgtcagagagaaaaggagttgcccgctgccgtgcatccctttcacttcgtttag

SEQ ID NO: 61433 - DNA, 705 bp, Artificial Sequence
  Description of Artificial Sequence: Synthetic coding sequence
atgcggtctggtgaaccagcctgcactatggaccaagcccgtgggcttgatgacgcagccgcacggggaggccagtgccccggactgggccctgcaccgacaccgactcccccaggtcggctcggggctccttactctgaggcttggggctattttcacctggctcccggaaggcccggacacccatcgggccattgggccacttgtaggctgtgcggtgagcaggttggcaggggacctgggttccacgctggcacatccgctctgtggcggcacttaagaagtgcccacaggcgggagttggaatcatccggggcagggagttcccctcccgcagccccatgtccccctccacccggtccagcggctgccccagagggagattgggcacgtctcctggagcagatgggcgctctcgcggtgcgcggatctaggagagagagggagctggagaggagggagctggcagtggaacagggagaacgggcactggaaagacgcagaagggccctacaagaggaagagcgcgctgcagcacaagctagacgcgagctccaggctgagagggaggctctccaggcccgtctgagagatgtttcccggcgagagggggcactgggttgggcaccagccgcacctcctcccctgaaggacgatcccgaaggcgaccgagacgggtgtgtcatcaccaaagtgcttctgtag

SEQ ID NO: 61434 - DNA, 453 bp, Artificial Sequence
  Description of Artificial Sequence: Synthetic coding sequence
atgagatccggtgagcccgcatgtacaatggatcaggccagagggctggatgacgcagctgcccgaggcggacagtgtcccggattgggtccagcacccacgcccaccccacctggccgtctcggcgctccatactcagaggcctgggggtatttccatctggctccagggagacccggacacccctcgggacattgggccacttgtcgcctgtgcggggagcaggtaggcagaggccctggctttcatgcaggaacaagcgcactgtggcgtcacctgaggagtgcgcataggcgggaactagagtcttccggggcagggtcctcacccccagctgctccttgcccaccacctcccggacccgctgctgcgccagagggagactgggcacggcttcttgagcagatgggggcacttgctgtgcgaggatccaggcgcgagcgcgaattgtag

SEQ ID NO: 61435 - DNA, 5969 bp, Artificial Sequence
  Description of Artificial Sequence: Synthetic coding sequence
atggcaaccgccgatactccggcacctgcctcaagtggtctctcaccaaaggaagagggtgagctggaagacggtgagatcagcgatgacgataataacagccagattaggtccaggtcaagcagcagcagcagcggtggcggactgctgccttacccaagaagacgccctccacactcagcccgaggaggaggaagcggtggaggtggagggtcctcctcctcctcaagctcatctcagcagcagctgcgcaacttctctcgctccagacatgcgtcagaacgcggtcacctaagaggtcctagctcttatcggcctaaggagccctttcggagtcaccccccatctgtgcgtatgcctagctcatccttaagcgaatcatccccgcgtccatctttctgggagcgatcacacctggcacttgacagattcagattccgaggaaggccctatagaggcggttcacgttggagtagaggacgcggagttggagaaaggggcggaaaacctgggtgccggccaccattaggaggtggtgccggtagtggtttcagcagctcccagtcttggagggaacctagtccaccacggaagtccagcaagagttttggccgttctccgtcgagaaagcaaaattacagtagtaagaatgaaaattgcgtggaagagacttttgaggatctgctcttgaagtataagcagatccagttggagcttgagtgtatcaacaaggacgagaaactggcccttagttcgaaagaggaaaatgtacaagaagatccaaaaactctgaattttgaggatcagacctcgacagataacgtgtcaatcacaaaagactcctctaaagaagtggcgcctgaagagaaaacacaagtgaagaccttccaggcctttgaactgaaaccactccggcagaaattgaccctgcccggtgacaaaaatagactgaagaaggttaaagacggtgcaaagccgctgtctctgaagagtgacacgacggactcaagtcagggtctgcaggacaaagagcagaatctcacaaggcggatcagcacaagcgacattctgagcgaaaagaagctgggggaagacgaagaggagttgagcgagttgcagctgcggctgctggctttgcagtcagcaagcaagaaatggcagcagaaggaacagcaagttatgaaggaatcaaaggaaaagttaaccaagacaaagactgtgcaacagaaagtaaagacatccaccaagacccactcagccaagaaggtctccacaactgcaaagcaggctctccgtaagcagcagacaaaagcttggaagaagctacagcagcaaaaggagcaagagcgtcagaaggaagaagatcagcggaagcaagccgaagaagaggagaggcgcaagagggaggaggaaatcagaaagattagagacctgtctaatcaagaagagcagtacaaccggttcatgaagctcgtgggcggaaaacgaaggagcagaagcaagtcaagcgaccccgacctcaggcgttccctggataaacagcccacggactccgggggaggtatctaccagtatgacaattacgaagaggtagccatggataccgactcagagacgagctcaccggctccatcccccgtgcagcccccttttttctcggagtgtagccttggttacttcagtccagccccatcgctgagcctgcccccaccccctcaggtaagctccctgccccctttgagtcagccatacgtggaaggcttgtgtgtcagcctcgaacctctgcccccactgccgcctcttccacctctaccccctgaggacccagaacaaccaccgaagccaccattcgcggacgaagaggaggaggaggagatgttacttagggaagagctcctcaagtccctggctaacaagagggccttcaagcctgaagagacatctagcaactccgatccgccatctcccccagtgctgaataacagtcacccagtgccccgtagcaacctgtccattgtctccattaacactgtgtcccagcctcgcattcagaatccaaaatttcatagaggtccgcgtctgcctagaaccgtcatttccctgcccaagcacaaatctgtcgtcgtgacactcaatgactcagacgactcagagagtgacggagaggccagcaagtctacgaatagcgtttttggaggactggagagtatgatcaaggaagccaggaggaccgccgagcaggcttccaaaccaaaagtacccccaaaaagcgagaaggaaaatgaccctttgaggaccccagaggctctgcccgaagagaaaaagatagaatatcgactactgaaggaagagattgctaaccgggaaaagcagcgattgattaaatctgaccagcttaagacatcctcaagcagcccggctaattcagatgtggaaattgatgggattggacggatcgcaatggtgaccaagcaggtgacagacgcggaatctaagctaaagaaacatcggatcttgctgatgaaggatgagtccgttctgaagaatcttgtgcaacaagaagctaaaaaaaaggaatccgtacgaaacgccgaagccaagattacaaagctgactgagcagcttcaggcgaccgagaagattttgaacgtgaatcgaatgttcctcaagaagctgcaggagcagatccaccgggtgcagcagcgggtgacaataaagaaggctctgacactgaaatatggggaggagctagcacgtgctaaggccgtggcgtccaaggaaatcgggaagaggaagctggagcaggatcggttcggacccaacaaaatgatgaggctcgactcaagtccagtaagcagcccacgcaagcactccgcagaattgatcgccatggaaaagcgcagactacagaagttagaatacgagtacgccctgaagatccagaagctgaaagaggcgagagcattgaaagccaaggagcaacagaacattagtcctgtggtagaggaagaaccagaattcagcctgccacaaccaagcttgcatgatttgacccaggataaactaacgcttgacacagaggagaacgacgtggacgacgagatcctctccgggtcaagtcgggaacgcagaagatcgtttcttgagtccaattacttcacgaagcctaaccttaaacataccgacacggccaataaagaatgtattaataaactcaacaaaaatactgtagaaaaacctgagttgttccttggcttgaagattggcgagcttcagaagctgtactccaaagcggacagtctgaagcagcttatcttgaaaacaaccactggcatcacagaaaaggtgctgcatggtcaggagatctctgtagacgtagacttcgtgaccgctcagagtaaaacaatggaagtgaaaccctgcccctttaggccttatcacagtccactgctggtctttaaaagttaccgtttcagcccatactataggactaaagagaaactgcctctgagttctgtatcatatagcaacatgatcgagccagaccaatgtttttgcaggttcgatttgaccggaacctgtaatgacgacgattgccagtggcagcatattcaggattacacgctctctagaaagcagctgtttcaggacatactcagctacaacctgagtcttattggctgtgccgagacgtctaccaacgaagagattactgcttctgctgagaagtacgttgaaaaactgtttggggtgaacaaagacaggatgtctatggatcaaatggcagtcttgttagtctcaaacatcaacgagtccaaagggcatactcctccattcacgacctataaggacaaacgaaagtggaagccgaagttctggagaaagccaattagcgacaacagctttagttcggatgaagagcaaagtaccgggccaatcaaatacgctttccagccagagaaccagatcaacgttcctgcgctcgacacagtcgtgactccggacgatgtgcggtactttactaacgagaccgatgatatcgccaacctcgaggcttcagtcctcgagaatccctcacatgtgcaattgtggttgaagctagcttacaagtatctcaaccagaacgaaggggaatgctccgaatctctggatagtgcccttaatgtactcgcaagagccctggagaataacaaggataaccccgagatctggtgtcactatctacgactgttcagtaaacggggtactaaggatgaggtacaggaaatgtgcgagactgccgtggaatacgcccctgattatcagtccttttggactttcttgcacctggagtctactttcgaggagaaggactacgtctgcgaacggatgttggaattcctcatgggggctgccaaacaggaaacatccaatatcctcagcttccagctgctggaggccttgttgtttcgcgtgcagctgcatatctttacaggacggtgccagtccgccttagctatcctccaaaacgctttgaagtctgccaatgacggaatcgtggctgaatacctgaaaacttccgatcggtgcctggcatggctggcttacatccatcttatcgagttcaatatcctgccatccaaattttacgatccttctaatgacaacccttctcgtatagtgaatacagaatccttcgtcatgccttggcaagcagtccaagacgtgaagaccaaccctgatatgctcctcgcagtttttgaagacgccgtaaaggcttgtacagatgaatcgctggcagtggaagagagaattgaggcctgcttaccactgtatactaatatgattgccctgcatcaattacttgaacgctacgaggcggcaatggaattatgcaagagcctcttggaaagttgtccaatcaattgtcagctccttgaggccctcgtggccctgtatctccagacaaaccagcacgataaggcccgagccgtgtggttaactgccttcgagaagaacccgcagaatgccgaagtgttttatcacatgtgcaagtttttcatcctacagaataggggtgacaacctgttgccgttcttgcgtaaattcatcgccagcttctttaagcctgggttcgaaaagtataacaacctcgatctgtttcgctacctcctgaacatccctgggcctattgatatcccgagcaggctatgcaaaggcaactttgacgatgatatgtttaaccatcaggtgccctacctgtggttaatctattgtctgtgtcacccattgcaaagctcgataaaggagacagtggaggcctacgaggcggctctcggagttgccatgagatgcgatatcgtacagaagatatggatggactatctggtgttcgcgaataaccgagccgcaggcagccggaacaaggtccaagaattcaaattcttcacagacctcgtcaatagatgcctcgtcaccgtccccgctagataccccatccccttttcatccgctgactattggtcaaattatgaatttcacaacagggtgatattcttctatctttcttgcgtaccgaaaacacagcactcgaaaaccctggagcggttctgtagcgtaatgcccgctaatagtggactggctctgagacttttgcaacatgagtgggaagaatctaatgtccagatcctcaaactgcaggcaaagatgtttacctacaacatacccacctgcctggccacatggaaaatcgccatagctgcggaaattgtgctaaaggggcagcgtgaagtgcatagactgtatcaacgggcattacagaagctgcccctttgcgccagtctgtggaaagaccaactgctatttgaggctagtgagggcggaaagaccgataacctgcgcaaacttgtctccaaatgtcaggaaataggagtttctcttaatgaactccttaacttgaactctaacaagaccgagagtaaaaatcatta

SEQ ID NO: 61436 - DNA, 1041 bp, Artificial Sequence
  Description of Artificial Sequence: Synthetic coding sequence
atggcaacagccgatacgcctgcacccgcatcctcggggctttcccctaaggaggagggagagcttgaggatggagaaatcagcgatgacgataataattcacaaatcagatccagatcgagtagttcatcatctggcggagggctcctcccctaccctagacggaggccccctcatagcgctcggggtggcggatccggtggcggaggagggagcagcagctcctctagcagcagccagcagcaactccggaacttcagccgttctcgacacgcctcagaacgaggacacctgagaggtccctctagttatagacctaaggaacccttcaggtcacatccaccttcggtcagaatgccatcttcctcactgtccgaatcatcccctaggccatcattctgggaaagaagccaccttgcccttgatagattcaggtttcgcggtcgaccctatcgcggtgggtctcggtggagccgaggacggggagtcggcgagcgtggagggaaacccggatgccggccaccccttgggggtggtgctgggtccggcttcagcagtagccaatcttggcgggagccaagcccgcctcggaagtcatctaaaagttttggcagatcaccctctagaaaacaaaattactcttccaaaaacgagaactgcgtggaggagacatttgaggacctgctactcaagtacaagcagatccaactggagttagaatgtatcaataaagacgaaaagcttgctctctcttctaaggaggaaaatgtgcaggaggatcctaaaaccttgaactttgaagaccagacctcgactgataatgtctctatcacaaaggactccagcaaggaagtggccccagaagagaagactcaggtgaaaacatttcaggcctttgaactgaaaccgttgcggcagaagctgaccttaccaggtgacaagaaccgtctcaaaaaagttaaagatggtgcaaaacccttatctttgaagagcgatacgacagattctagccaagggaacggcatcaaatacttttcctag

SEQ ID NO: 61437 - DNA, 606 bp, Artificial Sequence
  Description of Artificial Sequence: Synthetic coding sequence
atggagaagataaaggccagactgaaagcagagtttgaagcactggagtcagaagagcgacatctgaaggaatacaaacaggagatggatcttctactccaagaaaagatggcccatgtggaagagctccgtctgatccatgctgatattaatgtgatggagaacactataaagcaatctgaaaacgacctgaacaagttactggaatctacccgcaggctccacgacgagtataaacccttgaaggagcacgtggacgccctgcggatgaccctaggcctgcagcgtctgcccgacctctgcgaagaggaggaaaaactgagccttgattactttgaaaagcagaaggccgagtggcaaactgagcctcaggagcctcccatacccgaaagtctggccgcagccgctgctgccgcacagcaattgcaggtggctaggaagcaggacaccagacagaccgctaccttcagacaacaaccaccccctatgaaagcctgcttaagctgccatcagcagatccacaggaacgctcccatttgtcccctgtgtaaggctaaatctagatctaggaaccccaaaaagcccaagaggaaacaggatgagtag

SEQ ID NO: 61438 - DNA, 675 bp, Artificial Sequence
  Description of Artificial Sequence: Synthetic coding sequence
atggctgacgaacaagaaattatgtgtaagttggaatccatcaaggagattcggaacaaaaccctccagatggaaaaaattaaagcccgactcaaggctgagttcgaggccctggagagtgaggaacgccatctgaaagaatacaaacaagaaatggatctcctgctgcaggagaaaatggcccacgttgaagagctcagattaattcatgccgacatcaacgtgatggaaaacaccataaaacagagcgagaatgatctgaacaagctgctggagtctacgaggaggcttcatgacgagtataaacctcttaaagagcacgtcgatgcgctacggatgaccctcggtctgcagcggcttccggacctttgtgaggaggaggaaaaactaagcttggactacttcgaaaaacagaaggcggagtggcaaacagagcctcaggaacccccaattcccgagtcactggccgcagcagctgcagccgctcagcagctgcaggtggctaggaaacaagacacccgccagactgcgaccttccgacagcagccgccaccaatgaaagcctgcctctcttgtcaccagcagattcaccgaaatgcacccatctgccccttgtgcaaagcaaagagccgcagcagaaacccaaaaaagcccaagcggaaacaagatgaatag

SEQ ID NO: 61439 - DNA, 531 bp, Artificial Sequence
  Description of Artificial Sequence: Synthetic coding sequence
atggccgatgagcaggagatcatgtgcaaactggaaagcatcaaggagatcagaaataagaccctgcagatggaaaaaataaaggccaggcttaaggctgagttcgaagccttggaaagcgaagagcgacatctgaaagagtacaagcaggaaatggacctactgctgcaggaaaaaatggcacacgttgaggagcttagacttattcacgccgacatcaatgtgatggagaacacaattaagcagtctgagaacgacctcaataagctgcttgaaagcactaggaggctgcatgacgaatataagcccctcaaggagcacgtggatgccctgagaatgaccctgggattgcagcgcttaccagacctgtgcgaggaagaggagaaattgtctttggaacctgcatgtcatgtcactagcaagtttacaggcatgcatctttatgcgcttttcgctagaccacgtgtgggcccaggcacacccaaaagccgaaatgggagcagaatgaacaaagagcgggaatccacatag

SEQ ID NO: 61440 - DNA, 660 bp, Artificial Sequence
  Description of Artificial Sequence: Synthetic coding sequence
atgattcacttccacctgattttcctgtatgtcgcaagaaacaagacactgcagatggagaagatcaaggcgcgattaaaagcagaattcgaggcactggaaagtgaggaaaggcacttaaaggaatacaagcaggaaatggatctgctgttacaggagaagatggcccacgtggaggagctgcggctcattcacgctgacataaatgtaatggagaataccatcaagcagtctgaaaatgatctgaataaattgctggaaagtacaaggagactacatgatgagtacaaacctcttaaggagcatgtggacgcgcttcgcatgactctaggtctacagaggttacccgacctgtgtgaagaggaggaaaagctctccctggactattttgaaaaacaaaaggcggagtggcagaccgaacctcaggaaccccctattccagagtccctggctgccgcagccgcagcagctcagcagttacaggtggcacggaaacaggacactcggcagaccgctacgtttcgacagcagcccccacccatgaaagcctgcctatcatgccatcagcagattcaccggaatgctcctatctgtccactgtgtaaggccaagtcacgttcccgcaaccccaaaaagcccaaaaggaaacaggatgaatag

SEQ ID NO: 61441 - DNA, 513 bp, Artificial Sequence
  Description of Artificial Sequence: Synthetic coding sequence
atggctaccccgatgcacaggttgatcgctcggcgtcaggctgaagcgaacaaacagcacgtcagatgccagaagtgcctcgaattcggacattggacatacgagtgtactggcaagagaaagtacctgcacagaccctccaggactgctgaactcaagaaagcacttaaggagaaggaaaacagactcctgctgcagcaaagtatcggggaaacgaacgtggagcgcaaggctaagaaaaaacgctctaaaagtgtcacaagctcctcttccagcagttccgattcttccgcatctgacagtagcagcgaaagtgaagagacttctacttcttccagcagtgaggacagcgataccgatgagagttcttcaagctcttcatcttctgcctcttccaccacttccagtagctcttctgattccgattctgactcgtcctcatctagttcaagctccacctcaacagactctagctctgatgacgaaccacccaagaaaaagaagaagaagtag

SEQ ID NO: 61442 - DNA, 501 bp, Artificial Sequence
  Description of Artificial Sequence: Synthetic coding sequence
atgtcttccaaggacttctttgcatgtggtcactccggccactgggccagaggctgccccagagggggagctggaggcagacgcggaggcggacatgggagaggctctcagtgtgggtcaacaacgctctcatatacttgctactgctgtggtgaatccggcagaaacgctaaaaactgtgtattactcgggaacatctgctataactgtggcagatcaggtcacatcgccaaagattgcaaagatcctaagcgcgagcgcagacaacactgttatacctgcgggaggttagggcacctggctcgggattgcgatcggcagaaagagcaaaaatgctactcctgtgggaagttgggtcatatccagaaagattgcgctcaggtgaagtgttatcgatgtggagaaattgggcatgttgccattaactgttccaaagcgaggcctggacagctcctcccccttagacagatacccacatcctctcagggcatgtcgcaatag

SEQ ID NO: 61443 - DNA, 2850 bp, Artificial Sequence
  Description of Artificial Sequence: Synthetic coding sequence
atggcctcaaatcaccccgcttttagcttccaccagaagcaggttcttcggcaagaattaacccagatccaatcctcactgaatggtgggggtgggcatggcggaaagggggctcctgggccagggggagccttgccaacctgccctgcatgtcataaaatcacccctcgcaccgaggccccagtgagcagcgtgagtaattctctcgaaaatgccctgcacacatctgcccactcaaccgaggagtcattgccaaagagaccactgggtaagcattccaaggtgtctgtcgaaaaaatcgacctcaaggggctgtcacatacaaagaatgatcggaacgtggagtgcagtttcgaggtcctctggtccgattcttccatcacttctgtgaccaagtcctctagcgaggttactgagtttatatcaaagctttgccagctgtaccctgaggaaaacctggaaaagttgattccttgcttggctggccctgacgctttctacgtagagcgaaatcatgtcgacctcgatagcgggctaaggtatctagcgagcttaccatctcacgtgttgaagaatgatcatgtgcgcaggttcctctccacaagtagccctcctcagcagctccagtcacccagtcctggtaatccttccctgagtaaggtaggcaccgtaatgggggtgtccggccgacctgtctgtggtgtggccggtatcccatcctctcagagcggagcccagcatcatggccagcacccagccggatccgccgctcctctcccgcactgcagccacgccggatctgccggatccgcgctcgcataccggacccagatggataccagccctgccatccttatgccttcctcattacaaacacctcagactcaggagcagaacggcatcttggactggttaaggaagttgcgcctgcataaatattatcccgtttttaagcagctctcaatggaaaagtttctctctctgacggaggaggatctgaataagttcgagtccctcactatgggtgctaaaaagaaactgaagacccagctggaactagagaaagagaaaagcgagcgccgatgcctgaacccttctgccccacctttggtgaccagctccggggtggccagagtcccaccaaccagccacgtgggccctgtgcagtccggaagaggctcacatgcggctgagcttagggtagaagtggagcagccccaccatcaacttcccagggaaggctcatcctcagagtattccagcagctccagttcccctatgggtgttcaggcacgggaagaatctagtgattcggccgaggaaaacgacagacgcgtggagatccacctggaatccagcgacaaggaaaaacctgtcatgctcctgaaccatttcacatcttcttcggccaggccaacggcgcaggtgctgccagtccagaatgaagcctcctctaacccttctggccatcatccactccccccacagatgctgagcgcggcatcacacattacccctattagaatgttaaattctgtgcacaaacccgaacggggttcagccgatatgaaactcctgagctcttctgtgcacagcttactctccctagaggaaaggaacaagggcagtggcccaaggtcatccatgaaggttgataagtccttcggttcggccatgatggatgttctgccagcctcagcaccccatcaaccagtgcaggttttaagcgggctgtccgaatccagctccatgtcacctacggtcagctttggccctcgcaccaaagtcgtccatgcaagcaccttggatcgcgttctcaagactgctcagcaaccagcgctcgtagttgaaactagcacggccgcaactggcacaccgtccacagttcttcatgccgctaggcctcctataaagctcctactgtcctcctcagtgcctgctgattccgccatttcaggtcagaccagctgccccaataacgtgcagatctccgtgcctccagctattattaatcccagaacagctctttacacagctaatactaaggtcgcgttcagcgccatgtccagcatgccagtgggccctctacaggggggtttttgcgctaattccaacaccgctagccctagtagtcatccctctacttcgtttgccaatatggcgaccctgccaagctgtcctgctccttcctcaagtccggcactgtccagcgtccccgagagcagcttttactcctcctctgggggtggcggatctaccggcaatatcccagccagcaatcctaatcaccaccaccatcaccatcatcagcaaccgccagcccctccccagcccgcacccccaccccctgggtgtatcgtttgcacaagttgtggttgttcaggctcctgcgggtcctctggtctaaccgtctcttatgctaattatttccaacacccattcagcggaccctcggtgttcacgtttcctttccttcctttctccccaatgtgttcctctggttatgtgagcgcccagcagtacgggggaggatccactttcccagtggtccacgctccctacagctcatccggcacgcctgaccctgtccttagcgggcaaagcacatttgcggtgccacctatgcagaattttatggcgggtaccgccggtgtctaccagacacaggggctggtaggaagctccaacggctcatcccacaaaaagtctggaaacctgtcttgttataattgcggcgctaccggacacagagctcaagattgcaagcaaccctccatggacttcaatcgccctggaacgttccgccttaaatacgcaccacccgctgagtccctggatagcaccgactag

SEQ ID NO: 61444 - DNA, 933 bp, Artificial Sequence
  Description of Artificial Sequence: Synthetic coding sequence
atggagaagtgcacaaagtcctcttccactatgcaagtcgagccttcttttctccaagcagagaatctgatcctgcgacttcagatgcaacaccccactacagagaataccgctaaacggggtcaggtaatgccggctctggcaacaactgtgatgccagtgccttacagccttgaacatcttacgcagttccacggggatcctgcgaattgtagcgagttcctgacgcaggtgaccacctatctgacagcactccagattagcaaccccgctaacgacgcccagattaagctattttttgactacttaagtcagcagctggaatcatgtggcatcatctctgggcctgataagagcactttactgaagcagtatgagaacttgatcctggagtttcagcagagctttgggaagcccacaaagcaggagatcaaccccctaatgaatgcaaaattcgataagggcgacaattcgagccagcaggacccagcaacattccatctgctggcacaaaacctcatctgtaacgaaaccaatcagagtggtcagtttgagaaggctctcgccgacccgaaccaggatgaggagtccgtaacagatatgatggacaacctccctgacctcataacacaatgtattcaactggacaaaaaacattccgaccggccagagttgctacagtccgagacacagttgccactcctggccagtctgatccagcatcaggctctgttctctcctactgatccccctcccaaaaagggtccgatccagctgcgggagggccagttacctctgacgcccgcaaagcgagcaagacagcaggagacacagctgtgcctctattgtagccaaagcgggcacttcactcgggactgtttagctaagcgttcaagagctccagctacaaccaataacactgctcatcagtag

SEQ ID NO: 61445 - DNA, 687 bp, Artificial Sequence
  Description of Artificial Sequence: Synthetic coding sequence
atgcaggaagtatgtagcggggaggatacacacggcggacattttcctagcagaccaggacacaccggagccgagcagcaatgtgttcagggtcgcctgaccctgtggttaccccagcaacaccggagatggccccagcttcctcacagagctctgctacgacccgatccacatctgcgcggatcccaggcccagcaggccgctcccacacaactccccgttccacccgtcttgcaacagagaacactccatcagggtctccctcctgggacaccccagaggagaggccctgatagtatccccggacagaaggccctactcaggagggtgcaagttagccaggtgcaggaaaaaatggacgagcgcgaactactgggacagcacggcgctggagttcatcaagtgcctcaccagcgggtctcgacacaggccgagacgcctggagaagcgagacggcctggaagagtgcggccagaacaaggggcaccggcagcccctctgagagaggtgcagggcccagggttacttctccccagtcgcgctgtaactggatgtccacctgccccaagagctaccccacggcagccagaggaaacattgctcccctgcgcaacccctcggggatgcgtcagcccatgcgcctggggggcactggctggcctccgaggatgggccggaggttcctag

SEQ ID NO: 61446 - DNA, 726 bp, Artificial Sequence
  Description of Artificial Sequence: Synthetic coding sequence
atgtctttgcttagcgctatagatacatccgcagctagtgtttatcagccagcacaacttctgaattgggtgtacctgtctctgcaggatacccatcaggcgtcagcatttgacgcatttcggccagagccaacagcaggcgctgcacccccagaactcgcctttggcaaggggagaccggaacagttgggatctcctcttcactcatcatacctcaacagcttctttcagctgcaaaggggagaggcgttatcaaacagcgtttacaagggcgcaagcccgtacggcagcctcaataacatagccgacggactgagcagccttacagagcacttctctgacctgaccctgacgagcgaagcaaggaagccatccaagcgacctccgcctaattatttgtgtcatctttgcttcaacaaaggtcattatatcaaagactgcccacaggcccgacctaaaggcgaaggccttaccccctatcaagggaaaaaacgttgcttcggggagtataaatgccccaagtgtaagagaaagtggatgtccggcaactcttgggccaatatgggccaagagtgcatcaaatgtcatatcaacgtgtacccccataagcaacggcctctggaaaagccagatggactcgatgtctccgaccagtccaaagagcatccccagcacctttgcgagaagtgcaaagtgcttggatactactgcaggcgggtccaatag

SEQ ID NO: 61447 - DNA, 1215 bp, Artificial Sequence
  Description of Artificial Sequence: Synthetic coding sequence
atggcaactggaggcggtgcagaggaagagcggaagcggggtcgaccacagcttcttccgccagctaggccggcagcccgaggcgaagaggcggacgggggaagggaaaaaatggggtgggcacaagtggtgaagaatctggcggagaaaaagggggagttcagagaacccagaccacccaggcgcgaggaagaaagtgggggagggggtggcagtgctggtttgggtggtcccgctgggcttgcagcaccagaccttggcgatttccccccagccggacgcggagatcctaaggggcgacgacgtgaccccgcaggcgaggccgtggacccaagaaagaagaaaggggcagccgaagccggtcgcaggaagaaggcagaagccgctgcagctgctatggcaactccagcaagacccggtgaagctgaggacgccgctgagcgcccactacaagacgaacctgcggctgctgccgctggaccgggtaagggcaggtttctcgtccggatctgctttcagggggacgaaggcgcttgccctacgagagattttgttgtaggcgctttgatactgcggtccattggcatggatccgtcagacatctatgcagtcatccaaatccctggtagccgagagtttgacgtttccttccgatcggccgagaagctcgccttgtttctgagagtctacgaggagaagagagaacaagaagattgttgggaaaatttcgttgtgctcggcagatccaaatcaagcctaaagacactctttattctgtttaggaacgaaacagtggatgttgaagacatagtgacttggctcaagcgtcattgtgatgtactggctgtccccgttaaagtgactgatcgtttcgggatttggaccggagaatataagtgtgagatcgaactgaggcagggggaagggggtgtccggcacctgcccggtgccttttttctgggcgctgaacgagggtacagttggtataaaggtcagcccaaaacctgcttcaaatgcggcagccgcactcacatgagtgggagttgtactcaggacagatgttttcgatgtggagaggagggccacctcagcccctattgcagaaaagggatagtgtgtaacttgtgtgggaaacggggtcacgcttttgcccagtgtcccaaagcagttcacaacagtgtggcggctcagcttaccggagtcgccggacactag

SEQ ID NO: 61448 - DNA, 1428 bp, Artificial Sequence
  Description of Artificial Sequence: Synthetic coding sequence
atggtggaggacctagctgcttcctatattgtgcttaaactggagaatgaaatacggcaggcccaggtccaatggctgatggaggaaaacgccgcactgcaggcccagatcccggaacttcagaaatcccaggcagccaaagaatatgatcttctgcgaaagtcctccgaggccaaagagccgcagaagttgcccgagcacatgaatccacccgcagcctgggaagcacagaaaaccccagagttcaaagaaccgcagaagccaccagaaccacaggatctgctgccttgggaacctcccgctgcctgggaactgcaggaggctcccgcagctcccgaaagtctcgccccacctgcgactcgggagtcccagaagcccccaatggctcacgagatccccacagtccttgaagggcaaggcccagccaatacccaggatgcaaccatagcccaggagcccaaaaacagcgaaccacaggaccctccaaacatcgaaaaacctcaagaagcacccgaatatcaggagacggcagctcaactagaatttttagagctacctccccctcaagaacctttagaaccctctaatgctcaagagttccttgaactctccgccgctcaggaatccctggagggattgattgtcgtggagacgtccgccgctagcgaatttcctcaggccccaattggtctcgaggccactgattttcctctgcagtacaccctaactttcagcggtgactcccagaaactcccagaatttttagtccagctctacagctatatgagggtacgcggacacctgtaccctacagaggcggctttggttagctttgttggaaattgcttctccggtagagcaggctggtggttccaactccttttagacattcaaagccccttgctggagcaatgtgagtctttcatccctgttctgcaggatacttttgacaatcccgaaaacatgaaggatgcaaaccagtgtatacaccagctttgccagggggagggtcatgtcgccacgcatttccacctgatcgcacaggagctcaactgggatgagtcaaccttgtggatccaattccaggaaggcttggcctcgagcatccaggatgagctctcccacacaagccctgctactaacctgtcggatctgattacccagtgcatttctttggaagaaaagccagaccctaacccactgggtaagtccagctctgcggagggggacggtcctgaatccccacccgctgagaatcaaccaatgcaagccgctatcaactgcccacatattagtgaggccgagtgggttcgttggcacaaaggacgactttgtctgtactgcggttaccccggtcactttgctcgggattgtcccgtgaagccacaccaggctctgcaggcaggcaacatacaggcgtgccagtag

SEQ ID NO: 61449 - DNA, 2355 bp, Artificial Sequence
  Description of Artificial Sequence: Synthetic coding sequence
atgggcaacgagcatataagcgttcacccggagaattcagattgtatccaagccgatgtcaacagtgacgactacaagggggacaaagtttaccatccagagactggcaggaaaaacgaaaaagaaaaggtgggcagaaaaggaaaacacttgcttaccgtcgatcagaaacgaggggagcatgtcgtgtgcgggtccactaggaataatgaatctgaatccacgctggacctcgagggtttccagaatccaactgctaaggaatgtgaggggttggcaactttggataacaaagcagatctggacggagaatcaacagagggcactgaagaactggaagattcgctgaatcattttacacactcagtccagggacaaacctccgagatgataccatcggacgaagaagaggaggacgacgaagaggaggaggaagaggaagaaccccgactaacaattaaccagcgggaggatgaagacggtatggctaatgaggacgaactggataacacatatacagggagcggcgacgaggatgctttaagcgaggaagacgacgagctgggggaagctgcgaagtatgaggacgtcaaggaatgtggaaagcacgttgaaagagcattgctggtcgaacttaacaagattagcctgaaggaagaaaatgtctgcgaggaaaaaaactctccagtcgaccagtcggacttcttttacgaattttctaagctcatcttcaccaaaggcaaatcaccaaccgtcgtctgcagcttgtgtaagcgcgagggccatctcaagaaggactgcccagaggatttcaagaggatccagctggaacctctgccgcctctgactccaaagttcttgaatattttagaccaagtgtgtatccagtgttataaggacttttcccctacaatcatagaagaccaagctcgagaacacattcgccaaaatctagaaagcttcattaggcaggactttcctggcactaagctgtctctctttggttcttctaaaaatggctttggctttaagcagtccgacctggatgtgtgcatgaccattaatgggctggagacagcagagggcctggattgcgtaagaacgatcgaggagctggccagagttcttagaaaacactcaggtctgaggaatatcctgcctatcacaactgccaaggtgccgattgtgaagtttttccacctcagaagcgggctcgaggtagacatatctttgtataataccctggctctccacaacacccggttattatccgcttatagtgccatcgaccctcgagtcaaatacctatgctatacaatgaaagtgttcaccaaaatgtgcgacattggagacgcttcccggggaagtctgagcagttatgcctataccctgatggtgctgtattttctccagcaacggaatccaccagtaatcccggtgcttcaggagatatataaaggggagaagaaaccggagatctttgtagacgggtggaacatttacttcttcgaccagatcgatgagctgccaacttattggagcgaatgtggcaagaataccgagtctgtcggccagctgtggttggggctcttgagattctacacagaagaattcgacttcaaggaacatgtcattagcatccgcagaaagagtttgctgactactttcaaaaaacagtggacatccaaatacatagtgattgaggatccttttgacttgaatcataatctaggcgcaggccttagcaggaagatgacgaatttcataatgaaagcatttattaacgggcgtcgtgtcttcggaatccctgtgaaagggttcccaaaggattatcccagcaaaatggaatatttctttgaccctgacgttcttaccgagggcgaactggccccaaacgatcgttgttgccgcatctgtggtaagatcggccactttatgaaggactgccccatgagacggaaagtgaggcgtaggcgtgaccaggaagacgcccttaatcagcgttacccagagaataaggaaaaacggagcaaggaggataaagaaatccataacaaatataccgagagagaagtttctactaaagaggacaaaccaatccagtgtacgccccagaaagccaaacccatgcgagccgctgctgacctcggcagagagaagattctcaggcctccagtggaaaaatggaaaaggcaggacgacaaggatctgagagagaagagatgctttatctgcggacgcgaaggccacattaagaaagagtgtcctcagttcaaagggtcctccggttccctcagctctaagtatatgactcaagggaaagcaagcgccaagagaactcagcaagaaagctag

SEQ ID NO: 61450 - DNA, 507 bp, Artificial Sequence
  Description of Artificial Sequence: Synthetic coding sequence
atggaggccggatcaccggagaacaagaagcagaggtctaggcccaggaaaccgaggaaaactcggaatgaggagaatgagcaggatggagatctcgaaggccctgtcatcgatgagtctgtgttgagcactaaagaactgctaggacttcagcaggccgaagagagactgaaaagagactgtatagaccgactgaaacgccgtcctaggaactaccccacagccaaatatacctgtcgcctatgcgacgtgctgattgaaagtattgctttcgcccacaagcacatcaaggagaaacgacataagaagaacattaaggagaaacaagaggaggagctgcttaccactctgccacctcccacacctagccaaatcaacgccgtggggatcgccatcgataaggtggtccaggagtttggcttacacaacgagaatctggagcagcgactcgagatcaagaggattatggagaatgtttttcaacacaagctgccagggattttctag

SEQ ID NO: 61451 - DNA, 375 bp, Artificial Sequence
  Description of Artificial Sequence: Synthetic coding sequence
atgtctcagcccgatgtcctgttgctggttcaggaatgtttaaagaacagtgatagtttcatagatgttgacgctgatttccatgccagggtccccgtggtggtttgtagagaaaaacagtcaggactgttgtgtaaggtttcagccggtaatgagaatgcatgtctgacaactaagcacctcaccgccctgggtaagcttgagccgaaacttgttcccctagttatagcattccgatactgggcaaaactctgttcaattgaccgacccgaagagggcggactgcccccatatgtgtttgctctgatggccattttcttcctgcagcaaaggaaagaaccacttctccctgtttacttgggctcctgggtgtag

SEQ ID NO: 61452 - DNA, 1188 bp, Artificial Sequence
  Description of Artificial Sequence: Synthetic coding sequence
atgaccattaacgggctggaaacagccgaggggctcgattgcgtgaggacgatcgaggaactcgcaagggtgttgcgcaagcattctggcctccgcaatattctccccatcaccaccgctaaggtgccaatcgtgaaattttttcacctgcggagcggtctcgaagtggatatttcattatataatacccttgcactccacaacacacggctgctgtccgcctacagcgctattgatcccagagttaagtacctgtgttatactatgaaggtgttcactaaaatctataagggcgagaagaagcccgaaatttttgtagacggatggaatatatacttctttgatcaaatcgacgaacttccaacatactggtcagaatgcgggaaaaacacagaatccgtcgggcaactgtggctagggttgcttcggttttacacagaggagttcgactttaaagagcacgtgattagtatccgtcgtaagtcactacttactaccttcaagaaacagtggacctcaaaatatatcgtgattgaagacccattcgacctaaatcacaatctgggtgccggtctgtcccgaaagatgacaaattttattatgaaggccttcatcaacggaagacgcgtgttcggcattcctgttaagggcttccccaaagactacccctctaagatggagtactttttcgatcctgacgtcctgaccgaaggtgagttagcgcctaacgacagatgttgcagaatctgcggcaaaattgggcatttcatgaaagactgtccaatgcggagaaaggtgcgcaggaggcgcgatcaggaagacgcactgaatcagcggtatccagagaataaagagaaaaggagcaaggaagataaggagattcataataaatataccgagcgcgaggttagtaccaaagaagataaacccatacaatgtacgcctcagaaggcgaagccaatgcgggcagccgcagacctcggacgcgagaaaatccttagaccgccagtggaaaagtggaagcggcaggacgacaaggacctgagggagaagcgatgctttatttgtggaagggaaggccatatcaagaaagagtgtccccagtttaaagggtcatcggggagtctgtctagtaagtatatgactcaagggaaggcctctgcaaaaagaactcaacaggagagctag

SEQ ID NO: 61453 - DNA, 3780 bp, Artificial Sequence
  Description of Artificial Sequence: Synthetic coding sequence
atgggagataccgcgaaaccgtatttcgtgaagcgaacaaaggatcgcggaacgatggacgacgacgattttagaaggggtcaccctcagcaggattatctcatcatagatgaccatgccaagggacacggaagcaaaatggagaagggcctccagaagaagaagattactcccggtaactatggcaatacgcccaggaagggtccctgcgctgtctcaagtaacccctatgcctttaagaatccaatatactctcaaccagcctggatgaacgacagtcacaaggaccagtcaaagagatggctaagtgatgaacacaccggaaacagcgacaactggagagaattcaagccaggtccaaggatacctgtcatcaaccgtcagcgcaaagacagcttccaggagaatgaggacggatacagatggcaggacacccgagggtgtcggacagttagaagactgtttcacaaagatttgacctcactcgaaaccaccagtgagatggaagcgggaagtccggaaaataagaagcagcgcagccgccctagaaagccacgaaagactagaaatgaggagaatgaacaggatggagatctcgagggcccagtgattgacgaatccgttctgtccactaaagagctgcttgggctgcagcaggcagaggagcggcttaagagggattgcatcgatcggctgaaacgcaggcccaggaattaccccactgccaagtatacatgtcgcttatgtgacgttctgattgaatctatcgcttttgcccacaagcacattaaagagaagagacacaaaaaaaacatcaaggagaaacaggaggaggaattgttaacaacgctccccccaccgactccttcacagattaatgctgtggggattgcgatcgacaaagttgttcaggagtttggccttcataatgaaaacctggagcaaagactggagattaaacgaatcatggaaaacgttttccaacacaagttgcctgattgctctctacggctttatggatcctcttgttcacggctcggctttaagaacagcgatgttaatatagacatacagtttccggcaatcattgagggcttctccctatccaagctggggaattttaacctacaggatattgagaaagacgttgtaatctgggagcataccgactccgccgcaggggataccggtattactaaggaggaggctccccgagaaactcccatcaagcggggacaggtgagcctgatcctcgacgtgaagcaccagccttcggttccggtcggtcagctctgggtcgagttactccgcttctatgccctggaatttaaccttgcagacttggtcatctcaattagagtgaaagaactggtgtcccgggaactgaaggattggcctaagaaaagaatagcaatcgaggacccctacagtgtgaagcgtaatgtagctcgcacactcaatagccagccagtatttgagtatattcttcactgcctgcggacgacatacaaatatttcgcactgccccacaagatcactaagagctcccttctgaagcctctgaatgctatcacctgcatatcagagcatagtaaggaggtgatcaatcaccaccccgatgtgcagacaaaggacgataagctgaagaatagcgtgctcgcccagggccctggagctaccagtagcgctgccaatacctgcaaagtgcaacctctgactttgaaggagactgcagaatcttttgggtcaccccctaaggaagaaatgggcaacgaacacattagtgtgcatccagagaattcggactgtatccaagcggatgtcaattctgatgactacaaaggcgacaaagtgtaccaccccgaaaccggcagaaagaatgagaaggagaaggtcggcaggaaagggaaacatcttctgacagtcgaccagaaaagaggtgagcatgtcgtgtgcggatctacacgaaataacgagtccgagagcactctggacctggaagggtttcaaaaccctactgcgaaagagtgcgagggccttgccactctagacaacaaagcggacctggatggcgaaagtaccgaggggaccgaagaactggaggacagcctgaaccattttactcactctgtacaggggcaaacatccgagatgatccccagtgacgaagaggaagaggacgacgaggaggaggaggaagaagaggagcctagattgaccattaaccagagagaagatgaagacggaatggcaaatgaagatgaactagacaacacctataccgggagcggcgatgaagacgctctatccgaggaggacgatgagttaggcgaagctgccaagtacgaggacgttaaggagtgtggcaaacacgtcgaacgcgctctccttgtcgagctcaacaaaatcagtctgaaggaggagaatgtctgtgaggaaaaaaacagccctgtcgaccagtcagacttcttttatgaattctccaagctgatatttaccaagggtaaaggactcgactgcgtacgtaccatcgaggagctcgctcgtgttttaagaaaacactcggggcttcggaacatacttcccataacaactgccaaggttccgattgtgaagtttttccatctcaggagtggactcgaggtcgacataagtttatataacaccctcgcactgcacaacacgagactgctcagtgcatattcagccatcgacccccgagtcaaatatctctgttacaccatgaaagtgttcactaagatgtgcgacatcggcgacgctagccggggatcgctcagcagctatgcatacactctgatggtcctgtactttttacagcagcgtaatcctccagtgatccccgtactgcaggagatctacaaaggggagaagaaacctgagatcttcgtggatgggtggaacatctattttttcgatcagattgatgagcttccaacatattggtccgagtgcggcaaaaacaccgagtctgtcggccagctttggctcggcctgctccgcttttacacagaagagttcgactttaaagagcacgtaatttcgattcgcagaaagtccctgcttactacatttaaaaaacagtggacaagtaagtacatagttatcgaggacccgttcgacctcaatcacaacctgggcgcaggtctttctcggaagatgacaaactttattatgaaggcctttatcaatgggcgtcgggtgtttgggataccagtcaaggggtttccaaaggattatccaagcaagatggagtactttttcgaccctgacgtgctgaccgagggtgagctcgcccctaatgacagatgttgcagaatctgtggaaagatcggtcattttatgaaggactgtcccatgcggaggaaagttcggcgtaggagggaccaggaggatgcattgaaccagaggtaccctgagaacaaggagaaacgaagcaaggaggacaaagaaattcacaataagtataccgagagagaagtgtcaaccaaagaggacaaacctatacagtgcactccacaaaaagccaaaccaatgcgcgcagcggcagatttaggcagggagaagatccttaggccaccagtggagaagtggaaaagacaagatgataaagatctgagagagaagaggtgttttatctgcggaagagaaggacacatcaagaaggaatgtcctcagttcaagggtagtagtggctcactgtcctccaagtacatgacgcagggtaaggcatccgctaagcgtacacagcaagagtcttag

SEQ ID NO: 61454 - DNA, 4374 bp, Artificial Sequence
  Description of Artificial Sequence: Synthetic coding sequence
atgggagataccgccaaaccttacttcgtaaagcggacgaaggacagaggcactatggatgacgatgactttagaagaggccaccctcagcaagactatctgattattgacgatcatgccaagggacatgggtcgaagatggagaagggcctgcagaaaaagaagataactcccggtaactacggcaacaccccgaggaaaggcccatgtgcagtttcgagtaacccctatgcgttcaagaatcctatatacagccagccggcatggatgaatgacagccacaaagatcaatcaaaacgctggttgtccgacgaacacacaggaaatagtgacaactggagggaattcaagccgggacctcgcatacctgtcatcaatcgacagcggaaagacagcttccaggagaacgaagacggttaccgttggcaggacactcgaggctgtcgaactgtgcgtaggctctttcataaagatctgacgtccttagaaaccacttccgaaatggaggcgggatcacctgaaaacaaaaaacagcggtcccgcccaaggaagcccaggaaaactagaaatgaggaaaacgagcaagatggagaccttgaaggacccgttatcgatgagtctgtgttatcaaccaaggagcttctcggactccagcaagcggaggagcgtctaaaacgggactgcattgatagattaaagcgtcgccctaggaactatcccactgccaagtatacatgcaggctatgtgatgtattaatcgagtccatcgcatttgcacacaagcacattaaggagaaaagacataagaagaacatcaaggagaaacaagaggaggaactgttaactacactaccacccccaactccctcccagatcaacgcagttggcatcgccatagacaaggtggtgcaggaatttggccttcataacgagaacttggagcagaggctggagataaaacgcatcatggaaaacgtgtttcagcacaaactcccagattgctctctccgcttatatggtagcagctgctctcggctcgggttcaagaattcagacgtcaacatcgatatccagttccctgccattatgtcccagccagacgtgctgttactcgtgcaggaatgcctgaagaactcagacagcttcatcgatgttgatgcagatttccacgctcgcgtccccgtggtcgtgtgtagggagaagcaaagtggactgctgtgcaaggtctcagccggaaatgaaaacgcatgcctgacaactaaacatcttaccgcattagggaaacttgaacccaagctcgtgcccctggtaattgcattcagatactgggctaaactttgctcaattgacaggcctgaagaggggggattgcccccatatgtcttcgccctgatggctatcttctttttacagcagcggaaagagcccctactgccggtgtacctcggttcgtggatcgagggcttctctctgagcaaactggggaactttaatctccaggatatcgaaaaggacgtcgtcatatgggagcatactgacagcgctgccggtgacaccggtatcaccaaggaagaggctcctagggaaacacccataaaacggggtcaagtgagtctcatactggacgtcaagcatcagccatcagtacccgttggccagctttgggttgagctgctgaggttttatgccctggagtttaatcttgcagaccttgtgatctctattagagttaaagagttagtatctagggagctgaaagattggcctaagaagcgcatagctatagaggacccttactccgttaagaggaatgtggcacgaacgctgaactctcagcctgtgtttgaatacatcctgcattgtctgagaactacgtacaagtattttgcccttccacacaaaattactaagtctagcttattaaaacctttgaacgctattacttgcatatctgaacacagcaaggaagtaatcaatcaccatcccgatgtgcagacgaaggacgacaagctgaaaaacagtgtgctggcacaaggccctggagcaacatcatccgcagcgaacacatgcaaggtgcagcctcttactctgaaggaaaccgctgagtcctttgggtcgcctcctaaggaagagatggggaatgagcacatcagtgtgcacccggagaattcagactgtatccaggctgatgtgaatagcgacgactacaaaggggataaagtatatcaccccgagactggacgcaaaaacgaaaaggaaaaagtggggagaaaggggaagcaccttctgactgtggaccagaagcggggagaacatgtcgtgtgcggctccacaagaaacaacgaatctgaaagtactttggacctcgaggggtttcagaatcctacagccaaagagtgcgaagggcttgccactctggacaataaggcagatctggacggtgaatctacagagggaaccgaggagctagaagattccctcaatcacttcacacattcagtccagggacagacctcagagatgataccatccgatgaggaagaagaagacgacgaggaagaggaggaagaggaagagccacgtttaaccattaatcagagagaagacgaggatgggatggcgaacgaggacgaactggacaatacatataccgggtcaggcgatgaagacgcactctcagaggaggacgatgaactgggcgaggcagcaaagtacgaggatgttaaggaatgcgggaaacacgtggaaagggccctgctggtggagttaaacaagatttccctgaaagaggaaaacgtgtgcgaggagaaaaatagcccggtggaccagagcgatttcttttatgaattttctaagctgatcttcacaaaggggaaaagtcctaccgtggtatgcagtttgtgcaagcgcgagggccatttgaaaaaagattgccctgaagatttcaagaggatccagctcgaaccactgcctcctctcacgcctaagttcttaaacatcctggatcaagtctgcatacagtgttacaaggacttcagcccgacaatcatagaggaccaggcacgtgagcacatccggcagaatctggaatcttttatccggcaggactttccgggtacaaaattgagcctgttcggatcaagtaaaaacggatttgggtttaaacaaagcgacctggacgtttgcatgaccattaatggattggagacagccgagggcctcgattgcgtgcgcaccatcgaggaactggctagggtgctgcggaaacactccggcctgcggaatattcttcccatcacgactgctaaggtgcccatagtaaaattttttcatctccggtcgggtctggaggttgacatctccttgtataacactctcgcactgcacaacactagactgctgagcgcatatagcgccatcgacccgcgagtaaaatatttgtgctacaccatgaaggtgttcaccaaaatttacaaaggggagaaaaagccggagattttcgtggacggatggaatatatatttttttgaccaaattgatgaattacccacatattggtccgaatgcggcaagaacacggaaagcgtcggccagctgtggctcggtttacttcggttctatacagaagaattcgactttaaagagcacgtaatctccattaggcggaaatcactgctcaccactttcaagaaacaatggacttctaagtacatcgtaatcgaggacccatttgacctgaatcacaacttgggcgctggcctaagccgcaaaatgactaactttatcatgaaagcttttattaacgggaggcgggtcttcgggattcctgtgaagggctttcccaaggattacccatctaaaatggagtatttcttcgatccagatgtgttgacggaaggtgagctggcgcctaacgacaggtgttgccgaatttgtggaaagataggccacttcatgaaggactgccccatgcgcaggaaagttaggagaaggcgggaccaggaagacgccctgaaccagcgctatccggagaacaaggaaaaacgctccaaggaagacaaagaaatccacaacaaatatactgaacgagaagtgagtacaaaagaggataaacctatccagtgcacaccacagaaagccaagccaatgagagccgcagctgatctgggcagggaaaaaatcctgaggcccccagtggaaaagtggaagcgacaggacgataaagacctgcgagaaaaacggtgctttatctgcggcagggaaggccacattaaaaaagaatgtccacagttcaagggatcctccggaagtctatcaagtaagtacatgactcagggcaaagccagtgcaaaacgcactcaacaggagtcatag

SEQ ID NO: 61455 - DNA, 4488 bp, Artificial Sequence
  Description of Artificial Sequence: Synthetic coding sequence
atgggggatacagcgaaaccctactttgtgaagcgaactaaagatagagggaccatggacgacgatgattttaggcgaggacacccacaacaggactacctgatcatcgatgaccacgccaaggggcacggcagtaagatggagaagggactccagaaaaagaaaatcacaccaggcaactatggtaatactcctagaaaaggcccttgcgcagtaagctctaatccatatgcattcaagaacccaatatatagccagcccgcatggatgaacgacagccacaaagatcagtcaaagaggtggttaagcgacgagcacacgggcaattctgacaactggagagagttcaaacccggaccccgtataccagtgattaacaggcaaaggaaggattccttccaggaaaacgaggacggctataggtggcaagatacacggggatgtcgaacagtgcggcgactgtttcataaagatctgacttcgctggagacaaccagcgagatggaggcgggttctcccgagaataagaaacaacgaagcaggcctcgcaaaccacggaagacccggaatgaggagaacgaacaggacggggacttggagggcccagtgattgacgagtcagtgctctctaccaaggaactcctgggcttacagcaagccgaggagagactgaagcgcgattgcatcgatagattgaagcgaaggccacgaaactaccccaccgcgaagtacacatgtagattatgtgatgtgttgatcgaaagcattgcctttgcccacaaacacataaaagagaaaagacataagaagaacatcaaagagaaacaagaagaggagctccttaccaccctgcctccaccgaccccgagccagatcaatgctgttggaatcgcgattgacaaagtcgtacaagaattcggtctgcataatgagaatctcgagcaaaggctcgagatcaagcgcataatggagaacgtctttcagcacaagctcccggactgttctcttaggctgtatggcagctcctgttccagactcggatttaaaaactcagatgttaacatcgacattcaattccctgcaattatgagtcaacccgatgtgctattgcttgtgcaggagtgcttgaagaacagcgattctttcatcgatgtggatgctgactttcacgccagagtgcccgtcgtggtttgcagggagaagcagtccgggctcttgtgtaaggtgtctgccggaaacgaaaacgcttgcctgacaactaaacacctgacggcccttgggaagttagagcccaaactggtcccattggtaatagctttccggtactgggcaaagctctgtagcatcgatcgacctgaagagggaggcctgcctccctatgtgtttgcgctcatggctattttctttctccagcagcgaaaggaacctctgctgcccgtgtatctggggtcttggatcgagggtttctccctgagtaagcttggaaatttcaatctgcaggacatcgaaaaggatgtagtgatatgggaacatactgattctgccgcaggggatacggggattacaaaagaggaggcccctcgagaaacaccgatcaagaggggccaagtgtctctaatcctggatgttaagcaccagccatcagtgcccgtgggccagctgtgggtggagctgttgagattttacgcgctggagtttaatctggccgatctggtgattagtatacgggtgaaggagctcgtaagtcgggaactcaaggattggcccaaaaagcgtattgctatcgaggacccctattccgtgaagcgtaatgtggcaaggactctgaacagccaaccagtctttgagtacattcttcactgcctgaggactacctacaaatacttcgccctccctcacaagattacaaaatctagcctgctgaaaccactgaatgccatcacatgcatatctgagcattcaaaagaagtcattaaccaccacccagatgtgcagactaaagacgacaaactcaagaatagcgtgctggcacagggaccaggtgcgacgtcaagtgccgctaatacatgcaaagtccaacccctaactttaaaagagactgcagaatcatttgggtcgcccccaaaggaggagatgggtaacgagcacatatcggtccacccagaaaatagcgattgtattcaggccgatgtgaattccgacgactataaaggcgacaaagtatatcaccccgagaccggacgcaagaacgaaaaagaaaaagtcggcagaaaggggaagcaccttctgacagttgaccagaagaggggggagcatgtcgtgtgtggttctacacggaacaacgagtcagagtctacactggacctggaaggcttccagaaccccacagctaaggaatgtgaagggctggccacactcgacaacaaggccgacctcgacggagagtccactgaaggtacagaggaattggaagactctctgaaccattttacccatagtgttcaaggccagaccagcgagatgattccctcagacgaagaagaggaagatgacgaggaggaagaagaagaggaagagccacggttgactataaaccagagggaagatgaagacggcatggccaatgaagatgaactggacaacacatacactggatctggagatgaagacgccctctctgaagaggatgacgaactcggggaggcggctaaatacgaagacgtcaaagaatgtggtaaacacgtcgaacgcgctctcctggttgagttaaataagatttctttgaaagaagaaaatgtatgtgaggaaaaaaatagccccgtcgaccagtcggatttcttctacgaattctctaaattgatttttaccaagggaaagtctcctacagttgtttgctcactgtgtaaaagggaaggacatcttaagaaagattgtcccgaggatttcaagcggattcagctggagccgcttccacccctgaccccgaagttcttgaacatcctggaccaggtatgcatccagtgctacaaggacttctcaccaactatcatagaagatcaggcacgtgagcatattcggcagaatctggaaagtttcataagacaagattttccaggcacaaaactcagtctttttggctcgtccaagaatgggtttggattcaagcagtccgaccttgatgtctgtatgaccataaacggcctggagacagccgaggggctggattgcgtgcgcacgatcgaagagctagctcgggtactgcgaaaacacagcgggctgcggaacatcctgccgattaccaccgctaaggtcccgatcgtgaaattctttcacctccgatcagggctcgaggtggacatctcactgtataacaccctcgccctgcacaacacccggctgctatctgcttactcagcaattgacccacgggtgaaatatttgtgctacacaatgaaagtattcaccaaaatgtgcgacatcggtgacgcttcccgcggttctctgtccagttacgcctacacactcatggtgctttatttcctgcagcagcgaaaccctcccgttattcccgtacttcaggagatctataaaggagagaaaaaaccagagatcttcgttgatggatggaacatctacttcttcgatcagatcgacgaactgccaacttactggagtgagtgcggaaaaaatacagagtccgtgggacagctgtggctggggcttcttcgtttctacaccgaggaatttgacttcaaggagcacgtgatctccatccggagaaagtcccttcttactacctttaagaagcagtggaccagcaaatacattgtgatcgaagatcccttcgacttaaatcacaacttgggggctgggttgtctaggaaaatgacaaatttcataatgaaggcctttatcaacggccgacgggtcttcggaattcctgtgaaagggtttcctaaagactatccttcgaaaatggaatacttctttgaccccgatgtgcttacagaaggagaactggctcctaacgacagatgctgtcggatttgcgggaagattggccatttcatgaaagactgccccatgcggagaaaggtccggagacggagagaccaggaggacgcactgaatcagaggtaccctgagaataaggaaaagcggtctaaagaagacaaggagatacataacaagtacacagaaagagaggtgtcgacaaaagaagataaacccattcaatgcacacctcagaaggccaagcccatgagggccgcagcagaccttggacgagagaaaatccttcggccacctgtggagaagtggaaacgacaggacgataaagatcttagagagaagcgttgcttcatatgtgggagggaagggcacatcaagaaggagtgcccacaatttaaggggagctctggctctctgagtagcaagtatatgacacagggaaaggcctctgccaagcgaacccagcaagagagctag

SEQ ID NO: 61456 - DNA, 498 bp, Artificial Sequence
  Description of Artificial Sequence: Synthetic coding sequence
atggaagccggtagtccagagaataagaagcagcgctcccgccctaggaaacctcgaaaaacaaggaatgaggagaatgagcaggatggagatctggaagggcctgtgattgacgagtccgttctgagcacaaaggaacttttaggcttacagcaggcagaggaaaggctgaaacgtgactgtatagatcggctaaaaagaaggcccagaaactacccgacagctaaatatacctgcagattgtgcgacgtgcttatcgaatccatcgcctttgcgcacaaacatataaaggaaaaacgacataagaaaaacattaaagaaaaacaggaggaagagctactgacaaccttaccacctccaactccttcacagatcaatgccgtggggattgcaatcgataaagttgtgcaagaattcgggctccacaatgaaaacctcgaacagcggctggaaatcaaaagaataatggagaatgtcttccaacacaaactcccatag

SEQ ID NO: 61457 - DNA, 618 bp, Artificial Sequence
  Description of Artificial Sequence: Synthetic coding sequence
atgttcggcggatacgagaccattgaggcatacgaggatgacctgtacagggacgagtctagctccgaactgagtgttgacagcgaagtagaatttcaactgtacagccagattcattatgctcaggatctggatgatgtgatacgtgaggaagaacacgaggaaaaaaattctggcaattctgagagttcttcctccaaacccaaccagaaaaagctcattgtgctgtccgacagcgaggtgattcagctgagcgatgggagtgaggtgataactttatctgacgaagattctatctatcgatgcaagggcaagaacgtccgggtgcaagctcaggagaacgcccatggcctatcttcaagcctgcagagtaacgaactggtcgacaaaaaatgcaaatctgacatcgaaaaacccaagtcagaggagcgcagtggcgtgattagagaagtgatgatcatcgaagtaagtagctccgaggaagaagaatctactattagtgaaggtgacaatgtagagtcgtggatgctcctgggctgcgaggtcgatgataaggacgatgacattctcctgaatctcgtcggctgcgaaaattcagtgactgagggccaggaatag

SEQ ID NO: 61458 - DNA, 1632 bp, Artificial Sequence
  Description of Artificial Sequence: Synthetic coding sequence
atgatgtttggaggctatgagacaatagaagcctacgaagatgatctctacagggacgaatcaagttctgagctgtccgttgactccgaggttgagtttcagctatatagccagatccactacgctcaagatctggatgacgtcattcgagaggaggagcacgaggaaaagaacagcgggaactcagagagctcttcgagcaagcctaaccagaagaagttaatagtgctcagtgactccgaagtgatccaactttctgatggcagcgaggtgatcactctcagcgacgaagacagtatctaccgttgtaaaggcaaaaacgtgcgtgtacaggcccaggagaacgcacacggacttagctcttccctgcaaagtaacgaactggtcgacaagaagtgtaagagcgatatcgagaagccgaaaagcgaggaaaggagcggagtgatccgcgaggttatgatcatcgaggtgtcatcttctgaggaagaggagagcactatcagtgagggagataatgttgagagttggatgctcttaggttgcgaagtggacgacaaggacgacgacattttgctcaacttggtgggctgtgaaaactcagtaaccgaaggcgaggacggaataaactggagtatctcagacaaagacatcgaggcccagatcgctaacaaccgtacccccggtagatggacccaacggtactactctgctaacaaaaatatcatctgtagaaactgtgataaacggggacacctcagcaaaaactgccccctcccacgaaaagtgcgacggtgcttcctgtgctctaggcggggacacctcctttacagctgccccgctccattgtgtgaatattgtcctgtgcctaaaatgttagaccacagctgcttgttcagacacagctgggacaagcagtgtgaccgctgccatatgctgggccactacaccgacgcctgtaccgagatatggcgccagtatcacctcaccacaaagccaggcccaccaaagaagcctaagaccccatcccgtccctctgccttagcttactgttatcactgcgcgcagaaaggacactatggtcacgagtgcccggagagagaggtgtacgacccatccccagtgtcgccattcatctgctattatgatgacaaatacgagattcaggaaagagaaaagcgacttaaacagaagataaaagtcctaaaaaaaaacggggtgatcccagaaccatcaaagctgccctatattaaggccgcaaatgagaacccacatcatgatattagaaagggcagagcctcctggaagtcaaaccgctggccacaggagaacaaggagacacaaaaggaaatgaagaataagaacaggaattgggaaaaacaccggaaggccgacaggcacagggaggtcgacgaggacttccctaggggcccaaaaacatactcttcccccggttcattcaagacgcagaagccaagcaaaccttttcatcgaagctcacactaccatacttcccgggaggacaaatccccaaaggagggtaagaggggaaaacagaaaaagaaagagagatgctgggaagatgacgataacgacaacctttttctgatcaagcaacgaaagaagaaatcctag

SEQ ID NO: 61459 - DNA, 762 bp, Artificial Sequence
  Description of Artificial Sequence: Synthetic coding sequence
atgttagatcattcttgtctgttcagacactcctgggataaacaatgcgacagatgtcatatgcttgggcactataccgatgcctgcactgaaatctggaggcagtaccacctaaccaccaagccaggaccacctaaaaaacctaagacgccctctcgaccctcagcactggcgtactgctaccactgcgcccaaaagggccactacggacacgaatgcccagagagggaggtctacgacccttctcctgtttcaccttttatttgctattatgatgacaaatacgagattcaggagcgcgagaagcggctcaagcagaagatcaaggtgctaaagaaaaacggggtaatacccgaaccaagcaagctgccttatatcaaggctgctaatgagaatccacatcatgatatcagaaaggggagagccagctggaaatcgaacagatggccgcaggagaacaaagaaacccagaaggagatgaagaacaagaacagaaactgggaaaagcatcgaaaggcggataggcatagggaagtggatgaggactttcctcgtggacccaagacttactctagccctggctcattcaaaacccaaaagccatctaagcccttccaccgttctagtcactatcacacaagccgggaggataaaagtcccaaggaagggaaacgtggtaaacagaaaaagaaggaacgttgctgggaggatgatgacaatgataatctgttcctgatcaaacagcggaagaaaaagtcctag

SEQ ID NO: 61460 - DNA, 2124 bp, Artificial Sequence
  Description of Artificial Sequence: Synthetic coding sequence
atggccgcagaagtctattttggtgatttagaattgttcgagccatttgatcatcccgaggagagcatacccaagcccgtgcacactagattcaaagatgatgatggagacgaagaggacgagaatggggtaggagacgctgagctgcgcgagcggcttcgccaatgtgaagaaaccattgagcagctgcgtgccgaaaatcaggagctcaaacgcaagctgaatatcctaactaggccctcagggatactggtgaatgatactaagctcgacggcccaattcttcagatcctgttcatgaacaatgctatatctaagcaataccaccaagaaatcgaagaatttgtgagcaatctggttaagcgtttcgaggagcagcagaaaaacgacgtggaaaagacttcttttaatctgctgccccagccaagctccatagtcctggaagaggaccacaaggtagaggagtcttgcgcaatcaagaacaataaggaggctttcagcgtggtcgggtcagtgctctatttcacaaacttctgcctggataaattaggccagccactattgaacgagaatccccagctgtctgaaggctgggagatccctaagtaccaccaagtgttctctcacatcgtgagcctcgagggacaggaaatacaggttaaggccaaacgtcctaagccacactgttttaactgtggctcagaagagcatcagatgaaggattgtccaatgcccaggaacgccgcaagaatcagcgagaagaggaaggagtacatggatgcctgtggcgaggcaaacaaccagaacttccagcagcgttatcacgctgaggaagtggaggagcgctttggcaggtttaagcctggcgtgataagtgaggaactccaggatgcattaggggtcaccgataaatcattaccgcctttcatctaccggatgagacagcttggatacccacccggttggctgaaggaggcagagctggagaacagtggactcgctctgtatgatgggaaggatgggaccgatggagagactgaagttggtgagatccagcaaaacaagtctgtgacctacgacctgagcaaactcgtcaactacccagggttcaacatctccactcctcgagggatccccgacgagtggcgcattttcggctccatcccgatgcaagcctgccagcagaaagacgtttttgcaaattatcttacctctaactttcaggctcctggtgtgaagtctggcaacaagcgtagtagttcccatagtagtcccggatcacctaagaaacagaaaaatgagtccaactcagcaggctcaccggcagacatggaactggacagcgacatggaggttcctcacggatcgcagagttcagagagctttcagtttcagccaccccttccccctgacacacccccactcccgagggggacccctcccccagttttcactccgccattgccaaagggcaccccacccctgacccccagtgacagcccacagactcggaccgccagtggagcggtagatgaggacgcactgactctggaggagcttgaggaacagcagcggaggatctgggccgcattagagcaggccgagtcggtgaatagtgacagtgacgtgcccgtggatacacccctaacagggaacagtgttgcctcaagtccctgtccgaatgagctagacttgccagtgcctgaagggaagacctccgagaaacaaaccctcgacgaaccagaggtgcccgagatttttacgaaaaaaagtgaggctggccacgcatcttctcccgattcggaagttacttcactgtgtcagaaagagaaggccgagctggcccctgttaacaccgagggggctctgctcgataatgggagcgtcgtcccaaattgcgatatttctaacggcggtagtcagaaacttttccccgctgacacatcaccgagtaccgctacaaaaattcacagccctatacctgacatgtcaaaattcgctactggcataacccctttcgagttcgagaacatggctgagagcacaggaatgtacctccgaataagatctctgctgaagaactcccctcgcaaccagcaaaagaataaaaaggcctcagaatag

SEQ ID NO: 61461 - DNA, 1410 bp, Artificial Sequence
  Description of Artificial Sequence: Synthetic coding sequence
atgaaagattgccctatgcctagaaacgcggcacgcattagtgagaagaggaaagagtatatggatgcatgtggggaagctaacaatcagaatttccagcagaggtaccacgccgaggaagttgaagaacggttcggacgatttaagccaggggtcatatctgaggagttgcaggatgcattgggcgtgacggataagagtctgccgccatttatatataggatgcggcagctcgggtaccctcctggttggttgaaggaggccgagctggagaactcgggcctggccctctacgacgggaaggacgggaccgatggggagaccgaggtcggagagatccaacagaacaaaagcgtaacatacgatttgagcaaactcgtgaattatccaggctttaacataagcacacccagggggattccagacgagtggagaattttcgggagcattccaatgcaagcttgtcagcagaaagacgtatttgccaattacttgacgtcaaactttcaagctccaggtgtgaagtccggaaacaaaaggagcagttcacattcctcccctgggtctcctaagaaacagaaaaacgaaagcaatagcgcgggtagtccagctgatatggaactcgattcagacatggaggtgcctcacggctcacagtcatctgaatcgtttcagttccagcccccactgccgcctgacacccctcccctgcccagaggaacacctccccctgtgttcactccacccctcccaaaaggcacacccccactgaccccttccgacagcccgcagactaggaccgcctctggagcagtcgatgaggatgctctcaccctagaggagcttgaagagcagcagcggagaatctgggcggctcttgagcaggctgagagcgttaattccgacagcgacgtgcctgttgatactccactgacaggcaacagcgtagcctcgtcaccctgccccaatgaactggacttgccagtcccagaggggaagacatctgagaagcagacactggacgagcccgaggtccctgagatcttcaccaagaagtccgaggctgggcacgcctcatcccctgacagcgaagttacttctctttgccaaaaggaaaaggctgagcttgcccctgtgaatacggaaggtgcattgctcgataacggttccgttgtccctaattgtgacatatccaacggcggaagccagaagctgtttcccgcagatacttccccgtccacagccaccaaaattcactcacccatccctgatatgtcaaagttcgccaccggcattaccccttttgagtttgagaacatggccgagtctaccggaatgtacttgagaataaggtccctcctgaagaattccccacggaatcaacagaagaataaaaaagctagcgagtag

SEQ ID NO: 61462 - DNA, 117 bp, Artificial Sequence
  Description of Artificial Sequence: Synthetic coding sequence
atgaaggactgtcccatgcccagaaatgcggcacggatctccgagaagcgtaaggagtatatggatgcctgcggcgaagccaacaaccagaatttccagcaacggtaccacgcttag

SEQ ID NO: 61463 - DNA, 1410 bp, Artificial Sequence
  Description of Artificial Sequence: Synthetic coding sequence
atgaaagattgccccatgccgcgaaacgccgcacgaatctcagaaaaacggaaagaatatatggatgcctgtggggaagcaaacaatcagaacttccaacagaggtatcacgccgaagaagtcgaggaaagatttggacgttttaagcccggagtgataagcgaagaactgcaggatgccctgggcgtcaccgacaagtccttgccgccattcatctaccgcatgaggcagttgggatatccccctggttggctgaaggaggccgagcttgagaactcagggctcgcactgtacgatggcaaggatgggacagacggggaaaccgaagttggggagatccagcagaataaatctgttacttatgacttatccaagctggtaaattacccgggatttaacattagcacccctcggggaatacccgacgaatggcgcatcttcggctccattcccatgcaagcttgccaacagaaggacgttttcgcgaactacctgacatccaacttccaggctccaggagtcaagtccgggaacaagcggagctcttcccattcctcccctggaagtcccaagaagcagaagaacgagtccaatagtgctggcagccctgcagacatggaactagacagcgacatggaggtcccgcatggcagtcagtcttccgaatcctttcaatttcagccaccacttccccctgacacccctcctttgccccgagggacccctccaccagtattcacccccccactgccgaaagggacaccccctctgacacccagcgattcgccgcagaccagaaccgcatccggagcagtggacgaggatgctctgacactagaagagctggaagaacagcaaagaaggatttgggcagctctggaacaggctgagtcagtcaattcagatagtgatgtccctgtggatactcccctcacaggcaactctgtggcctctagcccctgtccaaatgaactggacctgcccgtgccagaaggtaagacctcagaaaaacagacattggacgagcctgaagtgcccgaaatcttcactaagaagtccgaggctggtcacgcaagctctccggatagtgaggttacttctctgtgccagaaggagaaagccgaactcgccccagttaacacggaaggggcacttctcgacaacggcagtgtggtccctaattgtgatatcagcaacggcggatctcagaagctgttcccagcggacacctctccatctactgcaaccaagattcacagtccaatccccgacatgtcaaaatttgcaacaggcataacaccgtttgagttcgaaaatatggccgagtccaccggcatgtacctgcgcattcgatctctcctgaaaaatagcccacggaaccagcagaaaaataagaaggcctctgagtag

SEQ ID NO: 61464 - DNA, 816 bp, Artificial Sequence
  Description of Artificial Sequence: Synthetic coding sequence
atgacgcgttgggcacgggtgagtactacatacaataagcgacctctccccgcaacaagctgggaagacatgaagaaaggctccttcgaaggtacctctcagaacctgcctaaacggaagcagctggaggccaacagactttcgctaaagaacgatgctccacaggccaagcataagaaaaacaagaagaagaaggagtacctgaacgaagacgtgaatggattcatggagtatctccggcagaactcccagatggtccacaacggccaaataatcgccactgacagcgaggaagtgcgagaggaaattgctgtcgcccttaagaaagattctcgcagggaaggcagaaggttgaaaaggcaggcggctaaaaagaatgccatggtctgttttcattgccgcaaacccggtcacggtatcgccgattgcccagccgcactggagaaccaggatatgggcacaggtatctgttaccgctgcggctctactgaacacgagataaccaagtgtaaggccaaagtggacccagcacttggggaatttccctttgcaaagtgcttcgtctgcggtgagatgggccaccttagccggagttgtcccgataaccccaaagggctttacgccgacggaggaggatgcaagttatgtggtagcgtggagcaccttaaaaaagactgcccagaaagtcagaactccgaaagaatggtgaccgtgggaaggtgggcgaaagggatgagcgcagactacgaagaaatcctggatgtacccaagcctcaaaagcctaagaccaagatccctaaggtcgtgaacttttag

SEQ ID NO: 61465 - DNA, 816 bp, Artificial Sequence
  Description of Artificial Sequence: Synthetic coding sequence
atgacccggtgggctcgcgtgtcaactacttataacaagaggcccttacctgccactagttgggaggacatgaagaaaggtagtttcgaggggacctcacaaaacctgcccaaaagaaagcagctggaggctaacagactttctttaaagaacgacgcaccacaagcaaaacataagaagaacaagaaaaaaaaggagtatctgaacgaagatgtcaacgggttcatggaatacctgcgccagaattcccagatggtgcacaatgggcagatcatcgcaacagactccgaagaagtgcgagaagagatcgctgtggccctcaagaaggatagcaggcgagagggtagacgcttgaaacgccaggcggctaaaaaaaacgccatggtgtgcttccactgtcgcaaaccagggcacggaattgccgactgcccagcagccctggagaaccaggatatgggcacaggtatctgctaccggtgcggcagtacagagcatgaaatcacaaagtgtaaagctaaggttgatcccgctctgggcgagtttcctttcgccaaatgtttcgtatgcggcgagatgggccacttgtcacgatcctgcccagacaatcccaagggactgtatgccgatggcggaggatgcaagctgtgcggaagcgttgagcacctgaaaaaggattgtccagaaagtcagaattctgaacgcatggtgacggttggaagatgggccaagggaatgtctgccgactacgaggagatcctcgacgtcccaaagccacaaaagcccaagaccaagattcccaaggtggtcaatttttag

SEQ ID NO: 61466 - DNA, 816 bp, Artificial Sequence
  Description of Artificial Sequence: Synthetic coding sequence
atgacccgatgggctcgcgtgtccactacatacaacaaaaggcctctccccgctaccagctgggaggacatgaaaaaaggttccttcgaggggacctcacaaaatctgccaaaaaggaaacaactggaagctaacaggctgtctctgaaaaatgacgcaccacaggctaagcacaagaagaacaagaagaagaaagagtatttgaacgaggacgtgaacggattcatggagtacttaaggcagaattcacagatggtccacaatggtcagatcattgccaccgactccgaagaagtgagggaagaaatcgctgtcgccctgaagaaggattcacgccgagagggtagaagactcaaacgccaggccgcaaagaagaacgcaatggtgtgctttcactgcagaaaaccaggacatgggattgctgattgtcccgcagccctcgagaaccaggacatgggcaccggcatctgctaccgctgcggttccaccgagcatgaaatcacaaaatgtaaagctaaagttgacccagcactgggggaattcccttttgctaaatgtttcgtgtgcggtgagatgggccatctaagcagaagctgtccggacaatcctaaaggcctttatgccgatggcggaggatgcaagctgtgtggctctgtcgaacatttgaagaaggattgccccgagtcccagaatagcgaacgcatggtgactgtaggtcgatgggctaagggcatgtcagctgattatgaggaaattctggacgtgccgaagccacagaaacccaagaccaagataccaaaagtggtcaatttctag

SEQ ID NO: 61467 - DNA, 816 bp, Artificial Sequence
  Description of Artificial Sequence: Synthetic coding sequence
atgaccaggtgggcaagagtttctaccacctacaacaaacgaccactgcctgcaaccagctgggaggatatgaaaaaaggcagctttgaaggaacatcccagaacttgcccaagaggaaacagttggaagctaacagactgagcctcaagaatgacgcacctcaggctaagcacaagaaaaataaaaagaaaaaggaatatctgaacgaggacgttaacggatttatggaatacctgcgtcagaactcacagatggtgcataacggacaaataatcgccaccgactcagaagaagttagagaggagattgccgtggccctgaaaaaagactctaggagggaaggacggagactcaaacgccaggcagccaaaaagaacgctatggtatgcttccactgtcgaaagcccggacacggaatcgccgactgcccagctgctctggagaatcaggacatgggaaccggcatctgctacagatgcgggtctaccgaacatgagataacaaagtgtaaggccaaggttgatcccgctctgggagaatttccattcgccaagtgtttcgtgtgtggggagatgggacacctctcaaggtcctgcccagacaaccccaaggggctgtatgcagacggaggtggctgcaaactgtgtgggtctgttgaacacttgaagaaagattgccctgagagccagaatagtgagaggatggtgactgtgggacggtgggcaaaaggcatgtctgctgattacgaggagatacttgatgtcccaaagcctcaaaaacccaaaaccaagatcccgaaagtcgtgaacttctag

SEQ ID NO: 61468 - DNA, 1434 bp, Artificial Sequence
  Description of Artificial Sequence: Synthetic coding sequence
atgggaagtggtctcgactttgcagaaactagctgtgcccaaccagtggtctcaacacaatctgataaggagcccggaattaccgcaagtgctactgacactgataacgcaaatggcgaagaggttccacatactcaagagatatccgtgagttgggagggggaagcggcacccgagatcagaacatcaaagctgggccaacctgacccggctccgtccaagaaaaagtctaatcgcttgaccctgagtaaacggaaaaaagaggcacaggatgagaaagttgaaaaaacacagggaggacatgaacatcgccaggaggaccggcttaagaaaactgttcaagatcactcccagatccgggatcagcagaaaggggaaatctccggctttggtcaatgcctggtctgggtgcaatgttcttttccgaactgtggaaagtggcgacggttatgtggaaatattgacccgtccgttctgccagacaattggtcttgcgatcaaaacaccgacgtgcagtacaaccggtgcgatattccagaggagacatggacaggcctagagtctgatgtggcatacgcttcatacatacctggttctatcatatgggcaaagcagtatggctacccatggtggcctgggatgatcgagtctgatcctgatctgggagagtattttctgtttaccagtcacctcgatagtctcccaagcaagtatcacgttaccttctttggggaaactgtatccagggcatggatccctgtgaacatgctcaagaattttcaggaactgagcctcgaattatcagtcatgaagaaacgtcgaaacgactgctcccagaagctgggggtagctttgatgatggctcaggaggccgagcagatatccatacaagagagggtaaacctattcggattttggtcccgcttcaacggctcaaacagtaacggagagagaaaggacctgcagctttccggtctcaattccccaggtagctgcctagagaaaaaggagaaggaggaagagctggagaaagaggaaggcgaaaaaacagatcctatcctgcctatccggaagcgggtgaagatacagacacagaaaactaaacccagggggccaaagaagaagttcaaggccccacagtccaaagctctggccgcttctttttctgagggcaaggaagttaggacggtgcctaagaatttgggactgagcgcatgcaaaggcgcatgtccaagttcagctaaagaggaacccagacacagggaacccctgacccaggaggccggaagcgtgccgcttgaggacgaggctagcagcgacctagatctggaacaactcatggaagacgttgggcgagagctcgggcaaagcggggagctgcaacattcgaactcggacggggaggattttccagtagctctgttcggtaaatag

SEQ ID NO: 61469 - DNA, 1410 bp, Artificial Sequence
  Description of Artificial Sequence: Synthetic coding sequence
atgatgaccactttgcagaataaagaagaatgtgggaaaggcccaaagcgcattttcgcaccacctgcacagaaaagctactcgctgctcccttgctctcccaactcaccaaaagaagaaactcccggtatcagctccccagagaccgaagcccgaatttcacttcctaaagccagcctaaaaaagaaggaggagaaagcaactatgaaaaacgttccctctagagagcaggaaaagaagcgcaaggctcagattaacaagcaggccgagaaaaaagagaaggagaagtcatctttgacaaacgccgagtttgaggagatagtgcagatcgtgcttcagaaaagccttcaggaatgcctggggggaatgggcagcggactcgatttcgcagaaacatcctgcgcccagcctgtagtgtccacccaatctgacaaagagccagggatcaccgcctcagcaactgataccgacaacgctaatggcgaagaggtcccacacactcaggagatttctgtctcatgggagggcgaagctgctccagaaataagaacatctaagttggggcagccagatcccgcaccgtctaaaaagaaaagcaatcgactgacattaagtaagagaaaaaaggaggctcaggatgaaaaagtggagaaaacccagggaggacatgaacatcgccaggaagaccggctcaaaaagactgtgcaggatcactcccaaattagagaccagcaaaagggggagatctctggttttggacagtgcctggtgtgggttcagtgtagttttcccaattgcgggaaatggcgaaggctgtgtggtaacattgatccctccgtgcttcccgacaactggtcatgtgaccagaataccgccgatgtgcagtacaaccggtgcgacattcctgaggaaacctggactggcctggagagcgatgtcgcatatgcctcttacatcccaggcagtatcatttgggcaaagcagtacggctatccttggtggcccggaatgattgagagcgacccagacctcggcgagtacttccttttcacctcgcatctagactccctgccgtcgaagtaccacgtgactttctttggagaaacggtgtctcgcgcatggatccctgtcaatatgctgaagaatttccaagagctgagcctggagctttctgtaatgaaaaagcggagaaacgattgcagtcagaaactgggcgtagctctgatgatggcacaggaggccgagcaaatcagcatccaggaacgagtgaacctgtttggcttctggagtcgtttcaatgggtccaactcaaatggagagcggaaagacctgcaactttccggccttaactcgccgggttcctgtctggaaaacgggaaggaacggaggccaagggaattccgtttttag

SEQ ID NO: 61470 - DNA, 1947 bp, Artificial Sequence
  Description of Artificial Sequence: Synthetic coding sequence
atgatgactactctgcagaacaaggaagaatgcggcaagggaccgaaaagaatattcgcacccccagcccagaaaagctacagcctgctaccttgttcacccaactcacccaaagaggagaccccaggtatttccagcccagagacagaagcgaggataagcctccccaaagcctctctcaaaaagaaagaagagaaagcgaccatgaagaacgtgccaagccgtgagcaggagaagaagaggaaagcacagatcaacaaacaggccgagaagaaagagaaggaaaagagttctctgacaaacgccgaattcgaagaaatcgtacagatcgtcctgcaaaaatccctacaggaatgcctgggcatggggtcgggtctggatttcgcggaaacatcatgcgcacagccagtggtgtcaacccagtcagacaaggagccaggcattacggcatccgcaaccgacactgataatgcgaatggcgaggaggttccacacacacaggaaatcagcgtctcgtgggagggggaagcggctccagagatccgcacctcaaaactgggccaaccagaccccgctccttccaaaaagaaaagcaatcgattgactttatctaagcgtaagaaggaggctcatgagaaggttgagaaaactcagggcggtcatgaacacagacaggaggacaggctgaagaagacagtgcaggatcacagccagattagggaccagcagaaaggcgaaatctccgggtttggacagtgcctggtctgggtgcagtgcagctttcccaattgcgggaaatggcgccgtttatgcgggaatattgatccttccgtccttcccgacaattggtcctgtgaccagaacactgacgtgcagtacaacaggtgcgacatcccggaggaaacttggaccggtttggaatcagacgtggcttacgcctcttacataccgggtagtatcatctgggccaaacagtatggctacccttggtggcctggcatgatagaatctgaccctgatttgggtgaatattttctctttacaagtcacctggactctctgccgtcaaagtatcatgttacattctttggtgagactgtctctcgcgcttggatcccagtgaatatgctgaaaaattttcaggagctgagcctggagctatctgtaatgaaaaagcgcagaaacgactgctcacagaagctgggcgtagctcttatgatggcccaagaggcagagcaaatttccatccaagagagagttaatctgttcggattctggtcaagatttaacggcagtaattccaacggagagcggaaggatttacagctatcagggcttaattctccgggaagttgcctcgagaagaaagagaaggaagaagaactcgagaaagaagagggtgagaagaccgaccctatcctgcccattaggaaacgggtcaaaatccaaacccaaaagactaagcccagagggctgggtggcgacgctggaacagccgatggacgtggaaggacccttcagcgtaagatcatgaagagaagcttgggaaggaagtccacagcgccaccggcaccccgtatggggaggaaggaggggcaaggtaacagcgatagtgatcaacccggacctaaaaagaagtttaaggctccccaaagcaaagcactggcagccagcttctcagaaggaaaggaagtaaggacagtgccaaaaaacctgggcctttcagcttgcaagggggcttgtccttcctccgctaaagaggaaccaagacatcgcgaacccttgactcaggaagccggtagtgtacctttggaagacgaggccagctcagacctggacttagagcagcttatggaggatgttggtcgagaattgggacagtcaggggagctgcagcactcaaattccgacggggaagattttcccgtggcccttttcggcaaatag

SEQ ID NO: 61471 - DNA, 1071 bp, Artificial Sequence
  Description of Artificial Sequence: Synthetic coding sequence
atggacaaagagaaactggatgtgaaaattgagtattgtaattacgccatggactccagcgtcgagaacatgtatgtgaataaagtgtgggttcagtgtgagaacgaaaattgtctgaaatggaggctgttgagcagtgaggactctgccaaagtcgaccacgacgaaccctggtattgcttcatgaacacagactcccgatacaacaattgcagtatttctgaggaggatttcccagaagaatctcaacttcaccagtgcgggttcaaaattgtgtattcacaactacccctggggagtctggtgctggtgaagttgcagaattggccttcttggcctggcatcttgtgccctgacagattcaaggggaaatacgtaacgtatgatcccgacggtaacgtagaggaatatcacatcgagttcttgggagacccccacagcagatcgtggatcaaggccacattcgtgggccattactctattacacttaagcctgaaaagtgtaagaacaaaaagaaatggtacaaaagcgccctgcaggaggcttgtttgctctacggttactctcatgaacagcgcctcgaaatgtgttgcctcagtaaactacaggataaatcggaaacgcacgacaaagtcgctgcactggtgaagaaacggaagcaaacaagtaaaaacaacatcgaaaaaaaaaaacccaagtttcggaagagaaagcgcaaggctatactgaagtgctctttcgagaacgtctactcagacgacgcactctcaaaggaaaaccgcgtggtatgcgagactgaagttctgctcaaagagctcgaacagatgttacagcaggcgcttcagccaacagccacgcccgatgagtctgaggaaggccatggggaagaaattaacatgggagagaaactttctaaatgctcccctgaggctccagccggaagtctcttcgagaatcactatgaggaagattatctggtcattgacggaatcaaactgaaagcaggggagtgtatcgaggatattactaataagtttaaggagatcgacgcgttaatgtcagagttttag

SEQ ID NO: 61472 - DNA, 384 bp, Artificial Sequence
  Description of Artificial Sequence: Synthetic coding sequence
atggacaaggagaagctcgacgtcaaaatagaatactgcaattacgcaatggatagctccgtggagaacatgtatgtgaacaaggtatgggtgcagtgtgaaaacgaaaattgcctcaagtggagactgctttccagtgaggattcagccaaagtggatcatgacgaaccatggtactgtttcatgaataccgatagccggtataataattgttccattagcgaagaggactttcccgaggagtcacaactccatcagtgtggattcaaaattgtgtactcgcagcttcctctgggcagcctggtcctggtgaaactccagaattggccaagttggccaggaatcctttgtcccgaccgttttaaaggcaaatacgtaacatag

SEQ ID NO: 61473 - DNA, 1071 bp, Artificial Sequence
  Description of Artificial Sequence: Synthetic coding sequence
atggataaggagaagcttgatgtgaagatagaatattgtaactacgcaatggactcctctgtcgaaaatatgtatgtaaacaaagtatgggtgcaatgtgagaatgaaaactgcctgaaatggcgccttttatcatccgaggatagcgcaaaggttgatcacgacgaaccttggtattgtttcatgaatacagactctagatataacaactgtagcataagcgaagaagacttccctgaggagtcccagctccaccaatgcggctttaaaatcgtgtactcacaactccctttgggtagcttagttctggtgaaactgcaaaattggcctagctggcccggtatcctctgtccggatcggttcaagggaaagtacgtaacctacgatcccgatggaaacgtcgaggaataccatatcgaattccttggtgatccccatagcagaagttggatcaaggctacgtttgtgggacattactccattaccctgaagccagaaaagtgtaagaataaaaagaagtggtataagtccgcgctgcaagaagcctgcctgctatacggttactcgcatgagcagagacttgaaatgtgctgcctgtctaaactgcaggataagagtgaaacccatgacaaagtcgccgctctggtcaagaagcgcaaacagacaagcaagaacaatattgagaagaagaaacctaagtttaggaaaaggaagcggaaggccattttgaagtgcagctttgagaatgtttactcagacgatgccctgtccaaagagaaccgtgtggtctgcgagaccgaagtgctgttgaaggaactggaacagatgcttcagcaggcgctgcaaccgacagcaactccagacgaaagcgaagaaggccacggtgaagaaattaatatgggcgaaaaactttcaaaatgctcccctgaagcacctgccggttccctttttgaaaatcactacgaagaagattatctagtgatagacgggataaaactgaaggctggggaatgcatagaggatatcactaacaagttcaaggagatagatgcccttatgagcgaattctag

SEQ ID NO: 61474 - DNA, 7064 bp, Artificial Sequence
  Description of Artificial Sequence: Synthetic coding sequence
atgcagaaaagacagggctactgctcatactgcagagtccagtataacaatctggagcagcacctcttctctgcccaacaccgatccttgactaggcagtcacggagacaaatctgtacatcctccctgatggaacggtttctgcaggatgtgctccaacatcatccctatcattgccaagagtctagcagcacccaggacgagacccacgtcaacactggatcgtcatcagaagtggtccatttagatgatgccttttcagaagaagaagaagaagatgaagacaaagttgaggacgaagatgctacagaagaaagaccttctgaagtctctgagcctatagaagagctacactcccggcctcataagagccaggaggggactcaagaagtctctgttaggccatccgtgatccagaagttagaaaaggggcaacagcagcctctggagttcgttcataaaattggggcatctgttcgtaagtgcaaccttgtcgatattggccaggccaccaataaccgatccaatctggtgcgaccgcctgtcatctgcaacgctccagcctcatgtctgcccgagtcaagcaatgacaggcccgttaccgctaacacaacttcattacctcctgccgctcacttagattctgtgagcaagtgcgatcccaacaaagtagagaaatacctagaacagcccgatggcgcttcaagaaaccccgtccctagtagtcatgtggaaactaccagcttcagctaccaaaagcacaaggagtctaacaggaaatctctgcggatgaattcggacaagctagtgttatggaaggatgtgaaaagtcaaggaaaaactttatcagcaggtctgaagtttcacgaacgtatggggacaaagggctctttaagagtgaaatctcccagcaaactggcggtgaatcccaataagacagatatgcccagcaacaaggggatctttgaggacactatcgccaaaaatcacgaagagtttttttctaatatggactgtacccaggaggaaaagcacctcgtatttaataagactgccttctgggagcagaaatgcagcgtctccagcgagatgaagtttgactgtatcagcctgcaatctgcctccgatcagcctcaggaaacagcccaggatttatctctttggaaagaagaacaaattgaccaggaagacaattacgagtcccgcggatcagaaatgtcattcgattgcagttcatcctttcacagtttgaccgaccaaagcaaggtcagtgccaaggaagtgaacctctccaaggaggttaggaccgacgttcagtacaagaataacaagtcatacgtgtccaagatcagttctgactgcgatgatattcttcaccttgtgacaaatcagtcccagatgattgttaaggaaatctctctgcaaaacgcgcgtcacattagtttggtcgaccagtcctacgagagttcctcttccgagacaaacttcgattgcgacgctagtccgcagtccaccagtgactatcctcaacagtccgtgaccgaagtcaacctgccaaaggaagtacacattggtctcgtagataagaactacgggtctagctcctctgaagtctctgccgatagtgtgttcccacttcagagcgtggttgaccgccctccagtagccgtaactgaaacaaaactgcgaaaaaaagcacacactagcctcgtagataactatggcagttcctgtagcgaaacctccttcgattgcgacgtttctctggaatcagtcgtcgaccaccctcagctgacagtcaaaggtcgaaatctcaaggggaggcaggtccacctgaagcataaaaagcggaagccctcctccgccaaagcacatctggattgcgatgtgagcctagggactgtcgcagacgaaagtcagagggcagtggagaagattaacctgctgaaggaaaagaacgcagaccttatggatatgaattgtgagtctcacggcccagagatgggctttcaggcagacgcccagctggccgaccagtcacaggttgcggagattgagaggcaaaaagttgatgtggacctggagaacaaatccgtgcagagttcccgctcttcactttcttccgacagccccgcaagcctgtaccatagcgcccacgatgaaccccaagaagccctcgatgaggttaatcttaaggagctgaatattgatatggaagttaggtcctacgactgctcatcttcagaacttacttttgacagcgacccgccactgttgtctgtgacagagcagtcgcatctggacgcggagggtaaagagcggcacatcgacctggaggatgagagttgtgagtccgacagttccgagattactttcgacagcgacatacctctgtacagtgtgattgaccagccagaggtggctgtgtatgaagaggagacggtcgatctggagagcaaatctaacgagtcttgcgtctcagaaatcacattcgatagcgatatcccactgcattcgggaaacgatcaccctgaagttgctgtcaaggaggtaattcagaaggaagagtacattcatcttgaacgaaaaaatgatgaacctagtgggtccgagatcagcagcgactctcacgccccacttcacagcgtgacgaacagtcctgaagttgcagtgaagaagttgaatccacaaaaggaggagcaggtgcacctggaaaacaaggagaatgaacccatcgattcagaagtgtcactggactataacattatctttcatagcgtcacaggtagaagcgaggaccctatcaaagaaatttctctgcacacgaaggagcatatgtacttagaaaacaaaagcgtctttgagacttctttggactcggatgtgcctcttcaggccgctacccacaagcccgaggtcatcgttaaagagacttggttacagagggagaaacacgctgagttccaaggcaggtcaacagagttcagcgggagtaaaacgtcccttgattccggtgtgcctcattattccgttactgagcctcaggtggccgtcaacaagataaataggaagaagcagtacgtgttagagaacaagaatgacaagtgcagcgggtccgagatcattctcgacagcaatgttcccccacagtccatgaccgatcagccccaactcgccttcttgaaagaaaagcacgttaacctgaaagataagaatagcaagtctggagattccaaaattacattcgactccgagcagcttcaggaggccgtgaagaagatagaccagtggaaagaggaggtgatcggccttaaaaataagataaatgagccatcaacatataagcttatccaccatcctgacgtaagcgtccagtcagtggccgatcaacccaaagtcgcaattaaacacgtaaacctcggcaacgagaatcatatgtacttggaagtcaagaatagccaatactcatgctcagagatgaatctggattcgggcttcctgggacagtccatcgtcaaccgccctcagatcacgatcctggaacaagagcatatcgagctggagggaaaacacaatcagtgctgcggatctgaagtatcattcgactcggatgatcccctacaatccgtcgcagataggctgcgcgaaactgtcaaagaaataagcctctggaaggatgaggaggtggacactgaagacaggcgaaacgaagccaaggggtttgagattatgtatgatagcgacgtcctgcagcctgttgcgggtcaaccggaggaggtggtgaaagaagtgagcctgtggaaggagcacgttgacctcgagaacaaaatagtcaagccaaccgacagccgcattaatttcgactctcatgagcctctgcaatctgtcacaaacaagataccgggtgctaacaaggaaatcaatctgctacgcgaagaacacgtctgcctcgacgataaagggtatgtcccgtcagattctgaaattatttatgtgtctaatatacctcttcagagcgttataaaacaaccacacatactcgaggaggagcatgcgagtttagaggacaaaagctcaaattcctacagtcctgaggaaagcagcgactctaatgactcctttcaggccgcagcagacgaattacagaaacccgtgaaggaaattaatctttggaaagaggatcacatttacctcgaagacaagtcttacaagctgggcgattttgatgtctcttacgcctcccacattcctgtccagttcgtgacagatcagtcctctgtgccggtcaaagagatcaacttacagaaaaaggatcacaacgatctcgagaacaagaactgcgaggtgtgtggaagtgaaatcaagtgtcactcctgcgtgcacctccagagtgaggtcgatcagccacaagtgagctacaaagaggcagacctgcagaaagaagaacacgtggtcatggaggagaaaaccgaccagcctagcgatagcgagatgatgtacgactctgacgtgccgttccaaattgtggtcaaccaatttccgggatcagtaaaagagacgcacctgcccaaagtcgtcttggtcgacctggttcccggagattccgattacgaagtgataagcgatgatataccgttgcagctggtgacagatccgcctcagttaactgtcaaagacatctcctgcatcaatacagaatgtatcgacatcgaagataaatcttgcgattttttcggcagtgaagtgcgatgtaattgcaaggcaagcaccccgagcatgaccaatcagtgtaaagaaacttttaaaatcattaataggaaaaaagattacatcatcctgggtgagccgagctgtcagtcttgcggctcagaaatgaatttcaatgtcgatgcttcagatcagagtatgacatatgagtcacagggacccgacgagaagatggtgaagtacatcgactctgaggacaagtcttgcggttataacggatcaaaaggcaagtttaatcttgaggatacctcacatagaacgactcaccgcctgcaaaaggcacataaggaggcgtctttacgcaaggacccccgtaacgccggactcaagggaaaatcctgccaatccagcgccagcgccgtggatttcggggcttcaagtaagtctgcactgcatagacgcgcagacaagaaaaaaaggtctaaattgaaacatcgcgacctggaagtctcatgcgagcctgacggatttgaaatgaattttcaatgtgctcctcctctgccatcagatactgatcagcctcaggagacggtcaaaaagcgacacccctgcaagaaggtctctagcgatttaaaggagaagaatcacgattctcaaagttcttccgtgctcaaagtggattctgtgagaaatcttaagaaggctaaggatgtgatagaagataaccccgacgagccagtgctggaagcgctccctcatgtacccccttcctttgttgggaagacttggagccagatcatgagggaagatgacatcaaaatcaacgcccttgtgaaggagttccgggagggacgcttccactgctactttgatgacgactgtgagaccaagaaagtctcgagcaagggcaagaaaaaagttacgtgggcagacctgcaggggaaagaggataccgcccctacacaggcagtcagtgaaagtgatgacattgtgtgcggcatttcagatatcgatgacttaagcgttgcccttgataaaccctgccacaggcatccacctgcagagcggcctcccaaacaaaaggggagggttgcgagtcagtgccagaccgccaaaatctctcactccacccagacaagttgtaaaaactatccagtgatgaaacggaagataattcgccaggaagaggacccacccaaatccaagtgtagtcgcctgcaggatgacagaaagactaagaagaaggtaaaaatcgggactgtagagttccccgcatcgtgcactaaagtgctcaaacctatgcagcccaaggcactggtctgcgtgctctccagccttaatattaaactcaaagaaggcgagggtctcccttttccaaaaatgcggcaccacagctgggataacgatatcaggttcatctgcaaatacaagaggaatatctttgattactacgagcctctgatcaagcaaatcgttatcagccctcctctgtccgtgatagttcccgagttcgagcggaggaactgggtcaaaattcacttcaatcgctctaatcagaatagtagcgccggagataatgatgccgacgggcaagggtcggcatccgcacctctgatggcagtgcccgcacgatacggttttaatagtcaccagggcacatccgacagctctctgtttttggaggaaagcaaggtcctgcacgctagagagttacccaaaaagaggaacttccagttgacatttctgaatcacgacgttgtgaaaatctcccctaaatctgtcaggaacaaactgctggaaagtcagagcaagaagaagatccacggaaagagagtgactacttcatccaacaaactcggatttcctaagaaggtgtacaaacctattatcctccagcagaaacccagaaaagcctccgagaagcaaagtatctggatccgtactaagccctcagacatcatcagaaaatacattagcaaatatagcgtgttcctgcgccaccgctaccaaagcaggtccgcgttcctcggccgatacctgaagaagaaaaagagtgttgtgagccgactgaaaaaggcgaagagaactgcaaaggttctgcttaacagctccgtgcccccagccggagctgaagagttaagttctgccatggctaaccctcccccaaagaggcccgtccgagcctcatgtcgtgtggctcgccgacggaagaaaacagacgagtcataccatggccgtcagaaaggtccttcaacaccggtacgggcttacgacctccgcagttcctcatgtcttcagcaacgtgagcgtatgatgacacgattagccaacaaacttagaggcaatgaggttaaata

SEQ ID NO: 61475 - DNA, 1116 bp, Artificial Sequence
  Description of Artificial Sequence: Synthetic coding sequence
atggacacaagatcagggagtcaatgctccgtaacacctgaggccattagaaataacgaggagttagtgctccccccaagaatctcaagggtgaacggctggtctcttccccttcactactttcgcgtcgttacttgggctgtttttgttggactatccctggcgacgtttaggattttcatccccctcctaccccattcttggaaatacattgcatatgtggtcactggcggtatctttagttttcacctggtagtccatctcatcgccagctgtattgatccggctgactccaatgtgcgactgatgaaaaactacagccaacccatgcccttattcgaccgctccaagcatgcccacgtcattcaaaatcagttttgtcacctgtgtaaagtcacagtgaataagaaaaccaagcattgcattagctgtaataagtgcgtgagtggattcgaccaccactgcaagtggattaataactgcgtcgggagccgcaattactggttttttttcagtacagttgcctcagccacagcgggaatgctttgcctcattgctattcttttatatgttctggttcagtacctggtaaaccctcgggtgctgagaaccgacccccgatatgaggatgtgaagaacatgaatacatggctgctgttcctgccattgttccctgtgcaggtgcagaccctcatagtagtgatcatcaggatgctggtgttgctacttgatttgctaggcctcgtgcagctcgggcaattactgatctttcacatttaccttaaggccaaaaagatgaccactttcgaatatctgataaatacgaggaaagaggagagcagcaagcatcaggcagtgcggaaagacccatacgtccagatggacaaggggttcctccagcagggcgctggcgctctcgggagtagcgctcagggagttaaggctaagagcagcctgttgatttacaaatgcccttgtcacttttgtacctctgttaaccaggacggggactctaaggctcaggaggctgacgacgccccttctacaagcactctcggactacagcaagagaccacagagcctatgaagaccgactccgccgagtcagaggactag

SEQ ID NO: 61476 - DNA, 1212 bp, Artificial Sequence
  Description of Artificial Sequence: Synthetic coding sequence
atgaactacgactcccagcagccgccactgcctccactcccgtatgccggttgccgcagggcaagcggtttccccgctctaggcagaggaggaacagtccctgtgggggtgtggggcggtgcaggacagggcagggagggacgcagctggggggaaggaccaagaggacccggactgggcaggagagatttgtcaagcgctgacccagccgttttaggcgctacgatggaatccaggtgctatggctgtgccgtgaaatttacactatttaagaaagaatatgggtgcaaaaactgtggccgagcattctgctccggatgtctttctttttcagcagccgttccgcgaacgggaaatacccaacaaaaggtttgtaagcagtgtcacgaggtgttgaccagaggaagttccgcaaacgctagtaaatggtcccccccacagaactacaaaaagagagtagcagctctggaagcaaagcagaagccttccacctcccagtctcagggcctcactcgacaggatcaaatgatagcagaacgcctggcaaggctaagacaggagaacaagccaaaactagtcccttctcaggctgagatcgaggcaaggctggccgctctgaaggatgagcggcagggctccattccctccacccaagagatggaagctaggttagcggctctccagggtcgcgtacttccatcccagacgccccagcctgctcaccatactccagatactaggacacaagctcagcagacgcaggatctgttaacacagctggctgctgaagtagctatcgacgagagctggaagggaggcggacccgtcactctgcaggactacaggctccctgatagtgatgatgacgaggatgaggagacagccattcagagggtcttacagcagctgactgaggaggcaagcctggacgaagcctcaggcttcaacataccagctgagcaagcatcacgcccttggactcagccgagaggggctgaaccagaggcgcaggacgtcgaccctcgccctgaggctgaggaggaagagctgccttggtgctgtatatgtaatgaggacgctacattgcgatgcgctggctgtgatggggatttgttctgcgccagatgttttagggagggacacgatgcctttgagctgaaggaacaccagacaagcgcctacagtcctccacgggcagggcaggagcactag

SEQ ID NO: 61477 - DNA, 1386 bp, Artificial Sequence
  Description of Artificial Sequence: Synthetic coding sequence
atgccagccgtcgctgaggcgttaggacaggagggtcccccagacttaagcagaagtgcctttctagccactgtcttgaccagtcttagtgctgcctttagctctatgccctcatccgcatattcactccctttctccaggtcactggagttagattaccataccagctcttgtttcagggggacgatggtgaaggccgactgtccggtgcccattacggacctccccgatagttcaggcaaactgcagtacggctgcaaaaactgtggcagagcgttttgctcagggtgtcttagtttcagcgcagcagtcccccgaaccggtaatacccagcaaaaggtgtgcaagcaatgccacgaagtcctcactaggggttctagcgccaacgccagtaagtggtctccaccccagaactacaaaaagcgggtagcagcattggaggcaaaacaaaagccctctacgtctcagagtcagggtcttaccaggcaagatcagatgatagccgagcgactcgcgagactgagacaagagaacaagcccaagctggtgccgagtcaggctgaaattgaggctcgtctggctgctttaaaagatgagcggcagggcagtatcccctctacacaagaaatggaagctcgcttggcggcacttcaaggtcgagtcttaccttctcagacacctcagccggctcatcacacacccgacaccaggactcaggcccagcagacacaggacttgcttacacaacttgccgcagaggtggctattgacgagtcttggaagggtggcggtccggctgcctccctgcaaaacgatctcaaccaagggggaccaggcagcaccaatagcaaaagacaagcaaattggagcttggaagaggaaaagagcaggctcctggccgaagctgctctcgaactccgagaggaaaatacacgtcaggaaagaatcctagccctggccaagcggctggcaatgttgaggggtcaggatcccgagcgggtgaccctgcaagactaccgcctgcctgattcagacgacgacgaggacgaggaaactgccatacagcgggttctgcagcaacttaccgaagaggctagcctggatgaggcaagtgggttcaatatacctgcagaacaggcatccagaccatggactcagccccgtggcgcagagccggaagctcaggacgtggatccacggccagaagctgaggaagaagagctaccttggtgttgcatttgcaatgaggacgcaacccttaggtgtgccggatgcgacggcgacttgttttgtgcaaggtgcttcagagaggggcatgatgcctttgagctgaaggagcaccagacctcagcctatagcccaccaagagcgggtcaagaacattag

SEQ ID NO: 61478 - DNA, 1416 bp, Artificial Sequence
  Description of Artificial Sequence: Synthetic coding sequence
atgaactatgatagccagcaaccaccactgcctcccttgccatatgcagggtgccgaagggcatccggcttcccagctctcggcagaggaggaaccgtgcctgtgggcgtgtgggggggagcgggacaggggcgagagggtcgctcatggggcgagggcccaagggggccaggcttgggcagacgggatttatcaagcgccgatcccgcagtgctcggggcaacaatggaatcccggtgctatggctgtgcagtaaaatttacactgttcaagaaagagtatggctgcaaaaactgtgggcgagcgttctgctctggttgtctatcgttttccgcagctgtgcccaggaccggcaatacacaacaaaaagtgtgcaaacagtgccacgaggtgctaacacggggaagcagtgccaacgctagcaaatggagccctccccagaattacaaaaagagagtggccgcactcgaagccaagcagaaacctagtacaagccaatcacaggggctgacccgacaggatcagatgatagccgaaagactcgcacggctgcgccaggagaataaaccgaagctcgtgccctctcaggccgagatagaggctcgcctggctgccttgaaggacgagcgccaaggaagcattccgagcactcaagaaatggaggcacggctggccgctctgcagggtcgggtgctgccttctcagacgcctcagcctgcacaccacactcccgacacgcggacccaggcccagcagactcaagatctgttgacacagttggccgctgaagtggccatcgatgagtcctggaaaggcggaggacccgctgcgtctctacaaaatgacctgaatcaaggcggacctggatctacaaacagcaagagacaggcaaactggtccctggaggaggaaaaatctcgactcctggccgaggctgcgctcgagctaagggaggagaatacacgtcaggaacgtatcctggcattggcaaagcggctggccatgctccggggacaggatccagagagagtgacactgcaagactaccggctgcccgacagtgatgacgacgaagacgaagaaaccgcaatacaaagggtcttacagcaactgacagaagaggcgtcattggacgaggcgagcggctttaatatcccggctgagcaagccagccggccatggacgcaaccgaggggagccgaaccggaggcacaggatgtcgatcctcgtcccgaggcggaagaagaagagttgccctggtgttgcatttgcaatgaagacgccacattacgctgtgctggctgcgacggagacctcttctgtgccaggtgcttccgcgagggccatgatgcctttgaactaaaggagcaccagactagtgcctacagtccgccacgtgccggacaggaacactag

SEQ ID NO: 61479 - DNA, 465 bp, Artificial Sequence
  Description of Artificial Sequence: Synthetic coding sequence
atggtggagaaaaagacaagtgtgagaagtcaagatccgggtcaacggagagtgttagacagagcggctcgacagcgccgaatcaatcggcagttggaggcgctggagaacgataactttcaggatgacccccatgcgggactgccccagcttggtaaaaggctcccgcagtttgatgacgatgctgacaccggaaaaaagaaaaagaagaccaggggcgaccacttcaagctcaggtttcgtaaaaattttcaggccctcctggaagagcagaacttgagcgtggcggaaggtccaaactaccttacggcctgcgccggaccaccttcacgaccacagcgcccattttgtgcagtatgtggctttccctcaccctacacctgcgtgtcatgcggcgcacgctattgcactgtgcggtgcctcggcacccaccaagagactcggtgtctcaaatggacagtgtag

SEQ ID NO: 61480 - DNA, 1413 bp, Artificial Sequence
  Description of Artificial Sequence: Synthetic coding sequence
atggaattcgccgctgagaacgaagggaaatccggcggtggactgcattcagttgccgagggagtccgcctgagcccagagccagggcgagagggtgtacgtgacttggcaggcgctgaagagttcggaggtggagaggaagggacagggcttaccgggattaaggaaataggtgatggagaagaaggcagtggccagagaccagaagaaattccaatggatctgacggttgtgaagcaggagatcatcgactggcctgggacagagggacggctggcaggccaatgggtagagcaggaagttgaagacagaccagaggtgaaggacgagaatgcaggtgttctggaggtgaaacaggaaactgacagtagcctcgtggtgaaagaggctaaagtaggcgagccagaggtgaaagaggaaaaagtcaaggaggaggtgatggattggtctgaagtgaaggaggaaaaggacaacctggagattaagcaggaggaaaaattcgttggtcaatgcataaaagaggagctcatgcacggggaatgtgtcaaagaggagaaggacttcctgaagaaggaaattgtggatgatacaaaagtcaaagaggagcctccaattaaccaccccgtcgggtgcaagcgaaagctcgctatgagtcgttgtgaaacgtgtggaaccgaagaagccaagtataggtgtcctagatgcatgaggtacagttgcagcctgccgtgcgtcaaaaaacacaaagctgagttgacttgtaatggcgtcagagataagacggcctacatcagcatccagcagtttacagagatgaatctgttgtccgactaccggtttctggaggatgtggccaggacagctgatcatattagtcgcgatgcctttttaaaacgacctatctcaaacaaatacatgtacttcatgaaaaatagagcccgacgacaaggtatcaatctcaaactcctccctaacggtttcactaagagaaaagagaattcaacattctttgacaaaaagaaacaacagttctgctggcatgtgaagctgcaattcccacaatcccaggcagagtatatcgaaaaacgtgtgccggatgacaaaacaatcaatgagatcctgaagccttatattgatcccgagaagagtgatccggtaattcgacagcgcctcaaagcgtatatcaggtctcagacaggcgtccaaattcttatgaaaattgagtacatgcaacagaaccttgtgagatactatgagttggacccatataagagtctactcgataaccttaggaataaggtcattattgaatatcccacactccatgtcgttctgaagggctctaacaacgatatgaaagttctgcaccaagtgaagagtgaatctaccaagaatgtgggcaacgagaactag

SEQ ID NO: 61481 - DNA, 1296 bp, Artificial Sequence
  Description of Artificial Sequence: Synthetic coding sequence
atggaattcgccgctgagaacgaaggtaaaagtggcggagggctgcatagcgttgctgagggtgtgagactgtcccctgaacctgggcgtgaaggggtaagagacctcgccggagccgaagagttcggcggaggtgaagaaggtaccggcctgacggggattaaagagattggggacggagaagaggggagtggacagcgacctgaagaaattccgatggatctcacggtggtaaagcaagagaccgactctagccttgtcgtaaaggaagcaaaagtaggtgagccggaggtgaaagaggagaaggtgaaagaagaggttatggattggtcggaggtcaaagaggagaaagacaatcttgagatcaagcaggaagagaagttcgtcgggcaatgcattaaagaggagctcatgcacggcgaatgcgtgaaagaagagaaagatttccttaagaaagagattgtggatgatacaaaggtgaaggaggagccacctatcaaccacccagtcggttgcaaaagaaaacttgcaatgtccaggtgtgaaacatgcgggaccgaggaggcaaagtaccggtgtcctagatgtatgcggtactcctgctctctgccatgtgtcaaaaagcacaaagcagagctgacctgcaacggggtgagagacaaaacggcctatataagcattcagcaatttaccgaaatgaacctgttgtctgattatagatttcttgaagatgtggctagaaccgccgaccatatcagcagagacgcgtttctcaaacgcccaatcagcaataagtacatgtactttatgaagaaccgggcaagacgacaggggattaacctgaaactattgcccaatggcttcaccaagaggaaagagaattccacgtttttcgataaaaagaagcaacaattttgttggcatgtgaagcttcaatttccccagtcacaggccgagtatatagaaaagagagtgcctgatgataaaacaatcaatgagattctgaaaccctatatcgatcccgagaagtccgaccctgtgattagacagagactgaaggcatatattaggtcacagactggggtccagattctgatgaagattgagtacatgcagcagaacctggttcgctactacgagctggatccttataagtccctgttggacaatctgcggaataaagtgattatcgagtacccaactctccacgtggtccttaaggggtctaataacgatatgaaggtactccatcaggtgaaatcagagtcaaccaaaaatgtgggcaatgaaaactag

SEQ ID NO: 61482 - DNA, 4647 bp, Artificial Sequence
  Description of Artificial Sequence: Synthetic coding sequence
atggccgagcgagaggttgagtctgggccacgaaagaggttcgaacagaagtctggtgccgtttttgacgagattgtggaaaattgtggaggcataatggatacagaaatgagtgaagatatcgaccataatcttacaccaaccctggacagtatgtcttacggtatgccaaaccagacagggtcggaaaacagcctgctggacgaggatgactactttctaaacagcggcgacctagcgggaattcccgtcgtgggtagcgacaacgaagatgagcaggatttttcttcaaaggataacctggtgagtagtattcatacagatgacagcctcgaagtcgagaggcgtgtgacacagcatgaaagcgataatgagaatgagattcagatccagaacaaactgaagaaggattttccaaagcaattcgatcaagttagtgtgtttaaatccatccgaaaagacttctcgttggtgagagagaacagcaaagagacttttagtggtaaagaaaaaaatcgggacctgacctacgagcgcgaaaagcgactggacaaacctcacaaggatttggacagtcgactgaagtcatcgttctttgacaaggctgctaatcaggtggaagagactctacacactcacctcccccagactcccgagacaaactttagggactcttcatacccttttgcaaataaggagagtattggctccgaattgggcaacagcttcgcttctaatatcaggattaaggaggaacccttggacgacgaatatgacaaagcaatggctccgcagcaagggctattagataagataaaggacgaacctgataacgcccaggagtacagccatgggcagcaacagaagacccaggaaggagagctgaaaatttccgccgtgtttagtgtgtcaggaagtccactggcaccgcagttgacaactggatttcagccctctctggccagctcaggtatgaacaagatgcttccctctgttcccgcaaccgccgtgcgcgttagctgctccggatgtaagaaaatcctccaaaaaggccagaccgcataccagagaaaaggaagcacacagctcttttgtagcaccctatgtctaaccgggtacactgttcccccagcacgtcctcccccacccctgaccaaaaagacatgctcctcatgctcaaaagatatactaaatcctaaggatgtcatcagcgctcagttcgagaacacaacaactagtaaagacttctgctcccaatcttgcctttctacatatgaattgaagaaaaagcccattgtcacgattaatacgaattcaatcagtaccaagtgctctatgtgtcagaagaatgcagtgattcgacatgaggtcaattaccagaatgttgtccacaaactctgctcagatgcatgtttctctaaattccgctctgcgaataacctgactatgaattgttgcgagaactgtggtggttactgttatagcggctcagggcaatgccatatgttgcagattgaaggccagtccaagaaattctgctcttccagttgcattacggcctataagcaaaagagtgctaaaattactccttgcgcactctgcaaatccctacggtccagcgccgaaatgatcgaaaacaccaactctcttgggaagaccgagctattttgctctgtgaactgcttgtccgcttaccgcgtcaagatggtgacctccgcaggggttcaagtgcaatgcaattcatgtaagacaagtgctatcccacagtatcacctggcaatgtccgacggatccatccggaatttttgctcttactcctgtgtggtcgcttttcaaaatctttttaacaagcctacaggtatgaattccagcgtggtccctttgagccaggggcaggtgatcgttagtatccccactgggagcacagtgtccgccggaggcggttccacttcagcggtgtcaccaacctctatctctagcagtgccgcagcagggcttcaacggttagctgcccagtctcagcacgtcggctttgcacgatccgtggtgaagcttaaatgccagcactgtaaccggctattcgccacaaaacccgagttgctggattacaagggtaaaatgttccagttttgcggaaaaaattgttccgatgaatataaaaagatcaataacgtgatggccatgtgtgaatattgcaagattgaaaaaatcgtgaaggagaccgtccgcttcagcggcgctgacaagagtttctgcagtgagggatgtaaactactgtacaagcatgatctcgcgaagcggtgggggaaccactgcaaaatgtgcagctactgtctgcagacttcaccaaagctggtccagaacaacctaggcggaaaggtcgaggagttttgttgcgaagagtgtatgagtaaatatacagtgctgttttatcagatggccaagtgtgacgcttgtaagaggcagggtaagctcagtgaatccttaaaatggaggggcgaaatgaaacacttttgcaacttgttgtgcattcttatgttttgcaaccagcagagtgtgtgtgatcctccatctcagaacaatgcagcaaatatttcaatggtacaggccgcatccgcgggtcctccttccctgagaaaagactccaccccggtcatcgccaacgtggttagtcttgccagtgcccctgccgctcagcctaccgtcaattcaaattctgtactgcagggtgccgttcccacagtcactgccaaaatcatcggagacgctagcacacagactgacgcgctaaagctgcccccatctcaaccgccaaggttattgaagaacaaggccctcctctgcaagcccattacccagactaaagctaccagttgcaagcctcacacacagaacaaagaatgtcagaccgaagacactccgagtcaaccacagatcatagtggtccccgtacctgtgccagtttttgtgcccattcctttgcatctttacacacagtacgcacccgtccctttcgggattccagtgcccatgcccgtgcctatgctcatcccgagctctatggacagcgaagacaaagtgactgaatctatcgaggatatcaaggaaaagttgccaactcacccctttgaggccgacctgctggaaatggccgaaatgattgccgaagatgaggagaagaagaccctctcccagggcgagagccagaccagtgagcacgagcttttcctggatacaaaaatttttgagaaggaccagggcagcacatactcaggcgatttagaatcggaggccgtgagtacgccgcactcctgggaagaggaactcaaccactatgctttgaaatccaacgctgtgcaggaggctgatagtgaactgaaacaattttcaaaaggtgagactgagcaggatctggaggcggactttcctagcgatagttttgatccactcaacaaaggacagggcatccaagccaggtcaaggactaggagacgccaccgcgacggcttcccccaacccaggaggagaggcagaaaaaagagcatcgtggcagtggaaccgcgaagcctgattcaaggcgctttccagggttgctctgtgtctggaatgaccctgaaatatatgtatggcgtcaatgcctggaagaactgggttcagtggaaaaatgcaaaagaagagcagggcgatttgaagtgcggcggtgttgaacaggcttcatcttcccccagatcggacccactgggttcaactcaggaccatgctttatcacaggaatcaagcgagccaggttgccgagtgcggtcgataaagctcaaggaagatatcctttcgtgcaccttcgccgaactgagcctcggtctgtgtcagtttatccaggaggtgaggcgccctaacggggaaaaatacgacccggattccatcctctatctatgtctcgggattcaacagtacctctttgaaaatggaagaatcgataatatcttcacagagccgtattctcgattcatgattgagctgaccaagttgctcaaaatttgggagcccacgattctgcctaatggctacatgtttagtcggatcgaagaggaacacctttgggagtgtaaacaattaggcgcatactccccaattgtattgttaaacaccctcctcttttttaataccaagtactttcagttgaaaaacgtaactgaacaccttaagctgagctttgctcacgttatgcgacgcacaaggacattgaaatacagcaccaaaatgacctacctccgttttttccctccactacagaagcaggaaagtgaacctgacaaactgacggtcggaaagcgaaaacgcaacgaggacgacgaagtgccggtcggggtggagatggctgaaaatacggacaatcccctcaggtgcccagtccggttatatgaattttatttgtctaaatgctcggagtcggtgaagcaacgcaacgacgtcttctatctgcagccggaacggagctgcgtccctaactcccccatgtggtattccacttttcctatcgatcctggtaccctggacaccatgcttacacggattctgatggtgcgcgaggttcacgaggagctggctaaggccaagagtgaggattccgacgtggaactcagtgactag

SEQ ID NO: 61483 - DNA, 4380 bp, Artificial Sequence
  Description of Artificial Sequence: Synthetic coding sequence
atggccgaacgcgaggttgaatccggtccaaggaaacggttcgaacaaaagtctggcgcagtattcgacgagattgttgagaactgcggaggcataatggataccgaaatgtccgaggacatcgaccacaatcttacccctaccctggattctatgagctacgggatgccaaaccagacagggtccgagaatagtctgcttgacgaagatgattactttctcaacagtggtgacctcgctggaattcctgtggttggcagcgacaatgaagatgaacaagacttcagcagtaaagacaatctagtttcaagcatacataccgacgacagtttagaggttgaacgtcgcgttacccaacatgagagcgataatgagaatgagattcagatccaaaacaagctgaagaaagacttccctaagcagttcgaccaggtatccgtcttcaaaagtattcgcaaggacttcagtcttgtgagggagaatagcaaggagaccttttcaggaaaagagaaaaatagagacctgacctacgagcgcgagaagcggttagacaagccccacaaggatttagacagtcggcttaagtccagcttcttcgacaaagccgctaatcaggtggaggaaaccctccacacccatctccctcagaccccggagacaaatttccgagattcatcctatccttttgcaaataaagagtctatagggagcgagctgggtaattccttcgcctctaacattcgaataaaggaggaaccactggacgacgaatacgacaaggcaatggccccacaacagggccttcttgacaaaataaaggacgaaccagacaacgcccaggagtatagccatggtcagcagcaaaaaacccaggagggcgaactgaagatctcagccgtcttcagcgttagcggttccccgttggcaccgcagcttaccaccggcttccaacctagcctggcctccagcggcatgaacaagatgctgccatcagttcccgctactgccgtgcgggtcagttgctcgggctgcaagaaaatcctgcagaagggacagacagcctaccagagaaaaggcagcacccaattattctgctccacactctgcttaacgggctatactgtgccacctgctcgacctcccccacctctgactaagaagacgtgtagttcctgtagcaaggatattctgaatcccaaggacgtgatcagtgcccaatttgagaatacaactactagtaaggacttctgctcccagtcttgcctgtctacatatgaactaaaaaagaagcccattgtgaccataaatacaaactcaatcagcaccaagtgttcaatgtgtcagaaaaatgctgtgattcgacatgaagtcaactatcagaacgtggtccacaagctttgttcagacgcttgcttctccaagttccggagcgccaacaatctgaccatgaactgctgtgagaattgtggcggatattgttattctggatctggccagtgccacatgctacagatcgaaggccagtccaagaagttttgctcttcctcatgcattactgcttacaagcagaatctgttcaacaagcccacaggcatgaatagctctgtagtgcctctctcccagggtcaagttattgtgtctatccctacaggatcaaccgtgtccgcgggtgggggttcgaccagcgctgtttctcctacctccataagttccagcgctgccgcaggcctgcagcgattagcagcacaaagtcagcatgtgggctttgcccgaagtgtagtcaagttaaagtgtcagcactgcaatcggttgtttgctacgaaaccagaattgctggattataagggtaagatgttccaattttgtggtaagaattgctctgacgagtataaaaagattaacaatgtcatggcaatgtgtgagtactgcaagattgagaagatcgttaaagaaactgtgcgtttctctggggcagacaagagcttctgctcagagggatgtaagcttctgtacaagcatgatctggccaagcggtggggaaaccattgcaagatgtgttcttactgcctgcagaccagtcccaaacttgttcagaataacttgggagggaaggttgaagaattctgttgcgaggaatgcatgtcgaagtacaccgttctgttctatcagatggccaagtgcgatgcctgcaagcggcagggtaaactgtcagaaagcttaaagtggcggggagagatgaaacacttttgcaatctgctgtgtatcctgatgttttgtaaccagcaatcagtgtgcgaccctcccagtcagaacaacgccgcaaacatatcaatggtacaggcagcaagtgcgggaccccctagcctcaggaaagattctacccctgtgattgccaatgtcgttagcctagcttccgccccagccgcacagcccaccgtgaattctaatagcgtgttacagggggcagtgcctactgtgaccgctaagattattggggacgcctctacacagactgacgcccttaaactgcctccttcacaacccccaagactgctgaagaacaaggcattactgtgtaagcccatcacccaaacaaaagcaacgtcttgcaaacctcatacacagaataaggaatgccagacagaggataccccctctcagcctcagattatagtcgttcctgtaccagtgccagtgtttgttccaataccattgcacctctacacacagtatgcccctgtccccttcggcattcctgtgcccatgcccgtacctatgctgatcccatccagcatggactcagaagacaaggttacggagtctatagaagacattaaagagaaactccccactcacccatttgaggctgatctcttagaaatggcagagatgatcgcggaggatgaggagaaaaaaaccctctctcagggtgaatctcaaacaagtgagcatgaactgtttttggatacaaagatctttgaaaaagaccaggggagcacctatagcggcgatctcgagtccgaagccgtaagcaccccacacagctgggaggaggaattgaatcactacgcgctcaagtccaacgctgtccaggaagccgactctgagctaaaacagttttctaaaggagaaacggagcaggacctcgaggccgactttccctctgactcctttgaccctctgaataaaggccaaggtatccaggccagaagcaggaccagacgaaggcatagagacggttttccacagcctaggcggcgtggacgtaaaaaatccatcgtcgcagtcgaacctagaagcttaattcagggcgcatttcaaggttgctccgtttccgggatgactttgaaatacatgtacggagtgaacgcatggaagaattgggtccagtggaagaacgctaaggaagagcagggggacttaaaatgtgggggagtagaacaggcatctagctctcctcgtagcgaccctctgggaagtactcaggatcacgccctttctcaggagagttcagagccgggatgtcgggtacgctctatcaaattaaaggaggacatactcagctgcaccttcgccgagctttcactgggattgtgccagtttatccaggaggtgagaaggcctaatggggagaagtacgacccagactcaattctgtatttgtgcctcggcatccaacagtacctttttgagaacgggagaattgacaatatctttactgaaccttattcaagatttatgatcgaactcacaaagctgcttaagatctgggagcctacaattctcccgaacggctatatgttcagcaggattgaggaagagcatctgtgggagtgcaagcagttgggagcatactcacctattgtcctgctcaacaccttgctgttcttcaatacaaaatattttcagctgaaaaatgtcacggagcacctgaaactcagtttcgctcatgtaatgagacggacccggactctgaagtatagtaccaagatgacctacttgcgtttctttccgccactgcagaaacaggaatccgaacccgacaagctgaccgttgggaagcggaaacgtaacgaagatgacgaggtgccagtgggcgtggaaatggccgagaatacagataatcccctcaggtgtcctgtcagactctacgagttttatctaagtaagtgctccgaaagtgtgaagcagagaaacgacgtgttctatctccagcccgagcgcagctgtgttcccaacagccctatgtggtactcgactttccctattgaccctggaactctcgatacaatgctgactcgcatcctgatggtgcgcgaagtgcacgaggaactggccaaagccaagtccgaggattcagatgtggagctgtcagattag

SEQ ID NO: 61484 - DNA, 297 bp, Artificial Sequence
  Description of Artificial Sequence: Synthetic coding sequence
atggacacggaaatgtccgaggatatcgatcataatttgactcctaccctggatagcatgagctacggaatgcccaaccaaacagggtccgaaaattctttacttgacgaggacgattatttcttgaatagcggggacctcgccggtataccagtggtgggatctgataacgaggatgagcaggacttttcctccaaggacaatctggtctctagcattcacacagacgactctctcgaggtcgaaagaagagtgacccagcacgagtcagacaatgaaaacgaaatccagatttag

SEQ ID NO: 61485 - DNA, 3624 bp, Artificial Sequence
  Description of Artificial Sequence: Synthetic coding sequence
tgaccattagatgacgagtatgataaggcgatggctccccaacagggccttcttgataaaattaaggacgaacccgacaatgcccaggaatacagccatggccagcaacagaaaacccaggaaggagaactgaagatttcagccgtgttttcagtatccgggtcgcctctagcacctcagcttaccacaggctttcagccaagtttggcatccagtgggatgaacaagatgttgccttcggtgcccgctacggccgtccgggtgtcatgttccggttgtaagaagatcctccaaaaagggcagaccgcttatcagcggaagggaagtacccaattgttttgtagtaccctgtgtctgaccggatacaccgtgccacctgcaaggcccccaccccctttaacgaaaaagacctgtagctcctgtagtaaggatattttgaaccccaaggatgtgatcagcgcccaattcgaaaacactacaacttcgaaggatttttgttcccagtcttgcctaagtacctacgaactgaaaaagaaaccgatcgtcactattaatacaaatagcataagtaccaagtgttcaatgtgccagaagaatgcagtgattcggcacgaagtgaactaccagaatgttgtacacaaattatgttctgacgcctgttttagcaaattcaggtctgccaataatctcactatgaactgctgcgagaattgcgggggatactgttatagcggtagtggccagtgccatatgctgcaaatagagggtcagagtaagaagttttgcagcagctcatgcatcacagcctacaaacagaacttgtttaacaagcccactggaatgaatagcagcgtcgttcctttgtctcaaggacaagtaattgtatcaattccgactgggagcaccgtgtcagccggtggcggttccacatcggccgtgtcccccacctccatctcttcttccgcggcagccggattacagcggctggccgctcagagccagcacgtcggttttgccaggtctgtcgtgaaattgaaatgccagcactgcaacaggcttttcgctaccaagcccgagcttttggactataagggtaaaatgtttcagttctgtgggaagaattgttcagatgagtacaagaagattaacaatgtgatggccatgtgcgagtactgcaaaatcgagaagattgttaaggaaacagtgcgattttccggggctgataagagtttctgctcagaaggatgtaaacttctgtacaaacacgacctggctaaacggtgggggaaccactgcaagatgtgcagctactgtctccaaaccagccccaaactggtgcaaaacaatcttgggggtaaagtcgaagagttttgttgcgaggaatgtatgagcaagtataccgttctgttctaccagatggcgaagtgcgatgcatgcaagcgtcagggtaagctgtccgaaagcttgaagtggcgaggcgagatgaagcatttttgcaatttactgtgcatattgatgttttgcaatcagcaatcagtgtgtgacccgccatctcagaacaatgccgcaaacatcagcatggttcaggccgcatccgccggaccgccttcactgcggaaggacagcaccccagttattgcaaatgtggtctccctcgcgtcagccccagctgcccagcccaccgtgaacagcaattccgtcctgcaaggagctgtaccaacggtgactgccaagatcattggcgatgcctcaactcagaccgatgctttgaaattgcctccctctcagcctcccagacttctgaagaataaagcactgctatgcaagccaataacccagactaaagccactagttgtaaaccccatactcaaaataaagaatgtcagacagacactccctcccagcctcagatcatcgtggtccctgttcccgttcccgtcttcgtgccaatccccctgcacctgtatacccagtatgcaccggtcccattcggaatccccgtgcccatgcctgtgcccatgctcattccctctagcatggactcagaagataaagtgactgagtctatcgaggatatcaaagaaaagctgccaactcatccatttgaagctgacctgctggagatggccgagatgatcgcagaggatgaagaaaaaaagacactaagccagggggaatcacagacgagcgagcatgagctctttctggataccaaaattttcgagaaggaccagggttcaacttacagtggtgacctggaatctgaggccgtttccactccacacagctgggaggaggaattgaaccactatgcactgaaatctaatgctgtccaggaggcagatagtgagctgaaacagttttccaaaggggaaactgagcaggatctggaggcagattttccctccgactcgttcgatcctctcaacaagggccaagggatccaggcgaggtccaggactcgcagaaggcaccgagatgggttcccacagcctcgcagacgtggaagaaagaagtctattgtggcagtcgaaccacgaagcctgatacagggagccttccagggctgcagtgtgagcggaatgactctgaaatatatgtatggcgtcaatgcttggaagaattgggtccagtggaagaacgctaaggaggagcaaggagacttgaaatgtggcggagtggagcaggctagtagtagtccccgttccgatcccctggggagtacccaggaccatgcactatctcaggagagcagcgagcctggctgtagagtaaggtctatcaagcttaaggaggacattctgtcgtgcactttcgctgaactgtctttggggctttgtcagttcatccaggaggtccggcgacccaacggagagaaatacgatccagattctattttgtacctctgcctggggattcagcaatacttgttcgagaatggcagaatagataacatatttactgagccctattcccgtttcatgatcgagctcactaaactactcaagatctgggaaccgactatcctgcccaacggctacatgttctcaaggattgaggaagagcacttatgggagtgtaaacagcttggagcatatagccccattgttcttcttaacacgttattgttttttaatacaaaatactttcaactgaaaaacgtgaccgaacatttgaagctgtctttcgcgcatgtcatgagacgaacacgaacgctcaaatacagtactaagatgacctatctgaggtttttcccaccactccagaagcaagagagcgaacctgataaactgacggttggtaagagaaaaagaaatgaggacgacgaagttccagtgggtgtcgagatggccgagaatactgataatcctctacgatgcccagttcggctgtatgaattttatttgtcaaaatgctcagaatccgtgaaacagagaaatgacgtgttttacctccaacccgagaggtcatgcgtgccaaacagccctatgtggtattcaacattcccaatcgatcccggaaccttggataccatgctgacgcgaatcctcatggtccgtgaggtacacgaggagctggccaaagcgaagtcagaagatagcgatgtggagctgagtgactag

SEQ ID NO: 61486 - DNA, 1098 bp, Artificial Sequence
  Description of Artificial Sequence: Synthetic coding sequence
atgaacgttatttaccctttggccgtccctaaaggccgacggctctgttgcgaagtctgtgaggcccctgccgaacgtgtttgtgcggcatgcaccgttacatattactgcggagtggtgcaccagaaggcggattgggactctatccatgaaaaaatctgccagctgctcatcccccttaggacaagcatgcccttttacaactctgaagaagaacgccagcacggtctgcagcagctccaacagagacagaaatatctgatagaattctgctacaccatcgcacagaagtatctgttcgaagggaaacacgaggacgccgtgcccgcagcgctgcagtctttgcgcttcagggtgaaactgtacggtctgagctcagtggaactggtgcccgcttacttgcttctcgccgaggcctctctgggcttaggaagaattgtccaggcagaagagtacctatttcaagcccagtggactgtgctgaagtcaactgattgcagtaacgctacacattcactccttcatcggaatcttgggctgttgtacatcgcaaaaaaaaactatgaggaggccaggtaccaccttgctaatgacatttactttgccagctgcgcattcggcactgaagacattcgaaccagtgggggatatttccatctcgctaacatcttctatgatttgaaaaagctggatctggccgacactctgtacaccaaagtgagcgagatttggcatgcatatcttaacaaccactaccaggtactgtcccaggcccatatccaacaaatggatctgcttgggaaactctttgaaaacgacactggacttgacgaggcccaggaggctgaagcaattcgcattctgacgtctatattgaatatccgtgagagtacctcggacaaggccccacagaagacgattttcgttctgaaaattcttgtgatgttctattatctcatgatgaactcttccaaagcacaagagtatggaatgcgcgctctatccctggctaaggaacaacagttggatgtccatgagcagtcaaccatccaagagctgctgtctctcatttccaccgaggaccaccccatcacctag

SEQ ID NO: 61487 - DNA, 768 bp, Artificial Sequence
  Description of Artificial Sequence: Synthetic coding sequence
atgagtgctctcgatagcacagcccactttcatgccctcttgcaattccggggaaggaccgctgcttggcccgctgccgctgccgcagccgctgggctgggccgaatagtgcaggccgaagagtacctcttccaggcccagtggaccgtcctcaagtctactgattgctcaaatgccacccattcactgctgcaccgtaacctcgggctcctttacatcgcaaaaaaaaactacgaagaagcgagataccatctggctaacgacatatacttcgcttcatgtgctttcgggacagaagacataaggacatccggaggctatttccacctagctaacatcttttatgacttgaaaaagctggacctcgccgacactctgtataccaaggtctcagagatctggcatgcttacctgaacaaccattaccaggtgctgagccaggcacacattcaacaaatggatctcttggggaaactttttgaaaatgacaccggcctggacgaagcacaagaggcagaggccatccgcattttgactagtatactcaacatcagggagtccacctcagataaagcccctcagaaaacgatcttcgttctcaaaatccttgtgatgttttactatctgatgatgaattcatctaaagctcaagagtatggtatgcgcgctctgtcgcttgctaaggaacagcaattggacgtgcatgagcagagtactattcaagaactcctgagtctcataagcaccgaggaccaccctatcacctag

SEQ ID NO: 61488 - DNA, 1383 bp, Artificial Sequence
  Description of Artificial Sequence: Synthetic coding sequence
atggctcccaggtcccgaagacggagacataaaaagcctcccagcagcgtcgccccaattatcatggctccaactacgattgtgacacctgtcccattaacaccctccaagcccggtcccagtatcgacacattgggcttcttttctctggacgacaatgtccccggattgtctcagctcattctccagaaactgaacatgaaatcctatgaggaatataaattagttgtagatggcggaacacctgtgtccggttttggctttcggtgcccccaggaaatgtttcaaaggatggaggatacttttcgtttttgtgcacattgcagggcactgccatcaggcttgtcagattccaaggtgctcagacactgcaaaagatgtcgcaatgtctattactgcgggcctgaatgccaaaagagcgattggcccgctcaccgccgagtgtgccaggaactccgactggtggccgtcgaccgactgatggaatggctgctagttacaggggatttcgttctgccaagtggtccctggccctggccaccagaggctgtgcaggactgggacagctggttttcaatgaagggcctgcatctagacgcgaccctagacgccgtactggtttcccacgcagtgactacactgtgggcgtccgtgggcaggcccagacctgatccagacgtgttacagggtagcctcaaaaggctcttgactgatgttctgagccggccactgaccctcggtctgggccttcgcgctttggggatcgacgtgaggcgcactggaggttcaacagtgcatgtagtcggggcatctcatgttgaaactttccttacaaggcctggcgactacgatgagttgggctacatgtttccgggtcatctgggactgagagtggttatggtgggggttgacgtggccaccggatttagccagtccaccagcacaagtccactggaaccaggcacaatccagctctcagcccaccgcggattgtaccatgatttttgggaggaacaggttgagaccggccagacccatcacccagacttggtagctgccttccaccccggattccatagctctcccgacttgatggaagcctggctacctactttactgcttctgcgggattacaagatcccaacactcataaccgtatatagccaccaagaactggtttcaagccttcaaattttagtggaactcgatacacacattacagccttcgggagtaacccatttatgagcctcaagcccgaacaggtctacagttcacccaataagcagccggtctactgcagcgcttattatatcatgtttctgggatcttcttgccagctcgataataggcagcttgaggagaaggtagacggcggaatctag

SEQ ID NO: 61489 - DNA, 1383 bp, Artificial Sequence
  Description of Artificial Sequence: Synthetic coding sequence
atggcgcctcggagccgtcgacggagacacaagaagccaccctcatcagtggcccctattattatggcgcctacaaccatcgttaccccagtgcctctgacgccatcgaagccaggaccttcaattgacacactcggatttttcagcttagatgataacgtgccagggctgtctcagcttattctgcagaagctcaatatgaaatcgtatgaggagtataagctggtcgtcgacggagggacaccggtgtctgggttcggatttcggtgtccacaggagatgttccagaggatggaagatacctttcgcttctgcgcacattgtagagccttgccttccggactgtccgacagcaaggtactgcgacactgtaaaaggtgcaggaacgtttattattgcggtcctgaatgtcagaagtcagattggccggctcacaggagggtatgccaagagctcagacttgtggccgtggacaggttaatggagtggctgctggtgactggggacttcgtgttgccatccggtccttggccatggccgcctgaggccgtgcaggactgggattcatggtttagcatgaaggggttacatctagatgccacactcgatgcagtgctggtatcccacgctgtgaccacattgtgggctagcgtcgggcgaccaaggcccgaccccgacgtactccagggttctctcaagcggctgctgacggacgtcctgagccgtccactcaccctcggcctgggcctgcgggcactggggattgatgtgcggcgtactgggggaagcacagtccacgttgtgggggctagccacgtggaaacatttctgacaaggcccggtgactatgatgaattaggatatatgttccccggtcacctcgggctacgggtggtcatggttggggtagacgtggctaccggcttcagtcaatcaacatccacgtcccctctggagcctgggaccatccagctgtcagcccacaggggattgtatcacgatttttgggaggagcaggtggaaacaggccagacacatcacccagatcttgtggcagcattccatccaggattccacagctcaccagacctgatggaggcctggctgcccaccttgcttctgctccgagactataagatcccaacactcataaccgtttactcccaccaagagctggtgagcagcctgcagatcctggtagagctggatacacacattacagcctttggctccaacccgttcatgtctctgaagcccgagcaggtttacagcagcccgaataaacagccagtgtattgctcagcttattacataatgttcctgggtagcagctgccaattagataacagacagctggaggaaaaggtggatggaggcatctag

SEQ ID NO: 61490 - DNA, 3240 bp, Artificial Sequence
  Description of Artificial Sequence: Synthetic coding sequence
atgccgagagtccataacattaaaaaatccctgacacctcacatttcatgtgttacaaatgaatctgacaatcttctcgattttcttcccgatcgcctgagggcgaaattgctcccgtttcagaaagatggcatcatttttgctttgaaacgaaacgggagatgtatggtggctgacgagatgggcttggggaaaacaatccaggcaattggcatcacctatttttacaaggaggaatggccgctccttatcgtggtccctagtagtttacgatacccttggacagaggagatcgaaaagtggatacccgaactgtcccctgaggagattaacgttatccagaacaagacggatgtgaggcggatgtctacctctaaggtgactgtactcggatatggcttacttacagccgatgctaagaccctaatcgatgccctcaataaccagaacttcaaggtggtgatagtggacgaatcacattacatgaaatccaggaatgctactcgttctaggatcctgctcccgatcgtacaaaaagcgaggcgggctattctcctgactggtactccagctctgggacgacccgaggagttgtttatgcagatcgaagccctgttcccccagaagtttggaagatggacagattacgcgaagagatattgtaatgcgcacatacgctatttcggaaaacggccacagtgggattgtagaggcgctagtaacctgaatgagctccaccagctcctgtccgatatcatgatcaggcgtcttaagacagaagttctgacgcaacttccacctaaggtgcggcaacgcattccatttgacctacccagtgcagcggcaaaggagttgaacacttcctttgaggagtgggaaaagatcatgcgaacaccaaactccggcgcaatggagaccgtgatggggctaatcacacgtatgtttaaacaaaccgcaatcgctaaagcgggagccgtcaaggattacattaaaatgatgcttcagaatgactccttgaaattcttggtgtttgcccaccacctttcaatgcttcaggcttgcacagaggcggtgatcgagaacaagacccgctatatccgtattgatggcagcgtgagcagttctgagaggatccatctcgtcaatcagttccagaaggaccccgacaccagagtcgccatcctgtccatccaggccgcaggtcagggcctaacctttaccgccgctagtcacgttgtgttcgctgagttatactgggaccccggtcacatcaagcaggctgaggaccgggcacatcggattgggcagtgctctagtgtaaacatccattacttgattgcaaatggaacgttagataccctgatgtgggggatgcttaacaggaaggcccaggttacaggatccacgttaaatgggagaaaagaaaagattcaggctgaggagggagacaaagagaagtgggacttcttgcagttcgctgaggcctggacccctaatgactcctcagaagaactgagaaaagaagcgctatttacgcacttcgaaaaggaaaagcaacatgatatcagatcattcttcgtccctcagccgaagaaaagacagctaatgacttcatgcgatgagtctaagcgctttcgggaggagaacacagtggtatccagtgacccaactaagactgctgccagggacatcatagactatgagtccgacgtggaacccgagacaaagcggttgaagctggctgcttccgaggatcattgctccccatcagaggagactccgtcccaatctaaacaaattaggacacccttggtggagtcagtccaagaggccaaggcccaacttacgactccagcctttcctgtagagggatggcagtgcagcctgtgtacatatataaacaactccgagctgccatattgcgaaatgtgtgaaacccctcaaggcagcgccgtaatgcaaatagacagtcttaaccacattcaggataagaacgagaaggacgactcacagaaagacacctccaagaaagtccagacaatttccgattgtgaaaagcaagcactcgcacagtctgaacctggacagcttgctgactcaaaggaggagacacccaagattgaaaaagaggacgggcttacgtcccagcccggaaacgagcagtggaaaagctccgacaccctgcctgtatatgacacgctgatgttctgtgccagccgcaataccgatcgcatacacatttataccaaggatggtaagcagatgagttgtaattttattccacttgatatcaagctggacctctgggaagacttgcccgcaagcttccagctgaagcagtatcggagcctgattctgcgattcgtgagagaatggtctagcttaacagctatgaaacagcggatcatcagaaaaagcgggcaattgttttgcagccccattctggcactagaggagattaccaagcagcagaccaaacagaactgtactaagcggtacatcaccaaggaagacgtggcagtagcctcaatggataaagtgaagaacgtgggtggccacgttagattgattaccaaggaaagccgacccagagacccattcacaaagaagctgttggaagacggagcttgcgtgccatttcttaatccgtatacggtgcaggcagatcttacagtaaaacccagcaccagcaagggttacctgcaggcagttgacaacgaggggaaccctctgtgcctgaggtgccaacaaccaacctgtcagacaaagcaggcctgcaaagccaatagctgggactcacgcttctgttccttaaagtgtcaggaggagttttggatacgctccaataactcttatctgagagcaaaggtattcgagaccgagcacggggtgtgccagctgtgtaatgtgaacgcccaggaactcttccttagactccgggacgctccaaagagtcaaagaaagaatcttctgtacgctacatggacgtctaaactgcccctcgagcaactgaacgagatgattcggaatccaggcgaaggccacttttggcaggtggaccacattaagcctgtgtacgggggtgggggacaatgttcccttgataatctgcagactctatgcaccgtctgccacaaggagcggacagccaggcaggccaaggagagaagccaggtacgccgacagtctctcgcctccaaacacggcagcgatattactaggtttctcgtcaagaaatag

SEQ ID NO: 61491 - DNA, 1797 bp, Artificial Sequence
  Description of Artificial Sequence: Synthetic coding sequence
atgacttcctgcgacgagtccaaacggtttcgcgaggagaatacagtcgtgagcagcgacccaaccaagacagccgctagagatattatagattacgaatccgacgtcgaaccggagactaagcggctcaagcttgctgcaagcgaagatcattgttcaccctccgaggagacaccttctcagagtaagcagatccggacacccctggtggagtcagtgcaggaagcaaaggctcaactcacaacacccgcatttccagtggaaggctggcagtgctcattgtgcacctatattaataactctgaactcccctactgtgagatgtgcgagacaccccagggatccgccgtgatgcagatcgacagcctgaatcatattcaggataaaaacgaaaaggacgacagccaaaaggatacctcaaagaaagtgcagaccataagtgattgtgagaaacaggccctcgcccagagcgaaccgggtcagttggccgattcaaaagaggaaactcccaaaatcgagaaggaagatggactgacctctcagcctgaacagtggaaaagctctgacaccctgccagtgtacgacactttaatgttttgtgctagcagaaacacagaccgcattcacatctacacaaaggatggcaagcagatgtcatgcaattttatcccactcgatatcaagctggacctttgggaggacctgcccgctagcttccagttaaagcagtatcggagtctgatcctacggttcgtgagggagtggtcaagtctcactgcaatgaagcaaagaatcattcgcaaatccggtcagctgttctgttccccgattctggcactggaagagattaccaaacagcagaccaagcagaattgcactaaacggtacatcacaaaggaggatgttgctgttgcttccatggacaaagtcaaaaatgtaggtggacacgtgcggctgataacaaaggagtcccggcctcgggatccctttaccaagaaattgctggaagatggcgcttgtgttccattcctgaacccttatacagtacaagccgacctcacagtgaagccatcaacatccaaggggtatctacaggcagtagacaatgaaggcaacccactgtgtcttcgctgccaacagccaacatgccagacgaagcaggcctgtaaggcaaattcctgggattcccgattctgttccctgaagtgtcaagaagagttctggatcagatctaataatagctaccttagagcaaaagtgtttgagactgaacacggggtctgccagctatgtaacgtcaacgcccaagagctgtttcttcgcctgagggatgcccctaaaagccaaaggaagaaccttctgtacgcaacatggacctctaagctgccgttggaacagcttaatgaaatgattcgcaatccaggggaaggccatttctggcaggtggaccatattaaaccggtgtatggaggcggtgggcagtgctcactagacaacctccagacactctgcaccgtttgccacaaggagcgaactgccagacaggccaaggagagatcacaagtgaggagacaaagtctagctagcaagcatggctccgatatcactcggtttctcgtcaaaaagaaactccatgagtcacataaggtcactggtgctgagcagggcctgcaggtgagcgggctgcccgacagcgcggcaccagaaggtggcgctgcacatactaatgatcaacgcagatgtcaaagaatgaagcagcccttgacagaagtccaaatcctctctcattcttcgtag

SEQ ID NO: 61492 - DNA, 1107 bp, Artificial Sequence
  Description of Artificial Sequence: Synthetic coding sequence
atgggacttggcaagacaatccaggccatcggcatcacctatttctataaggaagaatggcccctcctcatcgtggtcccatcatctctgagatacccatggactgaggagatcgagaaatggattccggagttgagccctgaggagatcaacgtgattcaaaacaagaccgacgtgaggagaatgtccacctcaaaggtcactgtcctggggtacggcctcctgacagctgatgccaagacccttatcgacgctctgaataaccagaactttaaggtagtgattgttgacgagtcgcactacatgaagtcgaggaacgctactcggagccggatcctgctgcctatagtccagaaagccagacgcgctatcctgcttactggaaccccagctttagggagaccagaagagctttttatgcagatcgaagctctgttccctcagaaatttggtcgttggactgattacgctaaacggtattgcaatgctcacattagatactttggtaagcgccctcagtgggactgccgcggagcttccaatctgaacgagttgcatcagctactatctgacattatgatccgccgtctgaagacagaagttctgacacagctgccccctaaggtccgtcagcgcatccccttcgacctgccatcggcggctgctaaggaacttaacacgagcttcgaagagtgggagaagatcatgaggaccccgaacagtggcgcaatggaaactgttatgggcttgataactcggatgttcaagcaaacggcaattgcaaaagcaggggctgttaaggactatataaagatgatgctccaaaatgacagcctgaagtttctggtgttcgcccatcacctttccatgctgcaagcttgcaccgaggccgtgatagagaacaaaacaaggtacatccgcatagatggcagcgttagctcatccgagagaatacatcttgttaatcaatttcagaaggaccccgacacgcgggtggccatcctttccatacaggccgcaggccaagatctgtatgataaggtagcctggggcaaaagaaccctcgtcagtggcttgttcatggaatgtttttgcttcgtgccctag

SEQ ID NO: 61493 - DNA, 3234 bp, Artificial Sequence
  Description of Artificial Sequence: Synthetic coding sequence
atgccacgcgttcataacatcaaaaaatctctgaccccacacatttcttgcgttactaacgagtcagataatttgctggacttcctgcccgaccgcttgagagctaaactactcccgttccagaaagacggaatcatatttgcattgaagaggaatggtagatgcatggtggccgatgagatgggcctaggaaagaccatacaggcaattgggattacatatttctataaagaagagtggccgctgctgatcgtcgtgccatcatccttgaggtatccatggaccgaagaaatcgagaaatggatacctgaattatctccagaagagatcaacgtaattcaaaataagactgacgtgcgccgtatgagtaccagtaaagtcaccgtgctaggttacgggcttctgacagccgatgccaaaacactgatcgatgcgctcaataaccagaacttcaaagtggtcatcgtggacgagagtcactacatgaagagcaggaacgccacccggtcccgaattctcctgccgattgtacagaaagccagaagagctattctcctcacaggcacacctgccctgggtcgtcctgaagagctgttcatgcaaattgaagctctgttccctcaaaaattcgggaggtggacggattacgcaaaacgatactgtaatgctcatatccgatacttcgggaagcgaccccagtgggactgcaggggtgcatcaaacttgaatgagctgcaccagctgctgagcgacataatgatacgtcggcttaaaaccgaggttttaacccagctgcctcccaaggtccggcaacgtatacccttcgatctgccttcagccgctgcgaaagaactgaacactagtttcgaggagtgggaaaagatcatgagaaccccaaactccggcgcaatggaaaccgtgatgggtctgattacaaggatgttcaaacagaccgcaatcgcaaaagctggagccgtcaaagactatatcaaaatgatgctccagaatgacagtctaaagtttcttgtgtttgctcatcatctgtctatgttgcaagcgtgcactgaagcagtcatcgaaaacaaaacccgctatattagaattgatggctctgtcagcagtagcgagcggatccacctggtcaatcagtttcagaaggatcctgatacccgggttgctattctgtctatccaagctgctgggcaagggctcaccttcacggcggctagccacgtagtctttgctgagctgtattgggatcctggccacattaaacaggctgaagacagagcacatcgaatcggtcagtgctcatctgtcaatatccattatctcatcgctaacgggactttagatacattaatgtgggggatgctgaatagaaaggcgcaagtgaccggtagcactttaaacgggcgtaaggagaagattcaggccgaggagggcgataaggaaaagtgggacttcctgcagttcgcagaggcctggacccccaatgattcaagtgaggagttgcgcaaggaagcattattcacacatttcgaaaaggaaaaacagcatgatattagaagcttctttgttccacagccgaaaaaaagacagttgatgacctcttgtgatgaaagcaaaagatttcgcgaggagaataccgtagtcagctccgatccgaccaaaaccgctgcacgcgacatcattgattatgagtcagatgtcgaacccgaaacaaaaaggttgaaactggcagcgagcgaggatcattgctctccaagtgaggagacgcccagccagagcaagcagatccgcacaccgcttgtggagagcgtacaggaggcgaaggctcagttgaccacccccgctttcccggttgagggctggcaatgctcactttgcacctatatcaacaacagcgagctgccctattgtgaaatgtgcgagactcctcaggggtctgccgtaatgcagatagactctctcaatcatatacaagacaaaaacgagaaggatgactctcagaaggacacttctaaaaaggttcaaacgatcagtgattgcgagaagcaggccctggcacagtctgagcctggccagctggcggacagcaaagaggagacacctaagatcgagaaagaggacgggctaacatcgcagccagagcagtggaagtcgagtgacaccctgcctgtgtatgacactctgatgttctgcgcatcgcggaacacggatcgaatccatatttataccaaagatgggaagcagatgtcatgtaactttatcccacttgatatcaaattggacctgtgggaggatctccctgcctccttccaactaaagcaatacaggagcctgatactccgctttgtgagagaatggagctctctgacagctatgaagcaaaggatcatccgcaagagcgggcagctgttctgctcacccatcctggccctggaggagatcaccaaacagcagaccaaacagaactgtaccaagagatatatcaccaaagaggacgtcgcggtggccagcatggacaaggttaaaaatgtcggcggacacgtgcgactgataaccaaggagtcgagacctcgggatcctttcaccaaaaagctgctcgaggatggagcctgcgtgccttttctgaacccctacacagtacaggccgatttaactgtgaaaccctcaacaagcaagggctacctccaggccgtggataatgagggcaatccattgtgcctgagatgccagcaacccacttgccagaccaagcaagcatgcaaggccaacagctgggattcgaggttttgcagcctgaaatgtcaggaagagttctggattcgttccaataattcatacctgagggccaaggtgttcgagaccgaacacggagtgtgtcaactgtgcaacgtgaatgcccaggaattgtttctgcggttgagagatgctccaaaaagccagcggaaaaacctattgtatgcaacctggaccagtaagctgcctctcgaacagttgaatgaaatgatcaggaatccaggggaggggcacttttggcaggtggatcatataaaaccagtctacggaggcggtggccagtgcagcttggataatctgcagactctgtgtacagtctgtcataaggagagaaccgcgagacaggctaaggaaaggagccaggtgaggaggcagtcgctagctagcaagcacggatccgacattactagattcctggtcaaaaaatag

SEQ ID NO: 61494 - DNA, 1797 bp, Artificial Sequence
  Description of Artificial Sequence: Synthetic coding sequence
atgacctcttgtgatgagagtaagaggtttcgcgaagagaatacagtggtatccagcgatcccaccaagaccgccgctcgcgatattattgactacgagtctgacgtcgaaccggagactaagcgcctcaaacttgctgcctccgaagatcactgcagcccatccgaggaaactccaagccaatcaaaacaaataaggacccctcttgtggagtccgtacaggaagccaaagctcagctgacaactccagctttccctgtagaaggttggcaatgttctttatgcacctatattaataattccgaactgccctactgtgaaatgtgcgaaaccccccagggaagcgcagttatgcagatcgatagtttaaaccacatccaagacaaaaatgaaaaggatgattcccagaaagatacatccaagaaggtgcagacaattagcgattgcgaaaagcaggccctggcccagagcgaaccaggccagctcgctgactccaaagaagagactcctaaaatcgagaaagaggacggtctcacttcgcagcccgagcagtggaaatcctctgataccctgccggtatacgataccctaatgttttgcgcttctaggaatactgaccgcattcacatctatacaaaggacggaaagcagatgtcctgtaacttcatccctcttgacatcaaacttgacctgtgggaggacctgcctgctagcttccagctgaagcagtacagatctctgatactccggtttgtacgtgagtggagcagcctgaccgctatgaaacagcggatcatcaggaaaagcgggcagctgttctgcagtccaatcttagcactggaggagataactaagcaacagactaagcagaattgtaccaaacggtacatcaccaaggaggacgtagcagttgctagcatggataaggttaagaatgtgggtggccacgtcaggctaataacgaaagagtcgcggcctagggacccattcacgaagaagctgcttgaggacggcgcttgtgtccctttcttgaatccttataccgtccaggccgatctgactgtgaaacccagcacatccaaaggatatctgcaggccgtcgataacgagggtaacccactgtgcctgcgatgccagcagcctacctgccagaccaagcaagcatgcaaggccaacagctgggactccaggttctgttccctgaaatgccaggaggaattctggatcaggtcgaataactcttaccttcgagccaaagttttcgagacagaacacggggtgtgccagctgtgtaatgtaaatgctcaagagttgttcttgcggcttcgtgatgcgccaaagtcacagcgaaaaaacctgttgtatgcaacatggacaagcaagttgcctctcgaacaactcaacgaaatgattagaaacccaggagagggccacttctggcaggttgatcatatcaagcccgtgtatggaggcggtggccaatgcagtcttgacaaccttcagacgctctgtacagtttgtcataaggagcgaactgctcgtcaggcgaaggagagaagtcaggtgcggaggcagtctcttgctagcaagcatggctccgatatcaccaggttcctggagacatctaaactacacgagtcacataaggttacaggggcagaacagggtctacaggtttccggacttccggattcagcagccccagaaggcggagcggcacatacgaacgatcagagacggtgtcagcgcatgaaacaacccctaacagaggtgcagatactgtcccacagcagctag

SEQ ID NO: 61495 - DNA, 3234 bp, Artificial Sequence
  Description of Artificial Sequence: Synthetic coding sequence
atgcccagggtgcacaatatcaaaaaaagcctgaccccgcatatctcttgcgtgactaatgaatcagataacctacttgactttcttcctgatagactgagggctaaacttctgccatttcagaaggacggaatcatcttcgctcttaagaggaacggtagtcggattgactgcgatcagatgggcctcggtaagacaattcaggcgatcggaattacttacttctataaggaggagtggccactccttattgtagtgcccagctcattaaggtacccgtggaccgaggagatcgagaaatggataccagaacttagtcctgaggagattaatgtcatccagaataaaaccgacgtgcgccgaatgtccacatctaaggtgactgtgttgggctacggcttactgactgcagatgccaagactctgatcgacgctctgaacaaccagaacttcaaggtggttattgtcgacgagtctcactatatgaaaagtagaaacgccaccaggagtcggattcttctcccaattgttcagaaagccaggcgggctatccttctgactggaacaccagcactaggtcgccctgaagaactgtttatgcaaatcgaagctctctttccccaaaaattcggaagatggacagattacgcaaaacgatactgtaatgcccacatcaggtatttcggaaaacgcccacaatgggattgtagaggtgcttcaaacctcaatgagctccaccagctgctctcagacattatgatccggcgactgaaaaccgaggtgctcacccaattaccacctaaggtccgacaaaggatcccattcgatctaccaagcgcagcagccaaggagttgaatacatccttcgaagagtgggaaaagatcatgaggactcccaattccggcgctatggagacagtaatggggctcataacacgcatgtttaagcagacggccatcgccaaggccggtgccgtcaaggactacatcaagatgatgttacagaacgactctttaaagtttctagtgttcgctcatcacttaagtatgcttcaggcctgtacagaggccgttatcgaaaataagacccgttacattcgtatagacggatccgtctcctcttccgaacggatacaccttgtcaaccagtttcagaaagatcccgatactcgcgtcgcaatcctgtcaattcaggcggcaggacagggccttactttcactgctgcaagccacgtggttttcgcggagttgtactgggacccaggacatattaagcaggcagaggaccgggctcaccgtattgggcaatgctccagtgtgaatatccactacctgatcgcaaacggcacccttgacaccttgatgtgggggatgcttaacaggaaagctcaagtgaccggatccaccctaaatggaagaaaggaaaaaattcaggctgaagagggagataaggagaaatgggatttcctgcagttcgccgaggcatggacacccaatgactcctctgaggaactcagaaaggaggcgctctttacccattttgagaaggagaagcaacatgacatcaggtcgttctttgtgccgcagccgaagaagaggcaactgatgacatcttgcgatgagtctaagaggtttcgtgaggagaacacggtcgtctcctctgaccctaccaaaaccgctgcccgagacatcattgattacgagtctgacgtggagcccgagacaaaacgtctaaagctggcggcttctgaagatcattgttctcctagtgaggagacaccaagccagtctaaacagatcaggacaccgctcgtggagtcggtccaagaagccaaggctcaactgactacccccgcttttcctgtggaggggtggcagtgttccctgtgcacttacattaataattccgaattaccatattgtgagatgtgcgagaccccccaggggtccgccgtcatgcagattgacagtcttaaccacatccaggacaagaatgagaaggacgactctcagaaggatacaagcaagaaagttcaaaccatttccgactgcgagaagcaggccctcgctcagtctgagcccggacagctcgcagatagcaaggaagagacacccaagatagagaaagaagatggcttaacctctcagcccgaacagtggaagagctccgacacactaccagtttatgacaccttgatgttctgcgcctctaggaatacggatagaattcatatttacacaaaggacggcaaacaaatgtcatgcaatttcattcctctggatattaaactagacctgtgggaagatctgccagccagcttccagctgaaacagtacaggtccttgatactgcggtttgttagagagtggtctagccttaccgccatgaagcagcgcattatccgcaaatctggccagcttttctgcagtcccattctggcactggaagagataacaaagcagcagacaaaacaaaactgtaccaagcgctacattactaaggaagacgtagccgtcgccagtatggataaggtaaaaaatgtggggggtcacgtgcgtctgattactaaggagagccgaccaagagatccctttacgaaaaagttactggaggatggcgcatgcgttccttttctcaacccttatacagtgcaagccgacttgaccgttaaaccatctacatcaaaaggttacctacaggctgtcgataacgaaggcaatcccctgtgcctgcgctgccagcagcccacgtgtcagacaaaacaggcatgtaaagcaaactcgtgggacagtcgcttctgctccttaaagtgccaggaggaattctggatccgctctaacaactcgtaccttcgcgctaaagtttttgagactgagcatggcgtgtgtcagctttgtaatgtgaatgcacaggaacttttcttgcgtctgagggatgcaccgaagtcgcagcgtaaaaaccttctctacgcaacatggacatccaaactccctctggagcagcttaacgagatgattagaaacccaggggaagggcatttctggcaggtggaccacattaaacctgtgtacggcggtggaggacagtgctccctggataacctgcaaactctctgcactgtatgtcacaaggagcgcacagccagacaggcaaaggagaggtcccaagtcaggcggcagtcgctggcatcgaagcatggaagtgacataacccggtttctggtgaaaaaatag

SEQ ID NO: 61496 - DNA, 1794 bp, Artificial Sequence
  Description of Artificial Sequence: Synthetic coding sequence
atgacaagctgcgatgaatccaagcgttttcgtgaagagaatacagtggtctcttctgaccccacaaagacggcagctcgcgacatcattgactatgagtctgacgtggagcccgagaccaaaagactgaagcttgctgcatctgaggaccattgctctcccagcgaagagacaccaagtcagtccaagcagatccggactcccctagtcgagtctgtgcaagaggccaaggcgcagctcaccacaccggcatttccagtggaaggatggcagtgctccttgtgtacctacattaataacagcgagttgccatattgcgaaatgtgcgaaactccacagggctcggctgtcatgcagattgactccctgaatcatattcaggataaaaacgaaaaagacgatagccaaaaagatacctctaaaaaggtgcaaaccatctccgactgcgagaaacaggccctggctcagtccgaacctgggcagcttgcagactctaaagaggaaactccgaagatcgaaaaggaagatggtctcacttcccagccagaacagtggaagtcaagtgacacgctcccggtatacgacaccctgatgttttgcgcgtcccgtaacactgatcgcatccatatctacacaaaagatggaaaacagatgtcctgcaacttcatcccactggatattaagttggatctatgggaggacctgcctgcctcctttcaattgaaacagtatcgatccctgattttgagattcgtaagggagtggagttctctgaccgcaatgaagcagaggatcattaggaaatctggacaattgttctgtagccccatcttagcactcgaggagatcaccaagcagcagactaagcagaattgtaccaagcgatacataacgaaggaggacgttgcagtcgcctctatggataaggtgaaaaatgttggaggccacgtcaggttaataactaaggaaagcagacccagagacccttttacaaaaaagcttttagaggatggcgcttgcgtgcctttcttaaacccctacacagtgcaagcagacctaacggtcaagccaagtactagcaagggttacctccaagccgtggacaatgagggtaaccccctgtgtttgcgatgtcagcagcctacctgtcagactaagcaggcatgcaaggccaacagttgggactcaaggttttgctctttgaaatgccaagaggaattctggattcgatctaacaattcatatctacgggcaaaggtgtttgagactgagcacggtgtgtgtcagctgtgcaacgtgaatgcacaggaactcttcttgcggctgcgcgacgcccctaaatcccagcggaagaatttgctctacgccacctggactagcaaactgccactcgagcagctgaacgaaatgattcgaaacccgggagagggccacttttggcaggtcgatcacattaagcctgtgtatggtggtggtggtcagtgtagtctcgataaccttcagaccttgtgtaccgtgtgccacaaagaaaggacagcaaggcaggctaaagagagaagccaagtgcggagacagtctctggccagcaaacacggctctgatattactagattcctggttaagaagctgcatgaaagtcacaaggtgaccggcgcagaacagggcctgcaagttagcggattgccagattctgccgctccggaagggggagcggctcacaccaatgaccagagacgatgccagagaatgaagcagccattgaccgaggtgcagattcttagccactccagctag

SEQ ID NO: 61497 - DNA, 1902 bp, Artificial Sequence
  Description of Artificial Sequence: Synthetic coding sequence
atgctgcggagaggttacaaggctagcgagagaaggcgacacctgagcgagcggctcagctggcaccaggaccaggcactgagttcgagcatttatctgctgagggagatgggcccaaccgggttcctgctaagggaagaagaaccggagtacatggatttccgcgtgttcctcggaaacccccacgtttgtaactgctccactttcccaaagggaggtgagctgtgcaaacatatctgctgggtgctcctcaaaaagttcaaactacctcgtaatcatgaaagcgccctacaactcggactcggagagagagaaatatcggatcttctgcgtgggattcatcgcgtgcagacaccccagccgggaacaaatgacgagaacgagcacgtggaggaagacggatatattaagcagaaggagattgactctgaggatatctgctcaatttgccaggaactcctcctggagaagaaacttccagtgacgttttgtcgcttcgggtgtggcaactccattcacatcaagtgtatgaaaatacttgccaattaccagagcacatctaacactagtatgttgaaatgtccactttgtagaaaagaatttgccccattaaagttgatcctcgaagaattcaaaaattcttcaaagctggtagcagctgcagaaaaagagcggcttgacaaacacctaggtataccttgtaacaactgcaagcagtttccaattgaaggtaagtgctacaagtgcaccgaatgcattgaatatcacctgtgtcaggaatgctttgattcttgttgtcacctgagccacacattcactttccgggagaagaggaaccaaaaatggaggagtctggaaaagagggctgatgaagtggtcaagtatatagacacgaagaatgaaattgaagagaaaatgtctcactttcaggagaagcagggccaggtgtacactcctaagcatatcgtgcgcagtttaccgctacaactcattacgaaaaattctaagctgctggccccagggtaccagtgtctgctgtgtctgaaggccttccacctcggccaacataccaggttgctgccctgtacacacaagtttcataggaaatgcattgataactggctctttcacaaatgtaattcgtgcccgattgacgggcaggttatatataatcccttgacctggaaaaacagcgctgtgaacggacaagcccatcaaagtgtgtcaaatcgggacatcatccacttgtctaagcagaaggagcctgatttgttcataccgggaacaggcctcgtgctgaagcaaaatcggttaggaatcctcccgagcattcctcagtgtaattttgatgaacttaatacaccccagtcacccaaggacgcttatgagaataccacaattgacaacctgtgttccataaaactggataattcaaattctaaaaagttaacttatgactacaagatttctcagcatttcccacgctatttgcaggacttgcctaccgtatctttcggcaaaatcccttctcagacccttctccctcccatagttcacaagaacatcgtatgccctacagccatggaatccccttgtatatcagggaagtttcacaccagcctcagtaggatgaccaagggctgcaagtgcaataatcacaacctgaaaaagaccccagccaccaaaatcagggaagataataaaaggtctactttgctgcccgaagacttcaacctaattgtgaattggtcgacagcaaagctgtcactgtcaaagagatattcaaattgtatgggcgaaatcacccgtaaatgttctcacctttccagacagcccgtgtcccacagtgtgaacaccaagtctacagagttatctttaattatcgagggcgtccaactttag

SEQ ID NO: 61498 - DNA, 2091 bp, Artificial Sequence
  Description of Artificial Sequence: Synthetic coding sequence
atggaactcggaagctgtttcaaaacatacgaagacttcaaggagtgcttttcggcgtataagagagaaaaccgctgttccttcatcttgcgggactgcgttagcgttaggttccataaccttaatcacgggacaagcatcagggaagacatcctgtacgttcaggttaaatttgtgtgtattaggacccagtccaaccgtaagagaacccgggaggcagatatgtgcccagcttacctccttctgagatacaatgagcgtctggatagactgttcattagcgagctcaacacgcagcacatccacggcgacagtaaggtggcgtctccagggggagacaccaccggaaaaagtcagaaaacaatgtgcctgcaaaggctccagcccgtccagccaacaacaaaaaaagacctggataccgcggagaaaagtcttgttgagcctagtttttgcctcgataaggtgcaggttagtagtaaaccagaacaggaaggcataaccccctctgacctagcgaagattgccaaggtgatgaaaaacttcttaaaggttgacgaagggagtatggcatcattttctgtcggtgattcacaacatctggaccggctcagttttcagtccagcaagatgacagacctgtttattcggtttccagaaaaccttttactgcacagggtggaaaacacccagggtcatatactctacgcctttctggttgaaaacaaggagagggaatcccgcgtagtccatttcgccgtcctgaaagccgagaccgtgacaagcgttgctaagatgttatctatctttaccgaattcaactctgactggcccaaagtgaaggtagttttcgtagatcccagcttccattacagagcaattctccaggaaatattccctgccgctcgcatactactctcaatttatcacaccactaggctgttggaaaagaaattgcacaggtctagtgccaatcctagctttaaacgccttatgaaagaagccctcagggaggccgtcttcgtgaccagcgaggccagtctcaagaatctgtgtcaaatgagtcaggccgtactcgacgaagatcttttcaactttcttcaggcccactggtttacctgcgaacttctctggtatatgcacgtcagaaagggcctgctcgcttgtaatacttatatggacagcctggatattgtgacttccaaagtgtcatctctcttcagggaacagcagtcactgctcgactgcattctctgtttcgtggactacatcgactttttcaataccaagggtctcaagaatctgcccactcctcctcctaagctgaaacgggcacgtcccgcatcaatgcccctgaagtcgaagaaagcttttggcatttgcggcgagtccctaacctcacttcctgccgaggagaccaagcctgacgcgcagcaagtgcaggtccagcagcagtcacaggtgccaccctcacaagtgggcatgctcgacacactgcaccaatcagggagtgagctcgcctacaaactttgccacaacgagtgggaggtggttcagaactctactcatctggtggacatggccggtagctctgtagacgttcaactcctggaagacagccaccaagtttcgaaagatggctgctcctgttcctgctcctttcaacaatggtaccacctgccttgtagacatattttggcccttctccacacatctcagcagcctgtcggagaagcgatggtttgtagacgatggcagaaaaagtaccagtacctactcggacctaacggagaactgcaggatcgagggatggtcccaaacacagggcagcccgagaaacaaggccgaaacgatatgatacaggacctgagtagagaattggccaatctgctcatgcagacggaaggccctgagttggaggaacgatatagtacccttagaaagattgtagatatctgggctggccctagccaaccatctgagctattccagcagccaggggactttaaggacgtgggcagactcccttttctgtgggggaagcaggaggaaggcgaaggctttcccccagctaccgcagtgatgcactattag

SEQ ID NO: 61499 - DNA, 2073 bp, Artificial Sequence
  Description of Artificial Sequence: Synthetic coding sequence
atgaagacccggctcgagagacaggccgaaacaacatcaggccatcctagtctcgcatctctctactattggaccgctccagccctccccggaccagagttggagatggctcctcctcctcactgcgcccacaatcgctacgtgcaggtgaagttcgtctgcataaggactcaaagtaacagaaaacgcacaagggaagcagacatgtgccccgcttacctcttgctgcgctataatgaaaggctggacagattatttatatccgagctgaacactcagcacatccacggggacagtaaagtggcaagccctggaggggacacaactggaaaaagtcaaaaaacgatgtgcctccaacgtcttcagcctgtgcagccaaccacgaagaaggacctggacactgcggagaaaagtctggtcgagccgagcttttgcctggacaaagtgcaggttagcagcaagcccgagcaggaaggaatcacgccctcagaccttgccaaaatcgcaaaagttatgaagaattttttgaaagtggacgagggcagtatggcttctttttccgtgggagacagtcaacatctggatagactctcttttcaatccagcaagatgaccgacctatttattcggttccctgaaaatctcctcctacatcgtgtggagaatacacaaggacacatattgtacgcctttttagtggagaataaggagcgggaatcccgcgtggtacacttcgcagtcctaaaagctgaaacagtgacctctgttgcaaaaatgctgtcaatcttcacagagttcaacagtgactggccaaaggtgaaggtcgtctttgttgatccctccttccactatcgcgctatcctgcaggagattttcccggcagccaggatcctcctgagcatctatcacaccactaggctgttggagaaaaagctgcaccggtccagtgctaacccaagttttaaaaggctcatgaaggaagccctgcgggaggctgtctttgttacgtctgaagcaagccttaagaacctctgtcagatgtcacaggcggtcctagatgaggatctcttcaacttcctccaggcgcactggttcacctgcgagttattatggtatatgcacgtaaggaagggcctgctggcctgcaatacatacatggactccttagacattgtgacaagcaaagtaagctctttattccgggagcagcagtcccttttggactgtattctttgcttcgtcgactatattgatttctttaatacaaaaggtctcaagaatcttcccacacctccgccaaaattaaagagggctcggcctgcctcaatgcctctcaagagtaagaaagcattcggcatctgcggagaatcccttacttccctgccggctgaggagaccaagccggatgcccaacaggtccaggtgcagcagcaatcacaggtcccaccctcccaggtgggcatgttggacacactccaccaatcaggatcagagttggcatacaagttatgtcacaacgaatgggaagttgtgcagaactccacacacctcgtggacatggcaggcagtagtgtggacgtacaactcctcgaggactcccaccaggtctcgaaagacggatgtagctgcagttgctcttttcagcaatggtatcacttgccttgtcggcacattctggccctgctgcacacgtcccagcagccagtgggcgaagcaatggtctgtagaagatggcagaagaaataccaatatctgctgggcccaaacggagagttgcaggacagaggcatggtgcctaacaccggacagcctgaaaagcaggggagaaatgatatgatacaggaccttagccgcgaactggcaaatctgctgatgcagactgaggggcctgaactagaggaacggtattccaccctgaggaaaatcgtagacatctgggccggacccagtcagccatccgagctgttccagcagccaggtgacttcaaagacgtcggcaggctgcccttcctgtggggcaagcaggaagaaggcgaaggttttccgccagccaccgctgtcatgcactattag

SEQ ID NO: 61500 - DNA, 2970 bp, Artificial Sequence
  Description of Artificial Sequence: Synthetic coding sequence
atggaaccccctgccgctaagcgatcaagaggttgccctgcaggccctgaggagcgagacgcgggagcgggagcggctcgcggtaggggtcgcccagaggcactcctggatctatcggccaagcgcgtcgcggaaagttgggccttcgaacaagtcgaagagagattctctcgcgtgcctgagccggttcaaaagcgaattgtgttttggtcttttcctagatctgagcgcgagatttgcatgtactcaagcttgggctaccctccccctgaaggggaacacgatgctcgcgtcccatttacacggggactgcacctgctgcaaagcggggcagtggatagagtgctgcaggttgggttccacctgtctggtaatataagggagcctgggagccccggtgagcctgagcggttgtatcatgtgagtatatcgtttgataggtgtaagatcacctcggtctcatgcggatgcgacaaccgggacttattctactgtgcgcacgttgtcgccctcagcctttaccgtatcagacatgctcaccaggttgagctgcgcctcccaatctctgaaaccttaagccaaatgaaccgcgaccagctccagaaattcgtgcagtacctgatctctgcgcatcacacagaggtactgcccacagctcagcgtttagctgatgaaatcctcctcctggggtcggaaatcaaccttgtaaatggggctccagacccaacagctggcgctggaatcgaagatgccaactgttggcatcttgacgaagagcagattcaagaacaggttaagcaactcctatctaacggcggttattacggcgcatcacagcaattacggtctatgttcagcaaggttcgggagatgcttcgcatgcgagattccaatggggctcgcatgctgatactgatgactgagcagtttttgcaggataccagactggccctttggaggcagcagggggcaggcatgacagacaaatgccgccaactatgggatgaattgggagctctttgggtctgcgttgttctctcccctcactgtaagccagaagagcgcgctgggtggctgcaactgctgtctcggtgggacaagctggacgtttgccccctagaagaaggcaattattcattcgatggtccctcacttcaacctacaatggcccctgcacccgagctgttgcagaaaggtagcacgtgcattaccaatacagagggctgggtgggccatcccctcgaccctatagggtgtctgtgccgcgcactcctcgaggcctgtagattggaagaagagactctaacactctaccctgactctggtcccgagaagcgtaaagtggcataccagcatgtccccgtgccagggagcccgggagagtcttatctggtgctggcgctcgaagttgccctgctgggcctaggtcaacagcgcgctctgcctgaaggcctgtatgcccaagacaaagtggtgcgaaatgaggagcagcttctggccttactcgaggaggtcgaactagatgagaggctggtgcaagtgctacgaaaacaggccggtcttctgctcgagggcggacctttctccgggtttggagaagtgctgtttagggagtctgtgcccatgcacacatgcgcccgatacctgtttactgcactcctaccacatgaccccgacctggcctaccggttagcgttgagagccatgcgactccctatactcgagaccgcgttccccgctggcgagcctcacccctctccactcgacagtattatgtctaaccgcttccccagatggtttatcctgggccatctcgagacgcggcagtgtgagctggcaagtaccatgttgaccgcggcaaagggcgatcctaagtggttgcataccgtgctgggtagtatccaacagaacatccactcccccgcactgctgttcaaactcgctcaggacgcatgcaaaacagccaccccagtgtccgctcctcctgacacaactttactcggaatcgcgctggaattgggactccaggttatgcgcatgactcttaacgtgatgacatggcggaggagagagatggtgcgctggcttgtgtcatgcgcgaccgagattgggcctcaggctctgatgaatattatgcagaactggtactcgctgtttaccccggtcgaggcagcgaccatcgtggcagtgacgggcactactcatgccaccctactacgccttcagctggatacttctcggagagaagaactttgggcctgcgcccgaactctagccttgcagtgcgccatgaaagacccgcagaactgtgctttacccgctctgactctgtgtgaaaagaaccactcagcgtttgaagcggcataccagattgttctggatgctgccgctgggggactgggtcatgcacacttgttcacggttgcacgctatatggaacaccgcggtttgcccctccgggcatataagttggcgaccctagccctggcccaattgtccatcgctttcaaccaggactctcacccagctgtgaacgatgtgctctgggcttgctcactaagccatagtcttggccgacatgagctgtcagccatcgtgcccctgattatccgttccatccactgtgctcctatgctatcggatattctgaggaggtggacactctctgctcctggactcggtcctttaggagccaggcgggctgccaaacccctaggggctgacagagcgcctctctgccagctgctggacgccgcagttaccgcctacattaccaccagccactcgcgactcacacacatctcgcctcgacattacggggattttattgagttcttgggtaaggcgagggagacattcctgctggcaccagacggtcacctacagttttctcaattcttagaaaacctgaagcagacctataagggcaagaagaaattgatgttgctagtgcgagaaagatttggttag

SEQ ID NO: 61501 - DNA, 2472 bp, Artificial Sequence
  Description of Artificial Sequence: Synthetic coding sequence
atgttttctaaggtcagggaaatgttacggatgcgggacagcaacggagcacgcatgcttatcctgatgacggagcaatttttgcaggatacgcgtctggcgttatggaggcagcaaggcgcagggatgacggataaatgcagacaactctgggacgagctgggggcattgtgggtctgtgtggttctaagccctcactgcaagccagaggagagagccggatggttacagctgctttccaggtgggataaacttgacgtgtgcccactagaagaggggaactactcctttgacggcccatccctgcaacccacaatggcacccgcaccagggagcgaggaggaggaggaagtggcagccaccagtcctcggcacacagtgtttgggagagcactgctcgccggagagctgcactggaatgacgcatacttgcagcgcatcctggctagtgactcctacgggccatccttaaccggcagtgtcggcggagataaaccaacattcgatcctcagggtcggccattgtggctcggagagccctttcctacagcttgtgcccgtgttgatacccttcgtgcccacggctaccctcgtcaagccctaaggctggcctctgcaattattaataccctccgcctgcaacagagacatcagctggaaagttacaagcagcagaagaaggagcttctgcagaaaggatccacctgtatcacaaatacggagggctgggtgggacatcctctagaccccattggctgtctgtgtcgcgcactgcttgaggcctgtcgcctcgaagaggagactcttacactgtatccggatagtggacctgagaagcgaaaggtggcatatcagcatgtgcctgtgccaggctctcccggtgaatcgtacctcgtcctcgccctggaagtggcccttctaggcctggggcagcaaagagccctccctgaggggctctacgcacaggacaaggtggtgcgtaatgaggagcagctgctcgcccttctggaagaagtcgagctggatgagcggctggtgcaggtgctccggaagcaggcgggattactcttagaggggggtcccttctcgggctttggcgaagtgctcttcagggagagcgtacctatgcacacatgcgctcgctacttgtttacagctcttctgcctcatgatccagacctcgcctacagactcgcactgcgcgcaatgcggctaccaatcttggagactgcctttcctgccggtgagccccacccaagtcctcttgattcaatcatgtcaaatcgatttcccaggtggtttattctgggacacctggagaccaggcagtgtgaactggccagtaccatgctgaccgcagctaagggagaccccaagtggctgcacaccgtgctgggatcaattcaacagaacatacattcacccgctctcctgtttaaacttgcacaagacgcttgcaaaacggcaactcctgtctccgcccctcctgatacaacactgttggggattgccttagaattggggctgcaggtgatgcgaatgactctcaacgtcatgacttggcgccgtagggaaatggtgcgctggttggtgagctgtgccaccgagatcggcccacaagccctaatgaatatcatgcagaattggtacagtctctttactccagtcgaggcagccacgattgtggctgtgacgggcaccacacatgctacactactacgcctgcagctggatacaagccgtcgggaagagctgtgggcctgtgcaagaactcttgctctgcaatgtgcgatgaaggatcctcagaattgtgctctgccggctttgaccctctgtgagaaaaaccactccgcattcgaggctgcttaccagatcgtgcttgatgccgcagccggaggcctgggacatgctcacttgttcaccgtggccagatatatggaacacagaggcctgccacttagagcgtataagctcgccacccttgctctcgctcaactttcgattgcctttaaccaagacagccatcccgctgtcaacgacgtgttgtgggcatgcagtctgagtcacagcctcggccgacacgagctgtccgccattgtccctctaataattcgcagtattcactgtgcccctatgctcagcgatatcctgcggcgatggacgctgagcgcacccggactgggcccactgggggcacgcagagccgctaaacctctgggagctgatagagccccactgtgtcagctcttggacgccgcagtgaccgcgtatatcaccacaagtcatagtcgcctgactcacatcagtcctcgtcattacggagacttcattgaattcctcggcaaagccagagagacattcctgctcgcaccagacggtcatctgcagttctcccagttcttggaaaacctaaagcaaacctacaaaggcaagaaaaagctgatgctgctagtcagggagcgcttcggatag

SEQ ID NO: 61502 - DNA, 3558 bp, Artificial Sequence
  Description of Artificial Sequence: Synthetic coding sequence
atggcggatggcggtgaacgggaggagctgctcagcccctcccctgtgagccctgccaaacgccagtgtagctggccttcaccacaagctcatcatcctcgcggttcgcctggcgcagctggcggaggggctggcggtgtggggagctcgtgtctggtccttggtgcccgaccccacttacagccagatagcctgctagactgtgctgccaaaacagtcgccgaaaaatgggcatatgaacgagtggaagaaaggtttgaaaggattccagaacccgttcaaaggcgaatagtctattggagttttccacgtaatgagcgagaaatctgtatgtattcctcttttcaatacaggggcggaccgggagctggagcggcaggcggagctgcaggtgcaagccccgctgaggaggggccacagccccctccaggggctgccgcacctgcgggtagtgcccctgggggagtggccgctggggcaagtcctgggctcggggcaggagccggtgctgctggctgtggtggggaaggattaccatttaggcgaggaatccggctgctggatagcggctctgtcgaaaacgttctgcaggttggattccacttatcaggcaccgtgacagagttggctaccgcctctgagcctgctgtgacctataaggttgcgatttccttcgacagatgcaagatcactagtgtcacatgtggttgcggtaacaaggatatcttctattgcgctcacgtggtagccctgtcactgtaccgcattaggaaacccgaccaggtgaagctgaggctgcctataagcgaaacattatttcagatgaatcgagatcagctgcagaagtttattcagtatctcattaccgctcaccacaccgaagttctgcctacggcccaaaagcttgcggatgagatcttgagttcaaactctgagattaatcaggttaacggtgctcccgatcctacagctggagcttccattgacgacgaaaactgttggcatttagacgaggagcaggtgaaagagcaggtaaagctttttctatcccaggggggttactgcggctccgggaagcaattgaatagcatgttcgcgaaggtaagagagatgctgcgcatgcgcgattctaatggcgctcgaatgctcactctgattaccgagcagttcgtcgccgatcccagactcacactgtggaggcagcagggtaccaatatgaccgacaagtgcaggcagctgtgggacgaattgggagccctttgggtgtgcattattttgaacccgcactgcaaactagaagagaaaagttgttggcttcagcagctgcagaagtggtcagaccttgatgtgtgccctctcgaggacggaaattatggacatgagttgcccaatatcaccaacgctctgccccagagtgctatacactcccccgattctctttccagacctcgacgtaccgtgtttacacgcgctatagagggtcgcgaactccactggcaggactcccaccttcagaggatcattagcagtgacgtctacacggcccctgcttgccaacgcgagagcgaaaggttgttgtttaacagccagggacagccgctatggctggagcacgtgcccaccgcctgcgctagggtcgatgcactaaggtcacacggttaccccaaggaagccctaagactgacagtggccattatcaatactctaaggttgcagcaacaacggcagttggagatctacaaacatcagaaaaaggaactcctgcaacgtggaactaccaccattacaaacctggaaggctgggtaggacacccactcgaccccatagactgcttgtttcttaccctaaccgaagcctgccggctgaacgacgacgggtatctcgaaatgtcagacatgaacgagtctcgtccacccgtctatcagcatgtacccgtcgctgctgggagtccaaacagctcagaatcatacctctctctggctctggaggtcgcacttatgggcttaggacagcagcggctgatgcccgaagggctgtatgcccaggacaaggtctgccgcaacgaggaacagctcctgtctcaactccaggaacttcagctggacgatgagttggtgcagacactgcagaagcaatgcatactgctgctagagggcggtcctttctccggcctgggcgaggtgatccatcgggaatctgtgccgatgcacactttcgctaaatacctcttcagcgccctcctgcctcatgaccctgacctcagctataaactggccctgagagctatgcgacttccggttctggaaaattcagcttctgccggagacaccagccatccccaccacatggtctcagtggtcccctctcgatacccacggtggttcactctgggacacttagaatctcagcaatgcgaacttgcttctaccatgctcaccgcagcgaaaggcgatacgttgaggctacggaccattttagaggctatccagaaacacattcacagttcctcacttatttttaagctcgcgcaggatgctttcaagattgcaacacccacggatagttcaacagactctacattgctcaacgtggctctggagctaggtctgcaggtgatgcgcatgactctcagcacactcaattggcgccgaagggaaatggtgcggtggctggtcacgtgcgccaccgaggtcggcgtgcgagcactcgtgagcattctccaaagttggtacaccctattcaccccaactgaggccacatcaatagtggcagccactgcagtatctcacactaccattctgagactgtcgctcgactatccacagagagaagagctggcaagctgtgccagaaccctcgcattacagtgcgcaatgaaggatccacagagctgtgccctgagcgcactgaccctctgcgagaaggaccatattgccttcgaggcagcttaccagattgccattgacgcggcagctggtggaatgactcatagccagctcttcactatcgcccgatatatggagctgcggggttacccgttgagagccttcaaactcgcttcactggcaatgtcacacctgaatttggcctacaaccaggatacccaccccgctattaatgatgtcttgtgggcctgcgcactcagccactccctcggaaagaatgagttagctgccctcatccccctcgtggtcaagtcggtccactgcgccacggtcttaagcgacatcctccgaagatgtaccgtaacggccccaggcctggcaggtattccgggaaggaggagttctggcaaactgatgagcaccgacaaggcaccccttagacaattgctggatgccacgatcaatgcctacatcaatactacacactccagactgactcacatctcccctcgccactatggagaatttatcgagtttttaagtaaggccagagaaacattccttctcccgcaggacggacatctgcagtttgcgcagtttattgacaacctgaaacaaatctacaagggcaaaaaaaagctcatgctcctggtgcgtgagcggtttggctag

SEQ ID NO: 61503 - DNA, 3648 bp, Artificial Sequence
  Description of Artificial Sequence: Synthetic coding sequence
atggctgaaaggggtcagcagccaccgccagccaagcgcctttgttgtaggcccggagggggagggggaggtgggggatcaagtggcggtggcggtggagcgggaggaggctactcaagtgcctgtagacccggacccagggccggaggagcagcagcagccgctgcatgcggcggaggggctgcactaggcctcctgccaccaggtaaaacccagagccccgagagtctgttggatattgcagcgagacgagtcgccgagaaatggcctttccaaagggtggaagaaagatttgagcgaattcccgaacctgtacagagaagaatcgtgtactggagtttcccaagatccgagagggagatttgcatgtattcttcctttaacactggaggcggtgctgctggcggacccggagacgacagtggaggcggaggcggagcaggtggaggaggagggggtgggagtagcagctccccagcagcaacctcagccgcagcaacctctgccgctgcagctgcagctgccgctgcagccgctgctgctgccgctgctggggcaggagctccaagcgttggtgccgcaggggcagctgatggcggagatgagactcgacttccatttaggcgtgggattgctctcttagagtctggttgtgtagataatgtgctgcaggtcggatttcatctaagtgggacagttactgagcctgcgatccagtccgagcctgagaccgtctgtaacgtggctattagctttgaccgttgtaaaatcacctcagtgacctgctcctgtggcaacaaagacatcttctattgcgcccacgtggtggccctgagcctgtacaggattcggaagcctgaccaggtgaagctgcacttacccataagcgagaccctgttccagatgaaccgggaccaactccagaaattcgtccaatatttaatcacggttcaccatactgaagtgctcccaacggcccagaaactcgcggacgaaatactctcgcaaaacagcgagattaaccaggtgcacggtgcccctgaccctactgctggcgctagcatcgacgacgagaactgctggcatttggacgaggagcaggtgcaggagcaggtgaaactcttcctcagccaagggggttaccatggatccgggaagcaactgaaccttctgttcgccaaggtgagggaaatgttgaaaatgagagactccaatggtgcaagaatgctgaccctgattaccgaacagttcatggcggaccctcgactgagcctgtggagacagcagggcacagctatgaccgataagtatagacagctgtgggatgaactgggcgcactgtggatgtgtatagtcctaaatccacactgtaagcttgaacagaaggccagctggctcaaacagctgaagaagtggaattcagtggatgtctgtccttgggaggacggaaatcacggttcggaactgcctaacctgacaaacgctctcccacagggcgcaaacgcaaaccaagattctagtaatcgaccccaccgcaccgtgttcacccgggctatagaggcatgtgacttacattggcaggacagccatctgcagcacatcatctccagcgacctgtacactaactactgttatcacgatgatacagaaaatagccttttcgatagcaggggttggcctttatggcacgagcatgtcccaacggcctgtgcaagggtggacgccctgcgatcacatgggtacccacgagaggctctgaggcttgctattgcaatcgttaacacacttcgtcggcagcagcagaagcaattggagatgttccggacccagaagaaagaactccctcacaagaacatcactagtattaccaatttggaagggtgggtgggccatccactcgaccctgtgggcacattattttcttctcttatggaggcctgccggatcgacgacgagaatctctctggtttctctgattttacggagaacatgggacaatgcaagtcacttgagtatcagcatctccctgctcataagtttctggaagaaggagaaagctacctgacactcgccgtggaagttgctctcatagggctgggacagcagaggattatgccagatggtctttacacgcaggaaaaggtgtgcagaaatgaggagcagttgatctctaagctgcaggaaattgaactggatgacaccctggtgaaaatctttcgcaaacaagctgtattcctgctggaagccggaccatactctggtttgggtgagatcatccaccgggagtccgtgcctatgcatacctttgccaaatatttgttcacctccttgcttcctcacgatgcagaactggcctataagattgccctccgtgctatgagactactcgtgctggaaagtacagctccctccggggacctaacgcggccacatcacatcgcgtctgtcgtgcccaatcgctacccaaggtggttcacactcagccatatagagtcccaacaatgcgagttggcgagtacaatgctgactgccgcaaagggcgatgtccggcgactggagaccgtgctcgaatcgatccaaaagaatatccatagctcttcacatattttcaaactggcacaggacgcgttcaagattgcaaccttaatggattccctccccgacatcacactgctgaaagtttctctggagctgggtcttcaggtgatgcggatgaccctgagtacacttaattggcggagaagagagatggtacgttggctggtgacatgtgccaccgaagtgggggtatacgctctcgacagcatcatgcagacatggtttacattgttcacaccaacggaagcaacaagcattgtggcgaccacagtgatgagtaactcaaccatagtccgactccatttggattgtcatcagcaggagaagctggctagctcggccaggacgctcgctctgcagtgcgccatgaaggatcctcagaactgtgccctgtctgccctgaccttgtgcgaaaaagaccatatagctttcgaaacggcgtatcaaatcgtcttagatgctgctactacaggtatgtcctatacccagcttttcacaattgcacgctacatggaacatcgcggttaccccatgcgcgcttataaactcgcaacccttgcgatgacgcatctgaacctgagctacaaccaggacacacatcctgccatcaatgacgtgctgtgggcatgtgctctatctcactccctcggaaaaaacgagcttgccgcaatcatcccgttagtggtgaaaagtgtgaagtgcgctacagtcctgtctgatattttacgcaggtgtacactgaccacaccaggtatggttggccttcatggtaggcgcaactccggcaaactgatgagcctcgataaagccccattgaggcaactgctggatgcaactatcggagcctatattaacacaacccactctagactgacccacatttcccccagacactactctgaattcatcgagttcctgagcaaggctcgcgaaacatttctgatggcccacgacggccatatacagttcacacagtttattgacaatctgaaacagatttacaaggggaagaagaaattgatgatgctggtccgcgaacggttcggctag

SEQ ID NO: 61504 - DNA, 8885 bp, Artificial Sequence
  Description of Artificial Sequence: Synthetic coding sequence
atgggcaacgctccatctcatagctccgaggacgaggccgctgcagctggaggcgagggttggggccctcatcaggactgggcagcagtctctggcacaactccgggacctggcgtggctgctcctgccctccctcctgccgcagccctccttgagccggctaggctgagggaggctgctgcagcgctccttccaacacctccctgtgagagtctggtctcaagacaccggggtgctcttttccgatggctggaggaacgcttgggcaggggcgaggagtcagtcactctagagcagtttagggagctgctagaagcacgcggagctgggtgttcttccgagcagttcgaagaggccttcgcacagtttgatgcagagggggatggcacagtcgatgcagaaaacatgttggaagcgctgaaaaatagttccggggctaatctgcagggggaactcagtcacatcatccgacagcttcaggcttgtagcctggtgcccggtttcactgacatcttctcggaaagtaaagaaggcctggacatccatagttcaatgattctgaggtttctgcaccgcaacaggttgagcagcgctgtaatgccatatcctatgttagaacattgcaataacatgtgcactatgcggtcctccgtacttaaggaatcattagaccaactcgtgcaaaaggagaaggaaagtccaggagacctgacaaggagccctgaaatggataaacttaaatcagtcgccaaatgttacgcctatattgagacctcaagcaattccgctgacatcgacaagatgacaaacggggaaacgtcctcttactggcagagcgatggatcagcttgcagtcattggattcgtctgaagatgaaacccgacgtggttcttcgacacctgtccattgccgtggctgctactgaccagtcatacatgccccagcaagtgacagtagctgttggacgaaacgcctcagatctgcaggaagtgagggatgttcacatccccagtaatgtcacagggtacgtcaccctattggaaaacgcaaacgttagccaactgtatgtgcagataaatattaagcgctgcctgtcagatggttgcgacacgcggatccacggcctacgggcagtcggattccaacgcgtaaaaaagtcaggcgtctccgtgtccgacgctagcgcaatctggtactggtctctgctgactagcctcgtgacggcgtctatggagactaatcctgcatttgtgcagacagtcctgcacaacacccaaaaggcgctgagacacatgccccctctgtccttatctccagggagcaccgacttttccacgttccttagcccaaatgtgctagaagaagtggatagcttcctcatccggatcacctcctgctgttcaacaccagaggttgagctgactctcctggcatttgctctggcgagaggaagcgtggccaaggtgatgtcctcactgtgtaccatcactgatcacttggatacacagtatgatgcttcctcacttatcctgagtatggcgagcgttcgtcaaaaccttttgctgaagtatgggaaaccacttcagctaacactacaggcttgcgacgtaaagggtaaagaggacaagagtggtcccgagaatctccttgtggagccttggacgagagacggatttcttactgagacgggaaaaaccagagcatctacgatcttcagcaccgggacggaaagtgcatttcaggtgacacagatccgtattatggtgcggcgagggggaataggagctcagtgtggactggttttcgcttataattctagttctgacaaattttgcgccgaggagcattttaaaagattcgagaagtacgacaagtggaagttgcaggagcttcgccagttcgtgaagagccggattggctgtagttcggatgatctcggggaagatgaccccattggctggttcgaactggaggaagaatgggatgaggcagatgtgaaactccagcagtgccgggtagccaagtaccttatggtgaaatttttgtgcacacgtcaggagagcgctgaaaggctcggggtgcagggactgacaatctcaggctacctgcgccctgccagggctgaagcagagcagtcagtgacttgcgcacattgtcgcaaggatactgaagaatctgtgtgcggcgctactctccttctgcgcaccctccagtttatacaacagctggctcatgatctcgtgcaacagaaggagtcaggactgaagtacaagtcatttcttgactttgctggtctggatttgcagatcttttggaatttctactcaaaactgaaacagaaccctcgcgaggagtgcgtatccgcgcagaccctgttgttgcagctcttgcaatcctgctttagtgtcttgcaaggggatgtgctcgcagcatctgaagaggaaaaggctcccatccaaagccccaagggggttgaagctgcgaaggagctgtacacccatctgtgtgacgtggtagataaggtggacggggatagtgtccccatggagattcttaagcaagaagtgaggaacacattgctgaacggggcagcgatctttttcccaaacagacagacacggcgaaaccacttgtttacaatgatgaatgtgacggaacaggagcataagcagagcctgcagcttacttttcgttcactgtgtacgtacttctccgataaagaccctgggggattgctgttgctcccggaaaagaatgatctagcgaagatgaacatttctgaagtcctggccgtgatggataccctcgtctcggtggccgctagggaatgtgagctgttaatgctgagtggtgcgccaggagaagtcgggtctgtcttattctccctgttctggagtgttcagggctcattgctgtcatggtgttacctacagttaaaatcaaccgacagcggagcgaaggatctggccgtcgatctcatcgaaaagtacgttggtcaattcctggcaagcatgcgggctatattggaaagcctctttagtcaatattcagggaagaccatcgtggagcgcctttgcaactccgtgtttagtatggccgcaaggcagctcgtcatttttctgctcgatttctgtacccttgacatacctcattgtgtgctactgcgcgagttctcagtgcttaccgagctgctgaagaaactgtgctccgggcctgagggcggacttcgaaagttagacgtggaaacatggcagcaagaacagcccgtggttttgcatacatggacgaaggagtctgcgcacaactacgagaataattgtcacgaagtcagcgtcttcgtgagtcccggtgctacatacttcgaggtagaatttgacgaccgttgtgaaaccgagaaacggtatgactatttagaattcaccgatgctcgtggcagaaagaccaggtatgacacaaaagtcggaactgacaaatggcccaagaaggtaaccttcaaggcaggaccccgattgcagtttctattccacagtgacagctctcacaacgagtggggctacaagttcacagtaactgcctgcggtctaccagacgttgccgtgtcctggggacttgatcttcaactactggttagcaggctgatgggacggctggcctcacaatgcatggcgctgaagtcagtgcgccagctgggctctaacatggtcgtgccgcaggctaaaatggccctggtgttgagctcacccctttggaaacctgtgtttaggcaccaggtgtgccccgaactggaattagaggcttcatggcctactcacccacaccggaatagtaaagaggtgaaaaacatcccagacgacccctgtcgccacttcctgttggatttcgcccagtcagaacccgctcagaacttctgcggcccatactctgagcttttcaaaggattcattcaggcctgcagaaagcaggcacccaagacggacattgtggctggttcgaccatagaccaggccgtgaatgcgacattcgccgcactggtgtaccgcactccagacttgtacgagaagctacagaaatacgttaatagtggtggtaagatagcactgtcggaagagttcgctcaggtttacagcttagccgatggtatcagaatctggatgttggaaatgaagcaaaagtccctgatgagcctgggcaatgaagccgaggagaagcacagttcagaagcaactgaggtgaatcctgaaagtttggccaaggaatgcatcgaaaagtccctgcttctcctgaagttcctgcccactggtatctcatcaaaggagtcgtgtgaaaagctagagaccgcggacgagacgtcacaccttcaacctctcaataagcgccaacggactagctccgtggtcgaggaacatttccaggcttcagtgagccctaccgaggccgcaccacccgctaccggcgaccagagcccaggattgggcacgcagccgaaactcccctccagttcaggattgcctgccgcagacgtaagtcctgcaaccgccgaagagcccttgagtccctctacccctacccgccgtccaccatttacccggggacgcctgcgattgctttctttcagatcgatggaggaggccagactggtgccgacggtgaaggaaaaatatcctgtcttaaaggacgtcatggatttcattaaagatcagtcattgtcgcacaggagcgtcgtgaaggtcctgagccttcgtaaagctcaagcacagagtatcttagaagtgctcaagattacccagcattgtgcagagagcttggggcagccccactgctttcatccacccttcattttgtttctgctagagctgctgacctgtcaaaaagatttcaccaattattttggacatctggagggatgtggcgctgatctgcataaagagattcgcgacacatactaccagctggttctgtttttggtaaaggcggtcaaggggttttccagtttgaacgacaggtccctactgcccgctttatcatgtgtgcagactgcacttctgcatttgctagacatggggtgggagccaaacgacctggcattcttcgtggatatccagctccctgatctcctcatgaaaatgtcacaggagaatatctcagtgcacgatagcgtgatcagccagtggtctgaagaagatgagttagcagacgccaaacaaaatagcgaatggatggacgagtgccaagacgggatgttcgaagcttggtacgaaaaaatcgcccaggaggaccccgagaagcagaggaagatgcacatgtttatcgcccgttattgtgacctcttgaatgtcgatatcagctgcgacggttgtgatgaaatcgccccatggcaccgctaccgctgcctccaatgcagtgatatggacctgtgtaagacttgctttctgggcggagtgaagcctgagggccatggagacgatcacgagatggtcaacatggagttcacctgcgaccattgtcagggcttgatcatcgggcgacgcatgaactgtaacgtctgcgatgacttcgatctgtgttatggttgctatgctgcaaagaagtactcttatggccacctgccaacacattcaatcactgcccaccctatggtgacaatccgcattagcgacaggcagagactgattcagccttacatacacaattattcgtggttgctgttcgcagccctcgccctctatagcgctcatctggcctcggctgaggatgtcgacggagaaaaattagatccccagacgaggagttccgcaacaacccttcgctcccagtgcatgcagctggtcggggactgcctcatgaaggctcatcagggaaaaggtctcaaggccctggcactactcggggtacttccagatggcgacagttcactagaggaccaggccttaccagtaacagtcccaacgggtgcgagcgaagaacagctggaaaaaaaggccgtgcagggagcagagctcagcgaggccggtaatggcaagcgagccgtgcatgaggaaattcgacctgtggattttaaacagagaaacaaggcagataagggggtaagtctctcaaaggatccgtcttgtcaaacacaaatcagtgactcccccgcagatgctagtcctccaaccggcctgcctgatgcagaggacagtgaagtatcctctcagaaacctattgaggaaaaggccgttacaccttcgcctgaacaggtattcgccgaatgctcacaaaaacgtatattaggcctgctggccgcaatgctccctccactcaagtccggacccactgtcccattaattgatctagagcacgtgctaccactcatgttccaggttgtcatctctaatgctggccacctgaacgagacttatcacctgaccctcgggctgctgggccagctcataatccgactgctgccagctgaggtcgacgccgctgtgattaaggtcctgtccgccaagcacaacttgttcgcagctggagactcatcaatcgtgcccgacgggtggaaaaccacacacttgctgtttagcctgggcgctgtgtgtctggattcacgcgttggcctggactgggcgtgttcaatggccgaaattctccggtcattgaattctgcccctctgtggcgcgatgtgattgccaccttcaccgatcactgcatcaagcagctgcctttccagttgaaacacacgaatatatttaccctcctggtgctagttggattccctcaagtgctgtgcgtcggcacccgctgcgtgtacatggacaacgcaaacgagccccacaacgtcatcattcttaaacacttcactgaaaaaaacagagccgtgattgtggatgtgaaaactcgaaagcggaagaccgtcaaagactatcagctggtccagaaggggggtggccaggagtgcggggatagccgggctcagttgtctcagtactcacaacactttgcctttatcgcaagccatctgttgcagtcctctatggactcccattgtcccgaggctgtcgaggctacatgggtcctgagtttagcccttaagggcctttataagaccttaaaggctcatggtttcgaggagatccgggctacatttctgcagaccgacctgctaaaactcttggtgaagaaatgttccaagggaacgggcttttctaagacttggcttctgcgcgacctggagatcctttccattatgctgtatagcagcaagaaggagataaatgcccttgccgagcacggggatttggagctggatgagagaggggatcgtgaggaggaggtggagcgccctgtgtcctcaccgggagatccagagcagaagaagctcgaccctctcgagggacttgacgagccaacgcggatttgtttcttaatggctcatgacgccttgaacgcaccccttcacatcttacgggcaatctacgaactgcagatgaagaaaaccgactacttttttctggaagttcagaaaaggttcgatggggacgaactgaccacagacgaacggattcgatcgttggcacagagatggcaaccttcaaagagccttcggctcgaggaacaatctgctaaggctgtggacactgacatgattatactgccctgtctgagtaggccagccagatgtgatcaggccactgccgagtcaaatcctgtcactcagaaactgatcagttccaccgagtccgagcttcagcagagttatgctaaacaaagacgctccaagtcagccgctctactccacaaggagttaaattgtaagtcaaagagggctgtgcgggactatctgtttcgggtcaacgaggctactgcagtcctttacgccagacacgtgctcgcctccctcctagccgaatggccttctcatgtgcctgtgtctgaggatatcctcgaactctcaggcccagcccacatgacgtacattctggacatgttcatgcagcttgaggaaaagcacgagtgggagaaaattctgcagaaggtgctgcaagggtgtagagaggacatgctgggaacgatggccctagctgcctgccagtttatggaagaaccaggaatggaggtccaagtacgcgagtctaagcatccttataacaataacactaacttcgaggacaaagttcacatcccaggcgctatttacttgagcatcaagttcgattcacagtgcaacacagaggaagggtgcgatgagttggccatgtcatcgagtagcgacttccaacaggatagacactcattcagcggaagccaacaaaagtggaaggactttgaattgccaggggacaccctttactaccggtttacctcagatatgtcaaacaccgaatggggatacaggttcactgtcaccgccggacatctggggagattccaaaccggcttcgaaatcttgaagcagatgctgtccgaggaacgcgtggtcccccatttgccactcgccaagatctgggagtggttggttggggttgcttgcagacagacaggacaccagagactaaaggccatccatctgctcctgaggatagtgcgctgctgtggacactcggacctgtgtgatctggccttgctcaaacccctgtggcagctgtttacccatatggagtacggactcttcgaagacgtaacccagcccggtatattactgcctttacatcgggcactcactgagttatttttcgtgacagagaatagagctcaagagctaggagtgctccaggactatctcttggcgctgaccacagatgaccaccttctgcggtgtgctgctcaggccctccaaaacatagctgcaatctctcttgcgattaattaccccaataaagcaaccaggctgtggaacgtggaatgcta

SEQ ID NO: 61505 - DNA, 588 bp, Artificial Sequence
  Description of Artificial Sequence: Synthetic coding sequence
atgggcgtgtggggtaagaagcacttaagactcactcacgctccatctccaacttttagtcatttgcccccttctcctcaggcaggcgaaccagggatcgatgggatatcgttggccgtggtgtgtgcggcatttataaggattcacccagccagacgccatccagcacgcaacgggtctcgcctggcctgcacgcctacgccgagacccaacgctggactggaagtcgtgagttccgccagagtggctgcatcgttgccgtcagagggtggctggacatccggcgctcctaggtcttcggggcttagcctgcccggttccgcatggcagccacccccactcccggtgctgagaaagcctgcatggccagggtcccctgcggtgaagaacgaaagtaaattcccgaaccgcggatctcggaattttccacgtcgacggctccccccagcccctgtgagtggggaacccccagaaaggtgcaaacttgctagggagatccgttggagactctggaaagcccacgaaggatggggcggaggcgctaaacggccactgggcgaccctgcctggagtggcgttaagagatag

SEQ ID NO: 61506 - DNA, 7871 bp, Artificial Sequence
  Description of Artificial Sequence: Synthetic coding sequence
atggtgccccctgtgtggaccctcctgctgttggtgggcgctgctctgtttcgaaaggagaagccaccagatcagaaactggtggtgcggtcgtcccgtgacaattatgtgcttactcaatgcgactttgaagacgacgctaagcccctgtgcgactggagccaggtgagcgctgacgacgaggattgggtacgcgcttccggaccgagtcctacgggatccactggggcacctggcggttaccctaatggcgagggttcttatcttcacatggaaagtaattcatttcatagagggggagtggcacgcctgctgtcaccagacctctgggaacagggtcccctgtgtgtccactttgcccaccacatgttcggcttgtcctggggcgcacaactgaggctgctactgcttagcggcgaggaagggcgtaggccggatgtgctatggaagcactggaacactcaacgcccttcctggatgctgacgaccgtgacagtacccgctggatttacgctccccactcgcttaatgtttgaaggcacaaggggcagtaccgcctacctggacatcgctctggatgcactgtcaattcgacggggtagctgcaaccgggtgtgtatgatgcagacgtgttctttcgacatccccaatgacctgtgcgactggacatggatacccactgcatctggggcaaaatggacacagaagaagggatcctctggcaagcccggagtcgggcctgacggcgacttctccagtccgggtagcgggtgttatatgcttctcgacccaaagaacgcccgacccggacagaaggccgtgctgctcagccccgtttctctttctagtgggtgcctcagcttttcgttccattacatccttcgcggacagtcccccggagcagccctccatatctacgcttccgtactgggctccattcgaaaacatacactgttttcaggccagcccggacccaattggcaagctgtgagcgtaaactacactgcggtcggccgtatccagttcgcagtagtgggcgtgttcggtaaaactccagagcccgctgtggctgtcgacgccacgtccatagcaccgtgcggggagggttttccccagtgcgatttcgaagataatgcacatcccttttgtgattgggttcagacaagtggagacggtgggcactgggcattggggcataaaaacgggccagtgcatggaatggggcctgcaggcggtttccccaacgccggtggacattatatttacctggaagcagatgagtttagtcaggctggccaatccgttcgcctggtaagcaggcctttctgtgcgcctggggacatttgcgtggagtttgcgtaccacatgtacggcttgggtgaaggaacgatgctggaattgctcctaggctccccagccggaagcccccctattcccctctggaagagggttgggtcccagcggccatactggcagaacacttcagtcactgtaccttcaggacatcagcaaccaatgcagctgatattcaagggtattcagggctccaataccgccagcgtcgtggccatgggcttcatcttgatcaatcccggaacgtgccccgtcaaagtgctccccgagctgcctcctgtctcccctgtcagtagtactgggcctagcgaaacaaccggactaacagagaatcctacgatttcaactaagaagcctaccgtttccatcgagaagccaagtgtaacaacagagaagccaacagtgcccaaagagaagcccacaattccgacagaaaaaccaacaatttccaccgaaaagcccactattccaagcgagaagcctaacatgccctcagagaagcctactatcccctcagagaaacccacaattctgacagaaaaacctaccatcccctcagaaaagccaacaataccatctgaaaagcctaccatcagcacagagaaacctacagtgcctaccgaagaacccaccactcccacagaggaaactaccactagcatggaggaacccgtgatccctaccgaaaaaccgagtattccgactgagaagccttcgatccccactgaaaagcccacgatcagcatggaggagaccataattagcacagagaagcccaccatctctcccgagaaacctacgataccaacagaaaaacccaccatccctacggaaaagagcacaattagcccagagaaaccaacgacccctactgaaaaaccaactattcctacagagaagccaacaatcagccccgaaaaacctaccactccaactgagaaacccacaattagcccggaaaagttaactattcccacagagaagcccacaatccctactgaaaagcctactatcccaacagagaagccaactatttcgaccgaagaacccacaacgcctaccgaggaaacaaccatatcgaccgagaagcccagcattcctatggaaaagcctaccctaccaaccgaagagacgaccacatccgtcgaagaaacgacaatcagcaccgagaagctaaccattccgatggaaaaacctaccatctccacagaaaagccaactatccccacagagaagcccaccatttctccagaaaagctaaccattcccactgagaaactaacgatcccaacagaaaaacctacaataccaatcgaggaaaccactataagcacggagaagctgacgatcccaacagaaaagccaactatttcaccagagaaacccaccatatctactgagaagcccacgataccgaccgagaagccaaccattcccacagaagaaaccactatcagcactgagaagctgacgatccccacagaaaaaccgaccatctcccccgaaaaattaaccattcccacagagaagcctactatttcaacagagaagcctacgatccctaccgaaaaattgactattcccaccgaaaaacctactatcccaacagaaaaaccaacaatcccaaccgaaaagctaaccgcactccgccctccacacccatctcctaccgctactggtctggctgctttggtgatgtcacctcacgcacccagtaccccaatgacttcggtgatccttggtacaaccactaccagtaggagcagtaccgagagatgccctccaaatgccagatacgagtcatgcgcatgtcccgcaagttgcaagagccctaggcccagctgtggaccgctgtgtagggagggatgcgtgtgcaatcctgggttcctgttcagtgacaaccattgcattcaggcaagttcctgtaactgtttttacaataatgactactacgagcccggagccgaatggttctcgcctaattgcaccgaacactgccgctgctggccaggtagtcgagtcgaatgtcaaatttcccaatgtgggacacatacagtctgtcagctgaagaatggacagtacggatgccacccatacgctggaactgccacttgcctggtctatggggaccctcactatgtaacgttcgatggaaggcactttggctttatgggcaaatgtacatacatcctcgcacaaccgtgtggcaactccaccgacccgtttttcagggttactgcaaagaacgaagagcaggggcaggaaggagtgtcatgccttagtaaggtgtatgtcaccctgccagagagcaccgtgaccctgctcaagggaaggcgaactctggtgggaggccaacaggtaactctccctgccattccatcaaagggggttttcttgggagcaagcggcaggttcgtggagcttcaaaccgaatttgggctgagggttcgttgggacggggatcagcaactgtacgtcactgtatcttccacctacagcggcaagttgtgtggcctgtgcgggaactatgacggcaattccgacaatgatcacctaaagctagacggttctccagctggagacaaggaggaattgggtaattcctggcagactgatcaggatgaggaccaagaatgccagaaatatcaggttgttaactcccccagctgtgacagcagcttacagtctagtatgtccgggcctggtttctgcggaaggctggttgacacccatggcccttttgaaacatgcctcctgcacgtaaaggccgcaagcttctttgactcttgtatgctggatatgtgcggttttcagggactccagcacttgctgtgtacacacatgtcaaccatgacaaccacctgccaggacgccggtcacgctgtaaaaccctggcgcgaaccccatttttgccctatggcatgccccccaaatagcaagtatagtctgtgcgccaagccttgtccggatacttgccattctggcttctcaggcatgttctgttctgaccgttgcgtggaggcctgtgaatgcaacccaggcttcgtgctcagcgggttagagtgtatccctcgctcccaatgtggttgcctgcaccccgctggctcttacttcaaagttggggaacgatggtataaaccagggtgtaaggagctttgtgtatgtgagtctaataacagaatcagatgccagccctggaggtgccgcgcacaggagttttgtggccagcaggacggtatctacggttgccacgctcagggtgcagctacatgcaccgcttccggagacccacactatttaaccttcgatggagctctgcaccacttcatgggcacatgcacttatgtactcactcgaccttgctggtctagatcacaagatagctattttgtcgtctccgcaaccaatgaaaaccgcggtggtatcctggaggtgagctatatcaaggccgtgcatgttacagtattcgatctctcgataagtctgctccgagggtgcaaggtgatgctcaatgggcatagagtggccctacctgtctggctcgcccaggggcgagtcaccataaggctgagtagtaaccttgtgctactgtacacaaactttgggttgcaagtgcggtacgacggctctcatcttgttgaagtgaccgttccctcctcttacggcggtcagctatgtggtctttgcggtaattataacaacaactcactcgatgataacttgaggccagataggaagcttgctggggactctatgcagctgggggcagcctggaagctgcctgagagctcggagccaggttgttttctcgtaggaggcaagcccagcagctgccaggaaaactccatggccgacgcttggaataagaactgcgcgatactcattaaccctcaggggccatttagccaatgtcaccaggttgtgcctccacagtcctccttcgcttcatgcgtccatggccagtgtgggacaaaaggagacaccactgccctttgtcgatccctgcaggcatacgccagcctgtgcgcccaggccggacaggccccagcatggcggaacaggactttctgccccatgaggtgcccgccaggcagctcgtactctccttgctcgagcccctgtcctgacacttgttcctcaatcaataaccctcgggattgcccaaaggccctcccatgcgcagagtcttgcgaatgtcagaaagggcacattttgagtggaactagctgtgttcccttaggtcaatgcgggtgtacggatcctgcgggatcctaccacccagtaggagaacgatggtatactgagaatacctgcacaaggttgtgtacctgctcggtccacaacaatattacatgctttcaatcaacttgcaagccaaaccaaatctgttgggcactcgatggactgcttcgcagagcatccggagtgggcgtctgccaattgccgggagagtcccactatgtgtcttttgacggcagtaaccactcaatccctgatgcttgcaccctggtgcttgtgaaggtgtgccacccagccatggcccttcccttcttcaagatcagcgccaagcacgagaaggaagaggggggaactgaggcgtttaggttacatgaagtttacatcgatatctacgacgctcaggtcaccctacagaagggacacagagtgctcattaactccaaacaggtgaccttgccagcaatctcccagatccctggggtatctgtaaaaagttcatccatctatagcatcgtgaatattaaaattggggtccaggtgaagtttgatggcaaccatctcctggagatcgaaattcctacgacttattacgggaaggtgtgtggcatgtgcggcaactttaatgatgaggaagaagatgagctgatgatgcccagcgatgaagtggcaaatagtgattctgaattcgtgaactcttggaaggataaagacatcgacccaagttgtcaaagcttgctcgttgacgagcaacagatccccgcagagcagcaggaaaatccctcaggcaattgccgggcagcagatctgagacgcgctcgagaaaagtgcgaggcggcactccgcgctcccgtgtgggctcagtgtgcttctcggatcgatctaaccccatttttggtcgattgtgcaaacacactctgtgagtttggtgggctataccaggccctttgccaggcccttcaggcatttggtgctacctgccagagccaaggtttgaaaccacctttatggaggaattcgagcttctgtcctctcgagtgccctgcttactcctcatatacaaactgtctgcctagctgtagcccatcctgttgggacctggacgggcgttgcgagggcgcaaaggtcccctcggcatgtgctgagggatgcatctgtcagcctggttatgttctgtctgaagacaagtgcgtaccacgcagtcaatgtggttgtaaggacgctcacggcggatccattccgctcgggaaatcttgggtgagttcaggctgtaccgagaaatgcgtttgtaccgggggtgccatccagtgtggcgattttcggtgcccgtccggttcccattgccagcttacgagcgacaactccaacagtaattgcgtgagcgataaatctgagcagtgctcggtttacggagatcccaggtacctgacttttgatggcttctcttatcgcctccagggccgtatgacctatgtcctgattaagacagtagatgtgttgccggagggagtggagcctttgctggtcgagggcagaaataagatggacccgccaagatcctctattttcctacaggaggttattaccaccgtgtatggctataaggtgcagctgcaagccggtctagaattggttgtcaataaccaaaaaatggcagtcccttaccgcccaaatgaacacctgcgtgttactctttggggccaaaggctgtatcttgtgacagactttgagcttgtcgtgagttttggtggtaggaagaacgctgtgatcagtttacctagcatgtacgagggccttgtgtccggcctttgcgggaactacgacaagaaccgcaagaacgacatgatgttgcccagtggagcattgacccaaaaccttaatacgtttggaaactcttgggaggttaaaaccgaggacgctctccttcgctttcccagggctatcccagcagaggaagagggccagggagccgagttaggactgaggacggggctccaggtttccgagtgcagtcctgaacaactagcttccaacagtacccaggcctgtcgggtcctggccgacccccaaggaccttttgctgcctgccaccaaacagtcgctcccgagccattccaggaacactgcgtgctggacttgtgctctgctcaagatcccagggaacaggaggagctgcgttgtcaagtgctgagtgggtacgctatcctgtgtcaggaagccggtgccgctctagccggttggagggatagaacactctgtgcaggccagcagttgtccgatta

SEQ ID NO: 61507 - DNA, 8066 bp, Artificial Sequence
  Description of Artificial Sequence: Synthetic coding sequence
atggtacctcctgtgtggaccttgttactcttagtgggcgcagccctgttccggaaggagaaaccaccagaccaaaagctggttgtgcggtctagtagggacaattacgttctcacccagtgcgacttcgaggatgacgctaagcctctgtgtgactggtcgcaggttagcgccgacgatgaggattgggtacgtgctagcggtccttcacccactgggtcgacaggagccccaggaggataccccaacggcgagggtagctaccttcacatggaaagcaactctttccatcgcggaggagtggcgagattattgtcccctgacttgtgggaacagggaccactttgtgtacatttcgctcatcacatgtttggtctgagttggggtgctcagttacggctgctactgctctcaggcgaagaaggacgaaggcctgatgtgctttggaagcactggaacactcaacgcccttcctggatgcttactacggttacagtcccggcaggcttcacattgcctacccgcttaatgttcgaggggaccaggggcagtacagcttatctggatatagctcttgacgcattgagcattcgccgtggctcctgcaacagagtttgtatgatgcagacatgttcattcgatatccccaatgatctgtgcgactggacctggattcccacagccagtggtgccaaatggacccagaaaaaaggatcatccggcaaacccggagtcggcccagatggcgacttcagttcgcctggcagcgggtgctacatgctcctcgatccaaaaaacgcccgtcctggacaaaaggcagtcttactgtcacccgtcagcctgtccagcggatgcctcagcttcagtttccattatatcttgcgaggccagagccccggagctgctcttcacatttatgcctcagtgctgggttccattagaaaacacacacttttctcagggcaaccaggtcccaattggcaggccgtgtcagttaactacaccgccgtgggcagaatccagttcgcggtggtgggcgtcttcgggaaaacacctgaaccagctgtggccgtagacgccacaagcatcgcgccatgcggagagggatttccccagtgcgactttgaggacaacgctcatcctttctgcgactgggttcagacctctggcgatgggggacattgggctttagggcataagaacgggccagtgcacgggatggggccagccggaggctttccaaacgctgggggtcattacatctacctcgaagctgacgaatttagccaagcaggacagtcagtaagactagtctcacgtccattctgcgctcctggtgacatttgtgtagagtttgcctaccatatgtatggacttggcgagggcacaatgttggaactgctgctcggatcccctgccggatcgccccctatacctttatggaaaagggtcggatcccagaggccctactggcagaacacgtccgtgaccgttcccagcggccatcagcaacctatgcagcttatcttcaagggaattcaaggaagcaatactgcatcagtggtggcaatggggttcattcttatcaacccgggaacatgcccagtcaaggtactgccggagctcccacctgtctcccccgtatctagcacgggcccttccgagactacaggtcttactgagaacccaaccatcagcacaaaaaaaccaaccgtttcgatcgaaaagcccagcgtgactacagagaagcccactgtacctaaggagaaacctacaataccaactgagaaaccaacaatcagcaccgaaaagcctactattccttcagagaaaccaaacatgccatctgaaaagcccactattccctccgaaaagcctacaattttaaccgagaagccgaccataccctctgagaaacccacgattcctagcgaaaaaccaaccatctcgactgagaaaccaactgtgccaacagaggagcctacgaccccgacagaggaaacgaccaccagcatggaggagcctgtaatccccaccgagaagccgtcgatacccacagaaaagccttccattccaaccgaaaaacccaccatctcaatggaggaaaccatcatctctaccgaaaaaccgacaatctctcctgagaagccaacaattcctacagagaaaccaactatacccaccgaaaagtccaccattagtccagagaagcccactacgcccaccgaaaaacccaccattccaaccgagaagcctactatatctcccgagaagcccacaacacccacggaaaagcccactataagtcctgagaaactcaccatcccgacagagaagcctactataccaacagaaaaaccgaccattcccactgagaagcccacgatctctaccgaggagcctaccactccaaccgaggagactacgataagcaccgaaaagcctagcattcctatggagaaaccaacccttcctactgaggagaccactacatccgttgaagagactactatcagcaccgaaaagttgaccatccccatggaaaaaccgacgatatcaaccgaaaaacctaccatccccaccgagaaacctactatctcgcccgagaagttgaccatcccaaccgaaaagctgacgatacctacagaaaagcctaccatccccattgaggagactactatttctactgaaaaactgaccatcccaacagagaagcctactatctctccagaaaagcctactatttctaccgagaagccgactatccctaccgagaaaccaaccatccctaccgaggaaactacgatcagcactgagaagctcactattcccacagagaaaccaacgattagtcccgagaagctgacaatcccaaccgagaagcctactatttccactgaaaaacccacaatccccaccgagaagctgacaatcccaacagagaaacctaccatacccacagagaaacctactatccctaccgagaaacttaccgccttaaggccacctcacccttctcctaccgcaacggggttggccgcactggtgatgagtccccatgccccatcaactcctatgaccagcgtgatactggggactaccaccacgagtcgctcatccactgagagatgcccaccgaatgccagatacgagtcttgtgcctgccctgcctcctgcaagagtcctcggccttcctgcggccctctgtgccgagaggggtgtgtgtgtaatcctggcttcctcttcagcgacaaccactgtattcaggctagttcttgcaattgcttctataataatgactactatgagcctggcgcagaatggttttccccgaactgcactgagcactgtcgctgctggcccggatccagagtcgagtgccagatctcccaatgcggaactcatacggtttgtcagttgaagaacggacaatatggctgtcacccctacgccggtacagctacatgcttggtgtatggcgacccccactatgttaccttcgatgggcgacatttcgggtttatgggcaagtgcacatacatcttagcccagccttgtggaaattcaaccgatccgttcttccgcgtgacggccaaaaacgaagaacaagggcaggaaggggtgtcctgtctttctaaagtttatgtaactttgcctgagagtacagtgaccctgctgaaagggcgtaggacactggtcggtggtcagcaggtgaccctacccgcaatcccaagcaagggtgtgtttctcggagcctctggacgcttcgtggagctgcaaacagagtttgggttgcgcgtcaggtgggacggcgatcagcagctctatgtaactgtctctagcacctactccgggaagctgtgtggtctttgcggaaattacgatggaaactcggacaacgatcacctaaagctcgacggcagcccggctggagataaggaagagctggggaattcatggcagaccgaccaagacgaagatcaagagtgccagaagtaccaggtggtaaattctccgtcatgtgactccagcttacagtcttctatgtcaggacctggcttttgcggcaggctggtcgacacccacggccctttcgaaacttgcctattgcacgtaaaagcggcttcttttttcgactcttgtatgttggatatgtgcggcttccagggcctgcagcaccttctgtgcacgcacatgtccaccatgacaaccacttgccaagatgccggacacgccgtaaagccctggagagagcctcatttctgcccaatggcctgccctcccaactcaaagtacagcctatgcgccaagccatgccctgacacgtgccactcaggcttttcaggaatgttttgtagtgaccggtgcgtcgaagcgtgtgagtgcaaccctggattcgtgttgtcgggtttagaatgcatccctcggtcccagtgcggttgtctccatccagccggatcttacttcaaggtgggggagcgatggtataagccaggttgcaaggaactctgcgtgtgcgaaagcaataaccggatacggtgtcaaccttggagatgcagggctcaggagttttgtggtcaacaggatggtatttatgggtgccatgcacagggcgcagcaacgtgcaccgcctcaggggacccccactacctaacgtttgatggtgcactgcaccattttatgggcacatgcacctatgtccttacaagaccatgttggtcccggtcccaggattcctatttcgtggttagcgccacgaacgagaaccggggaggaatcctagaagtgagttacattaaggcggttcatgtgacagtctttgatctcagcataagcctcctcagggggtgcaaagtcatgttgaacggacatagagttgccctgccagtgtggctggcgcagggacgcgtgactatccgactgagctccaacctcgtgctgctttacaccaactttggcttgcaagtgcgctacgacggaagtcatctggtcgaagtgacggtgccgtcttcctacggcggacagctgtgtgggctatgtgggaactataataacaactcacttgatgataacctcaggccggaccggaagctcgctggcgactctatgcagctcggcgctgcttggaagctgccggagtctagtgagcctgggtgctttctggtggggggaaaaccgagcagctgtcaggagaactctatggccgatgcatggaacaaaaattgcgccatcttgattaatccccagggaccttttagccagtgccatcaggtggtgcctccacagtcatcctttgcatcatgtgtgcatggccagtgtgggaccaaaggcgacaccactgccctgtgccgcagcctgcaggcttatgcatcgctgtgtgctcaggcgggacaggcacccgcatggagaaacaggacattctgtcccatgcggtgccccccaggaagcagttacagcccttgtagctctccatgccccgacacgtgtagcagtatcaacaacccacgagactgccctaaagctttgccgtgcgctgaatcctgtgaatgccaaaaggggcacatcctcagtggcactagttgtgtccccctagggcagtgcggatgcacagacccggcaggtagttatcaccctgtgggggaacggtggtacactgagaacacttgcactcgtctctgcacctgctcagtgcacaataatataacctgctttcaaagcacctgcaaaccaaatcagatctgctgggccttggacggccttctgcggagagcaagtggagttggcgtctgccaactgccgggtgaaagccattacgtctcttttgatggctctaaccactcgattccagacgcctgtactctggtgttagttaaggtgtgtcaccccgctatggccttgccgtttttcaagattagtgccaagcacgaaaaagaggagggaggcaccgaagcattcaggttacatgaagtgtacatcgatatttatgacgcccaggtgaccttacagaaagggcatagagtgcttattaattctaagcaagtcacccttcccgcaatttcccaaattccgggtgtgtccgtcaagtctagctccatttactctatcgtcaatatcaagatcggagtgcaagtcaaatttgatgggaaccatcttctagagatcgaaatacctacgacttactatgggaaggtttgcggaatgtgcggaaacttcaacgatgaggaggaagatgaactaatgatgcctagtgacgaagttgcaaacagtgactcagaatttgttaacagctggaaggataaagatattgatccgtcctgtcagtctctactggtcgacgaacagcagatcccagccgagcagcaagagaacccttcgggcaactgtcgcgctgcggatttgagacgcgcacgcgaaaaatgtgaggctgccctgcgggctccggtctgggctcagtgtgcaagcaggattgacctgacaccattcctggtggattgcgccaacaccttatgcgagtttgggggtttatatcaggctctatgtcaggcactgcaggcatttggcgctacctgccagtctcaggggcttaagcccccactgtggagaaattccagcttctgtccactggagtgtcccgcttactctagttatacgaactgcttgccttcttgttcaccatcatgttgggacctggacgggagatgcgaaggcgcaaaagtcccttccgcgtgcgctgaaggatgcatctgtcagccaggctacgtgctgtccgaggataaatgcgttccgaggtcccaatgcggttgcaaggatgcccacggaggaagcattccactcgggaagtcctgggtttcctcgggatgcacagagaaatgcgtttgtactgggggagcgatacagtgcggagacttccgctgtccaagcggctctcattgtcaactgacatccgataacagtaatagcaactgtgtgtccgacaagtctgaacagtgctccgtgtatggtgatcccagatatcttacattcgacggcttttcctaccggttacaaggtagaatgacctatgttctaatcaaaaccgttgatgttttgcccgagggcgtcgaacccctgcttgtggagggaagaaacaagatggacccaccacgatccagtatctttctacaggaagtgataactactgtttatggatacaaggttcagctccaagcgggattagagttggtggtaaacaatcagaagatggccgttccctatagacctaatgaacacttgagggtgactctatggggacagaggctttacttggtgaccgactttgagctggttgtatctttcggaggcagaaaaaatgccgtcatcagcctaccgtccatgtacgagggtcttgtctcaggcctgtgcggaaactacgacaaaaacagaaagaacgacatgatgctacctagcggcgctctgacccagaatctgaacacgtttggcaatagctgggaggtgaagactgaggatgcactcctgcggtttcccagggctatccccgcagaggaagaaggccaaggtgcagaactgggactgcgcactggtctccaggtgtccgaatgctcgcccgagcaattggcatcaaactccacgcaggcatgtagagtcctcgctgacccccagggccctttcgcggcatgtcatcagactgtggcccctgaaccgttccaggagcattgtgtgctcgacctgtgctccgcacaagatccgagggaacaagaagagttaaggtgccaagtgttaagtggttacgccatcctgtgccaggaggctggtgccgcactcgccggatggcgggaccgcacgttgtgtgctatggaatgtccggcagggactatataccagtcctgcatgaccccatgtcccgcaagctgtgccaacctggctgaccccggagattgtgagggaccctgcgtcgaggggtgtgcaagtatacccggttatgcctactctggtacacagagcctgccttggttgaccgtagccgctcccgctatggccagcaccactagctgggcagcagcctttta

SEQ ID NO: 61508 - DNA, 3555 bp, Artificial Sequence
  Description of Artificial Sequence: Synthetic coding sequence
atggcatgtccccctaacagtaagtacagcctgtgtgccaaaccgtgtcccgacacgtgtcattctggatttagcggaatgttttgctctgaccgttgcgttgaggcctgcgaatgtaatccaggctttgtgctttcgggcctggagtgtatcccaagaagtcagtgtgggtgtttgcacccagctggatcgtacttcaaagtcggagagcgatggtataagcctgggtgtaaagagctgtgcgtgtgcgagtccaacaaccgcattcgctgccaaccttggaggtgtcgtgcccaagagttctgcggccagcaggatggtatttacggatgccatgcccagggtgcagccacatgcactgcctcgggcgatccacactatttgactttcgacggcgctctgcaccactttatgggtacctgcacatatgtgctgacccgcccttgctggtctcgtagtcaggactcctactttgttgtgtcggcaaccaacgaaaaccgtggcggtatcctggaagttagctatattaaggctgtgcacgttacagtgtttgaccttagcatttccttgctgcgcggatgtaaagtgatgctcaatggtcatcgggtggcgctacccgtgtggctggcacagggcagagtaaccataagattgagcagcaatcttgtcttgttgtacaccaatttcggtttacaggtccgttacgacgggagccacctggtagaagtcaccgttccttcgtcctacgggggacagctgtgtggcctgtgtggcaactataacaataacagcctggacgataatctcaggcccgacaggaaactagccggagactctatgcaacttggtgccgcatggaagcttcccgagagctctgaaccaggctgcttcctagtgggcggaaaaccaagctcatgtcaagagaattctatggccgatgcctggaacaaaaattgcgctatattgatcaaccctcaaggtccattttctcaatgccaccaggtcgtgccaccccaatccagcttcgcttcgtgcgtgcacggacagtgtggtacgaagggagacaccaccgccctttgtaggtcccttcaggcctacgccagcctgtgcgcccaagctggccaggcacctgcctggcggaatcggaccttttgtcccatgcgatgtcctcccggaagctcctatagcccttgctctagcccgtgtcccgatacatgcagctccattaacaacattacgtgtttccagtcaacgtgcaagccaaatcagatttgctgggcgcttgacgggctgctgcggagggcttccggtgtcggcgtgtgtcagctcccgggagagtcccactatgttagtttcgacggctcaaatcacagcattcctgatgcctgtactctcgtgctagtcaaagtgtgtcacccagctatggccctgccattctttaaaatcagcgccaagcatgagaaggaagaaggtgggaccgaggcttttcggctacacgaggtgtacatcgatatttatgacgcacaggtaaccttacagaaagggcatagagtcttaatcaacagcaagcaggtaacacttcccgcaattagccaaattccaggggttagcgtcaagtcatcctccatttatagcattgtgaacataaagattggcgtacaggttaaattcgatggcaaccatctccttgaaatagaaatcccaacaacctattacggcaaggtgtgtggcatgtgtggaaacttcaatgacgaagaagaggacgagctaatgatgccttctgacgaagttgccaatagcgattctgagtttgtgaatagctggaaggataaggacatagacccaagttgtcagtcactattggtagacgagcagcaaattccggctgagcagcaggagaatccatctggtaattgtcgtgccgctgatctgagaagggcacgcgagaaatgtgaagcagccctgcgggctcctgtctgggctcaatgcgccagtcgaatcgatctgaccccctttctggtggactgtgcaaacactctaagcctggagtgccccgcatatagttcctatactaactgtttgccctcttgctccccaagctgttgggacttggacgggaggtgtgagggagccaaggtcccttctgcatgcgccgaggggtgtatctgccagcccggatacgtgctgtctgaggacaagtgcgtccctcgaagccagtgcggatgcaaggacgcccatggcggaagcatacctttaggcaagtcgtgggtgtctagcggatgtaccgaaaagtgtgtttgtacaggtggggcaatacagtgcggggatttcaggtgcccctcaggttcccattgtcaactgacttcagacaatagcaattcgaactgtgtgagcgacaagtcagagcagtgtagcgtttacggtgaccctcgatacttgacttttgatggtttcagttataggctacaaggcaggatgacatatgtactaatcaaaacagtggacgtgctgcccgagggggttgaaccacttctggtggagggacgaaacaaaatggacccacccagaagttcaatattcctacaggaagtgataactactgtctacgggtacaaagttcaactgcaggctgggctcgagctggttgtcaacaatcagaaaatggctgtgccgtaccgcccaaatgaacatctgcgtgttactttgtgggggcagcgactgtaccttgtgacagactttgaactggtggttagcttcgggggacggaagaacgccggactgtaccagaggcgccgtcgcgataagggcagaagctgggcgagcgccagagcctctaagtgtcccaacgtagccagatcttcctggcgtgccaccgcgccacggcctgtcggttgctggcagacacccagggcccctctgctgccagtcacacgacggtggccgcagagccctagcaaaagtaccgcctgttggatctgcgccctgctaagaacccaggagtcaaaacggtcctgcgttgctagatcctctgtggggacccctagtagcgctcgcaggagagctttgccatggctcgccggtgggacagctccctccgctcttggatcttctttcctgacagaggactgctcacagcggtgtacatgcgctagctccaggatattactttgtgaacctttctcctgtagggccggagaggtatgcacactgggaaatcatacgcaagggtgttttccagaaagcccatgtttacagaacccatgccagaacgatggtcaatgtcgcgagcagggagccaccttcacctgtgagtgcgaggtcggttacggtggtggcctgtgcatggagcccagggacgcaccaccgccacggaagcctgaggcttcaaacctcgtgggagtgctactaggcttgctggtgccagttgtggtggtgttactggcagtgacaagagagtgcatttaccgcacacggaggaaacgagaaaagactcaggagggagaccgactggccagacttgtagacactgatacagtgctggactgcgcctgctag

SEQ ID NO: 61509 - DNA, 8162 bp, Artificial Sequence
  Description of Artificial Sequence: Synthetic coding sequence
atggtaccacctgtttggaccctcctcctcctcgtgggcgctgctctgtttagaaaagagaaaccacctgaccagaaactcgtggttcgttcttctagggacaactatgtgctgacccagtgcgatttcgaagacgatgcgaagcccctctgcgactggtcccaggtttccgctgatgatgaggactgggtgagagccagtggtccgtctccgacaggcagcactggagcccctgggggttacccaaacggagagggctcgtacctccacatggaatccaactctttccataggggtggcgtggccagactcttgagccccgatctgtgggagcagggtccactgtgcgtccactttgcgcaccatatgttcggattgtcatggggcgctcagctccggctgctattgctgtctggcgaagaagggcgtagacctgatgtgctctggaagcattggaatacccagcgacctagttggatgttgacaaccgtcactgtccccgctggatttaccttgcccacacgccttatgttcgagggcacaaggggcagtactgcatacttagacattgcgctggatgcactgtctatccgaaggggcagctgtaaccgcgtgtgcatgatgcagacctgtagtttcgacattcccaatgacctgtgtgattggacctggatccccaccgcttcaggcgcaaaatggacgcagaagaagggcagctccggcaaaccaggtgtaggccctgatggagactttagtagcccaggcagcggatgctacatgttgctggaccctaagaatgctcggccaggccagaaagcggtgctgcttagccctgtgtctctgagctctggatgtctcagcttcagctttcactatattctaagaggccagagtcctggggcagctcttcacatatacgcatccgtgctgggtagtattcgcaaacatacccttttcagcgggcagccagggcctaattggcaggccgtgtctgtgaactataccgcagtcggaagaatccagttcgcggttgtgggagtgtttgggaagacaccagaaccggctgtcgccgttgatgccacttcaattgcaccctgcggggaggggttcccccagtgcgattttgaggataacgcacatcccttttgcgactgggttcaaacctcaggggacgggggacactgggctctcgggcataaaaatggcccagtgcatgggatgggaccagctggtggattccctaacgctgggggacattacatttacctggaagccgatgaattttctcaagccggtcagtctgttcgattggtctctaggcccttctgtgcgcctggcgatatctgcgtggagttcgcctatcacatgtatgggctgggtgaggggacgatgctagaattgcttctgggctcccccgcaggatcgccccctattccattatggaaaagggtcggctcacagaggccctattggcagaatacatccgtcaccgtgccaagtggccaccagcagcctatgcagttaatattcaaaggtatccagggaagtaataccgccagcgtggtcgcaatgggattcatcttaattaatcctggaacctgcccagtcaaagtcttacccgagctgcccccagtgtctcctgtgagctccaccggcccatccgagacgacggggctcactgaaaacccgacgatctcaaccaagaagcctactgtgagtattgagaagccttccgtgacaactgagaagcctaccgtacccaaggaaaagcccactattccgactgaaaagcccacaatttctacagagaagccaaccattccctctgagaaaccgaacatgccaagcgaaaagcccactattccttcagaaaagcctaccattctgacagaaaagcctacaattccctccgaaaagcctacaatccctagcgaaaaaccgaccatctcaaccgaaaagcctactgttccgactgaagaaccaaccacccctaccgaggagacgacgacatcaatggaggaacccgttattcccacagaaaagcctagcattcccaccgagaaaccctcgatccctacagagaagcctactatttctatggaggaaacaattatttctacggaaaaaccaactattagcccagagaaaccgaccattcccaccgaaaagccaactattcccacagaaaaatcaaccatcagtcctgaaaagccaaccaccccaactgaaaaacccaccatacccacagaaaagcctactatatccccggaaaaaccgacgacaccaaccgagaaacccaccatctcccctgaaaagctgaccatacccaccgagaagcctaccatcccgacggagaagcccacaattcccactgagaaacccacaatttctaccgaggaaccaaccacgcctacagaggaaaccacaatcagcaccgaaaagccttctatccctatggagaaacccacgctgcctaccgaggaaactactacttccgtggaggagacaaccatttcaacagaaaaattaaccatccctatggaaaagcctaccattagcaccgaaaaacctaccattccgactgagaagcccaccataagtcccgagaagttgactatccctaccgaaaaactcactatcccaaccgagaagccaactataccaattgaggagactaccatttccactgaaaaactgacgatccccaccgaaaagccaacaatctcacccgagaaacctacaattagcactgagaaaccaaccatccctacagaaaaaccaactatacccacagaggagacaaccatcagtaccgagaagctgacgataccaaccgagaaacctaccatctcaccagaaaaactcacaattccaacagagaaacccacaatctcaaccgagaagcctactatcccgaccgagaagttgacaatacccaccgaaaagccaaccattcccacggagaagcctacaatccctactgaaaagctgacagcattgcgcccaccccacccctccccaactgctacaggcttggccgctttggtcatgagcccccacgctcccagcactccgatgacgtctgtaatcttgggaactaccactacctctcgatcttccacagagagatgcccacctaacgcccgatatgagagctgtgcgtgcccggcttcttgtaaatctcccagaccctcttgcggcccactctgtcgtgagggttgcgtctgcaaccccggtttcctattctctgacaaccattgtatacaggcttcttcgtgcaactgtttttacaataatgattactacgaacctggcgcagaatggttttcgccaaattgtacagagcactgtaggtgctggcccggtagtagggtggaatgccagatttcccagtgtggcacccatacggtgtgtcagctgaaaaacggacagtacgggtgccatccttacgccggaactgccacttgcctggtctatggggaccctcactacgttaccttcgacggtaggcacttcggtttcatgggaaaatgtacttacatacttgctcagccctgcggtaatagtaccgaccccttctttcgagtcactgctaagaacgaggaacaaggacaggaaggagtgagttgtctttccaaagtgtatgtgactttgcccgagagtaccgtcacactcctgaaaggccgtagaacacttgtggggggacagcaggttactttgccagcgattccctccaagggtgtgttccttggcgcaagcggacgattcgtcgagctgcagacagagtttggattgcgcgtacgatgggatggagaccagcaactttatgttaccgtatctagcacatactccggcaaactgtgtggactgtgtggtaactacgatggaaacagtgataatgaccatctgaagctggatgggtcaccagcaggagataaggaggaactggggaatagctggcagaccgaccaggacgaggaccaagagtgtcagaaataccaggtggttaacagtccctcctgcgatagcagtctgcagtcttcaatgtcgggccctgggttctgcgggagattggtagacacccacggcccttttgagacatgtctcttgcacgtcaaagctgccagctttttcgatagctgcatgctagatatgtgtggctttcaggggctacagcatctactttgcacccacatgtccacaatgacaacaacatgccaagacgcaggacacgcagttaagccatggagagaaccgcacttttgcccaatggcgtgcccccctaattcaaaatacagcctgtgtgcgaaaccatgtcctgatacgtgtcattccggcttctcaggaatgttttgtagcgaccgatgcgtggaagcatgtgaatgtaaccccggatttgtgctgtctggactcgaatgcatccctcggtcccagtgtgggtgcttgcaccctgccggatcctacttcaaggttggcgagcgctggtataagcctggctgtaaggaattatgcgtgtgcgagtctaataatcgtattcggtgtcagccctggcgctgtcgggctcaggaattctgcggtcagcaagacggcatctacggctgccacgctcagggagccgcaacgtgcaccgcatcaggcgacccccactaccttacgttcgacggggctttgcatcacttcatgggcacatgtacgtatgttctgacccgaccttgctggtcaaggagtcaggactcctatttcgtagtctccgccacaaacgaaaaccgcggtggaattctggaggtgagttatatcaaggccgtgcatgttacagtgttcgacttgtcaatcagtctgctgaggggctgcaaggtcatgctcaacggacacagggttgcactgccagtgtggctcgcgcagggtagagtgaccatccggctctcgtccaatttggtgctcctgtataccaactttggcctgcaggtgcgatatgacgggtcacacctggtggaagtgacagtgccttcgtcttatgggggacagctatgcgggttgtgtggaaattacaataacaactccctggatgataacctgagacctgaccgcaagctcgccggtgatagtatgcaactaggagcagcctggaaactgcctgaaagcagtgagccaggatgtttccttgtgggcggtaagccctcatcatgccaggaaaatagcatggcagacgcatggaataaaaattgcgccattcttataaaccctcagggtccttttagtcagtgccaccaggttgtcccccctcagagcagcttcgcttcgtgtgtccatggacagtgcgggacaaagggcgatacaacagccctgtgtcgatcactccaagcttacgccagcctttgcgcacaagcagggcaagcaccagcgtggaggaataggaccttctgcccaatgcgatgcccacctggttcttcctattccccctgtagtagtccctgcccagacacctgttcctccataaataatcctcgagattgccctaaagctctgccgtgtgccgaatcttgcgagtgccagaagggccacattttatctggtactagctgtgtgccgttagggcaatgcggctgtaccgatcccgcaggctcttatcacccagtgggtgaaagatggtataccgagaatacatgcacaagactgtgtacctgcagtgttcataataacattacctgcttccaaagcacttgtaagcctaatcaaatatgctgggcactggacggcctcctgcggcgtgccagtggcgtaggagtgtgccagttacctggtgagagccactatgtgtccttcgatggctcaaatcatagtatccctgacgcctgtacgttggtattagtcaaagtatgccaccccgcaatggcactccctttttttaaaatctctgcaaagcacgaaaaggaagaggggggaactgaagcctttagactgcatgaggtctacatagatatatacgacgcgcaggtgacactgcagaaagggcatagagtattgatcaacagcaaacaggtgacactgcctgcgatttcccagatccccggagtgtcagtgaaatcctctagcatttattctatcgtcaatataaagatcggagtgcaggtaaaattcgatggaaaccacctgttagagattgaaatccccacaacatattacggtaaagtctgcggcatgtgcggaaacttcaacgacgaagaggaggacgaactgatgatgccaagtgacgaagtcgccaatagcgattcagagtttgtgaattcatggaaggacaaagacatcgacccaagttgccagtccctgctagtggatgaacagcagatcccagcggaacaacaggaaaatccttccgggaattgccgtgctgccgatctacggagggctcgggagaaatgcgaggcagctctccgcgctccggtgtgggcacagtgtgctagtaggatcgatctcacgcctttcctggttgattgtgccaatacactatgcgaatttgggggtttgtatcaggccctgtgccaggctctgcaggcatttggggctacctgccaaagccagggcctgaagcctcctttgtggagaaacagcagtttttgtcctttagagtgcccagcatactcttcctacaccaactgtcttccttcatgttccccctcgtgttgggatctggatgggcgttgtgagggcgctaaggtgccctctgcatgtgccgaagggtgtatctgccagcctggatacgtgctctctgaagacaaatgcgtccctcggagccagtgcggatgcaaggatgcccatggcggttccattccccttggaaaaagctgggtgtcgagtggctgtaccgagaagtgcgtgtgtactggtggagctattcagtgtggggattttcgatgtccttcaggctctcactgccagcttacttccgataattccaatagcaactgcgtgagcgacaaaagcgagcaatgcagcgtgtacggggatccgaggtacctgacgttcgacggcttctcgtaccgcctgcagggtcgaatgacctacgtgctgatcaagaccgtcgatgtgcttcctgaaggggtggaaccacttctggtcgagggccgaaataagatggaccctccaagatccagcatcttcctgcaagaagtgattaccactgtgtatggttacaaggttcagctgcaggccggattggaacttgtggtaaataaccaaaagatggccgttccttacaggccaaacgagcaccttcgtgtgactctatgggggcagcggttgtatttggtgacagacttcgaattggtggtgtcattcgggggacgtaaaaacgcagtgatttctttaccctcaatgtacgaggggctagtgagcggcctttgtggcaattacgacaaaaaccgtaaaaacgacatgatgctaccatcaggggcattgacccagaacctcaatacttttgggaactcatgggaggtgaagacagaagacgctctgctgcgatttccccgtgccatacccgcagaggaggaaggccagggagctgaactcggcctgagaaccggattacaggtttcagagtgcagcccagaacagctggcttccaactcgacacaagcgtgccgagtattggcggatcctcagggccctttcgctgcctgccatcagacagtggccccagagccattccaggagcactgtgtgctggacctgtgctccgcccaagaccctagagaacaagaagagcttaggtgccaggtgctgagtggctatgccatcctctgtcaggaagcaggtgctgctcttgccggttggagggacagaactttgtgcgaatcaccctgcctgcaaaacccctgccaaaacgatggtcagtgtcgggaacagggtgctacatttacgtgtgaatgcgaggtaggatacggagggggtctgtgtatggaaccacgggacgctcctcctcctcgcaagccagccagcaacctggtgggcgttcttctgggtcttctggtgcccgtcgtggtggtcttacttgccgtgacacgggagtgtatctatagaactagacgaaagcgagagaagacacaagaaggggaccgcctggcacgtctggtagacactgacactgtcctggactgcgcctgtta

SEQ ID NO: 61510 - DNA, 2280 bp, Artificial Sequence
  Description of Artificial Sequence: Synthetic coding sequence
atggtccactttctccatcccggacacactccacggaacatagtccccccagacgctcagaaggatgccttgggatgctgcgtggtccaggaggaggcttcaccttataccctggttaacatttgcctaaatgtactcatagcaaatctggagaaactgtgcagtgagcgccctgacggtacactctgtctcccagagcattggtcttttcctcaagaagttgccgagagattcttgagagtgatgacatggcaaggtaagttgacagataggaccgcttccatttttcgtggcaatcagatgaagctcaagctggttaatatccagaaggccaagatcagtaccgctgcctttatcaaggctttttgccgtcacaagctcatcgaactaaacgcgaccgcagtccatgcagacctgcctgttcctgacatcatctcaggcctgtgcagcaatcggtggatccaacagaatctacagtgtctgctgctcgatagcacatcaattccccagaacagccggcttctgtttttcagtcaactcacggggttgagaatacttagcgtgtttaacgtctgctttcacactgaagatcttgcaaacgtgtcccagttacctcgcctggagtctctcgacatttcaaataccctggtgaccgatatctcagcactccttacttgtaaagatcgtcttaaatctttgacaatgcactacctgaagtgcctggccatgacgaaatcccaaatactggccgtgatccgcgaattaaagtgcttgcttcacctggacatctccgatcaccggcagctgaagtccgacctggctttccatcttctgcagcagaaagatatcctcccaaacgtagtctcactcgatatttcaggcggaaattgtatcaccgatgaggccgtcgagctcttcatcaggctcaggcccgctatgcagtttgtgggattgttggctaccgatgccggttcatctgatttcttcactacgaaacaggggcttagggtggccggaggggcaagcatgtcccaaattagcgaggctctgtctcgctataggaatcgctcctgcttcgtcaaagaggcgctgcatcggctgttcacagaaacctttagcatggaggtgactatgccggcaattctgaagctggtggctatcggaatgcggaatcatcccctagatctccgagttcagtttacggcatctgcttgtgcactaaacctcacacggcagggcttggctaagggcatgcctgtccggttactgtctgaagtcacatgcctgctctttaaagctctcaagaatttcccccactatcaacagctgcaaaagaattgcttgttgtcactgacaaactccaggattttagtcgatgttccattcgaccgcttcgatgccgcaaagttcgttatgcgatggttgtgcaagcatgagaatccgaagatgcaaacaatggctgtgagcgtgacctcgatattggccttgcagctctcgcccgagcaaactgctcagttggaggagctctttatggcagtgaaagagctgctagctatcgtgaaacaaaaaacaacagaaaatcttgacgatgttacattcctgttcactctaaaagcactgtggaatctcactgacggtagtccagccgcttgtaagcatttcattgagaaccagggacttcaaatttttatacaggtcctcgagacttttagtgaatccgctatccagagcaaggttctgggcctgcttaacaatatagcagaagtacgcgagttatctagtaaacttgtgacggaggacgtcctgaagcacatcaacagcctgctctgtagtagagaaatggaagtatcttacttcgcagccggaatcattgcgcaccttacaagcgatcggcagttgtggatatcaagagatttccaaaggcggaccctcctgcaggacctccatgcaactatacagaattggccatcatcttcctgcaagatgaccgccctggtcacctaccgctcatttaagacatttttcccccttctcgggaactttagccagccggaagtgcagctctgggccctctgggctatgtaccatgtttgttcaaagaatccctctaagtactgcaaaatgcttgtagaggaggagggtctccaacttttgtgcgacatccaagaacactcagaggccacccccaaggcacagcaaatcgccgcatctatactagacgactttcgtatgcatttcatgaactaccaacgacccacactctgtcaaatgcctttctag

SEQ ID NO: 61511 - DNA, 1254 bp, Artificial Sequence
  Description of Artificial Sequence: Synthetic coding sequence
atgtcacagattagcgaggctctctctaggtatcggaatcgcagctgcttcgttaaagaggccctgcaccgactgtttacggagacgttctcaatggaggttactatgccagcgatactgaagttggttgccatcggtatgcgaaaccacccactcgacctaagggtgcagttcacggcttctgcctgcgctttgaatttaaccaggcaaggcttggcaaagggaatgccggttaggttgctgagtgaggtcacatgcctcctgtttaaagcactgaagaacttcccccactatcagcaattgcagaagaattgtctgctgtcgctcacgaactcaagaattttagtggacgtgccctttgatcgtttcgatgctgcaaagttcgtcatgaggtggttgtgcaagcatgagaatcccaagatgcagaccatggccgtgagtgtcacctccattctcgctctccaactttcaccggagcagaccgcccagctagaagaactgtttatggctgttaaagaattacttgccatcgtgaaacagaagactacagagaatctagacgacgtgacttttcttttcactcttaaggccttatggaaccttacagatggatctccagccgcttgcaagcatttcatcgagaatcaggggttgcagatcttcatccaggtcctcgagactttcagcgagtccgctattcagtccaaggtcttggggctattaaataacatcgccgaggttcgcgagctatcctcaaagctggttacggaggacgtgctgaagcacatcaactcattgttgtgctcccgtgagatggaagtcagttattttgccgcagggatcatcgcacatctgacatcggaccgacagttatggatatcaagagatttccagcggaggacccttctgcaggacctgcatgccaccatccagaactggcctagttcttcatgtaagatgaccgcattggtgacgtacaggtcattcaagactttttttcccttgctcggtaatttctcgcagcctgaagtccagctgtgggctctctgggcaatgtaccatgtttgtagtaaaaatcctagcaaatactgcaaaatgctggtcgaggaggagggcctccagctgctgtgtgacatacaagagcactcagaagccacccccaaggctcagcagattgccgctagcatattggatgacttccggatgcactttatgaattaccagagacctactttgtgtcagatgccgttctag

SEQ ID NO: 61512 - DNA, 2235 bp, Artificial Sequence
  Description of Artificial Sequence: Synthetic coding sequence
atgccagaggaccaggcaggggctgcaatggaggaagcttccccctacagtctgttggatatctgcctgaacttcctgaccacacacctggagaagttctgttctgcccgacaggacggaactttgtgcctccaggaaccaggagtgtttccccaggaggtggcagatcggttgctgaggacaatggccttccatggcttgctgaatgatggaacagtgggtatctttagggggaatcagatgcggctgaagagggcatgtattaggaaagccaagatctcggctgttgcctttagaaaagcattctgtcaccataaattggtggagctcgacgcgacaggagtgaacgcagacatcacaatcaccgatattattagcggactggggtcaaacaaatggattcagcagaacctccagtgccttgtgctgaactcactaactctgagcctggaggacccctacgaacggtgtttctctcgactctctggcctgcgggcattgtctatcacgaacgtgctgttctataatgaagatctggccgaggtggcctcactaccgcgactcgagtccctggatatctctaacacaagcatcacagatatcaccgcgttgctggcctgcaaggatagactgaagtctttgacaatgcaccatctcaagtgcctgaagatgaccacaacacagatcttggatgtggtgagggaattgaaacaccttaatcacctggacatctcagacgacaagcagtttacctctgacatagcactgcggttgttagagcagaaagatatcctgcctaatctggtttctctggatgtgagcggccgaaaacatgttactgacaaagccgtggaggccttcatacaacagcgtccctctatgcagtttgtaggactcctggcgaccgatgccggttattcagagttcctgacaggcgaaggtcacttaaaggtaagtggggaagccaatgaaacccagatagccgaagccttgaagagatacagtgaaagagccttcttcgttagagaggctttgtttcatttattctcgttgacacacgtcatggaaaagacaaaacccgaaatcctaaaattagttgtaaccgggatgagaaatcatcctatgaacctgcccgtccagctggccgcttctgcctgtgttttcaacctgacgaagcaggacttggcagccggtatgcctgttcgcctgttggccgacgttactcacctgctcctcaaggccatggagcacttccccaatcaccaacagttgcagaagaactgtctgctttcactctgctccgacagaatcctacaagacgtgcctttcaatcgctttgaggcggcaaaattagtcatgcagtggctctgtaatcatgaagaccagaatatgcagaggatggccgtggccatcatctccatattagcggcaaagctgtctactgaacaaactgcccaactgggaacagaactgttcatcgtgagacagctgctacagatcgtcaaacaaaagactaatcagaattccgtggacacaacccttaagtttacgctgagtgctctgtggaacctgacggatgaaagccccactacatgcagacatttcattgagaatcagggactggagctgttcatgcgtgtgctagaatcttttcccaccgagagtagtattcagcagaaggtattaggactgctgaacaatatcgccgaggttcaggagctgcatagcgagctgatgtggaaagactttattgaccatataagctctctgctccatagcgttgaggttgaagtgtcctactttgcagcaggcattatcgcccatctcattagtaggggcgagcaggcctggactctgtcccggtcacagagaaatagccttcttgatgacttacacagcgcaattctcaaatggcccacgcctgagtgtgaaatggtggcctacaggtctttcaatcccttcttccccttactgggctgttttacgacccctggcgtgcagctatgggccgtgtgggccatgcaacacgtatgttctaagaacccttctcggtattgttctatgctcattgaggaggggggtttacagcatctttataacatcaaggaccacgagcacactgatccccatgtacagcagattgcagttgcaattctggacagtcttgaaaagcatattgtacgtcatggaagacctccaccttgcaagaaacaacctcaggccaggctgaattag

SEQ ID NO: 61513 - DNA, 2025 bp, Artificial Sequence
  Description of Artificial Sequence: Synthetic coding sequence
atgcctgaggatcaggcaggtgctgccatggaagaggcttcaccttactccctgctggacatttgtcttaattttctcacaacccacctggagaaattttgttccgcccgtcaagacggcactttgtgcctacaggagccaggagtcttccctcaggaggtcgccgatagacttttgcggaccatggcctttcatggtctgctcaatgacggcaccgtcggaattttcagagggaaccaaatgaggctgaaaagagcatgtattcgtaaggccaagatctctgcggtagcctttcgaaaggcattctgccaccataagctggttgaattggatgctaccggtgttaacgccgatataactataacagatattatttcaggccttggtagcaataagtggatccagcagaatctgcagtgcctggtgttgaactccttgaccctgtccctggaagatccttatgagcgctgctttagccggttgtcaggactgagggccctgtccatcaccaacgttctgttctacaacgaagatctcgccgaggtcgctagcctgccacggctggagagcctcgatattagtaatacttccattacagatatcactgcactgctcgcttgcaaggaccgactgaaaagcttaacaatgcaccacctgaagtgtttgaaaatgacaactactcagattctagatgtcgtgagagagttgaaacatctcaaccacctggatatctccgatgataagcaattcacaagcgatatagcccttagactactcgaacagaaagacattctacccaacctggtgagtctggatgtttccgggaggaaacatgtgacagataaagcagtggaggcattcatccaacaacggccttctatgcagtttgtgggactccttgctacagacgcgggatactctgaatttctcactggcgaaggacatctgaaggtgtctggggaggccaacgaaacccagattgctgaggccctgaaacgatattccgaaagagcattctttgttagggaggcgctgttccacctctttagtttaacccatgtgatggagaagactaagcctgaaatcctgaaacttgtggtgacgggaatgaggaaccaccccatgaatcttccagtgcagctcgccgcatccgcctgcgtgtttaatttaaccaaacaggacctggccgctggcatgcccgtccgactcttggctgacgtgactcatttgctgctgaaggccatggagcactttcctaaccatcagcagcttcagaaaaactgtctactgagcttgtgttctgacaggatcttacaggatgtcccattcaacaggttcgaggcggctaagctggtgatgcagtggttatgtaaccacgaagaccagaatatgcagcgcatggcagtagccatcatctccattcttgctgcaaaactctcaaccgagcagaccgctcaactggggactgagttgtttatcgtccgaaacaacatcgcggaggttcaggaattgcactccgaacttatgtggaaggatttcattgatcacatatccagtctgctgcactctgttgaagtggaggtgtcgtatttcgctgcgggtatcattgcccacctaatcagtaggggtgaacaggcgtggacattatcaagatcacagagaaacagtctgttggacgatctgcactccgccattcttaagtggcccacgcccgagtgcgaaatggttgcctatagatcattcaatccttttttccccctcctgggctgtttcacaaccccgggagtgcaactgtgggccgtctgggctatgcaacacgtgtgcagcaagaatccaagccgctactgttccatgctaatcgaagaaggtgggctgcagcatctgtataacatcaaggatcatgagcatactgacccgcacgtgcagcaaattgcagtcgccattttagacagtttggaaaagcatatcgtcaggcacgggcgtccaccaccatgcaaaaagcaacctcaggcccgactcaattag

SEQ ID NO: 61514 - DNA, 1701 bp, Artificial Sequence
  Description of Artificial Sequence: Synthetic coding sequence
atgcccgaggatcaggccggagccgctatggaagaggcctccccgtacagcctgctcgacatctgcctgaattttctgaccacccacctcgagaagttctgtagtgcgcgacaagacggcacactctgtctccaggagccaggagtgtttccgcaggaagtggccgacaggcttctgaggactatggcctttcatggtctgctgaatgacgggacagtcggaatttttcgtggcaaccagatgcgtttgaagcgcgcttgtatcaggaaggccaagatctcggccgtggcctttcgaaaggccttttgccatcacaagctcgtggaactcgacgctaccggtgtcaatgcggacatcactatcacagatatcatctcgggcttggggtccaacaaatggatacaacaaaatttgcagtgtctcgtgttaaactcgctgacactgtctctcgaagacccatacgaaagatgctttagcaggctgagcggactgcgcgcactcagcatcaccaacgtcctgttctacaacgaagacctggccgaagttgcgtccctgccaaggcttgaaagcctagacatttccaatacttcgataactgatatcacagccctgcttgcctgcaaggaccgactaaaatcattgaccatgcatcatcttaaatgcctcaaaatgacaaccacccagatcttggatgtcgtccgcgaacttaagcacctaaatcacctggacattagcgacgacaagcagttcacatctgacatcgccctgcggttgctggaacagaaagacatattacctaacttagtttcactcgacgtgtcaggtcgaaaacatgttacggataaagcagttgaagcgttcatccagcagcgacccagcatgcagtttgtaggcctgctagcaactgacgccggatatagtgagtttctcacaggagaaggccatttgaaagttagcggagaagcaaatgagacccagattgccgaagctctcaagagatattccgagcgcgctttttttgtaagagaggcactcttccacttgtttagcttgacccacgtgatggagaaaacgaaaccagaaatcctaaagctcgttgttactgggatgcgcaaccacccgatgaatcttcccgtgcagttggccgcatctgcttgcgtgtttaatctcacgaagcaggacctggcagccggaatgcctgtgcgcctccttgccgacgtgacccacttgctgctgaaagcaatggaacattttccaaaccaccagcagctccaaaaaaattgcctgctgagcctgtgttccgacaggatcctgcaagatgtgcccttcaataggttcgaagccgctaaactggtcatgcagtggctgtgcaaccacgaggatcagaacatgcaacgcatggccgtagctatcattagcatcctggcagccaagctttccactgaacagacagcccagctggggacggagctgttcatagtgaggcagcttttgcagattgtgaaacagaagactaaccaaaacagcgtcgacacaacgctcaagttcaccctgagcgctctgtggaaccttaccgatgagtccccgaccacttgccgccattttatagagaaccagggcctggagctgtttatgagggtgctcgaatctttcccgaccgagagctccatccagcagaaagttcttggcctacttggctag

SEQ ID NO: 61515 - DNA, 966 bp, Artificial Sequence
  Description of Artificial Sequence: Synthetic coding sequence
atggagaggtttgtgcgggtgccgtatggcttgtaccaaggatacggcagtacagtgcctctcggacagccaggcctgtcgggtcataaacagccggattggcgacagaacatggggccacccaccttcttagctaggccaggcctgctcgtcccggcaaatgctcctgactactgcatcgatccctacaaacgtgctcagcttaaagctatattaagtcagatgaacccaagcctgagtcccagactttgcaaacccaacacaaaagaagtcggagtccaggtgtcgcccagggtcgataaggccgttcagtgctccctgggcccaaggacattaagctcatgttctccttgggatggcagggacccccaggaaccactccccgcatgtggagtgacttcacctgccacaggaaggagaggtttaatccggcttagacgggacggcgacgaggcggaatcaaaggcactcccaggccctgctgaagcgtcccaaccgcagccaccatcacggaggagcggtgcggaccgccaggaagagcccggacaactagaagaatcaggcgagaaggacgcaccctgcccccaggaaaccaagtcaaaacaggttcccggagatgccgcatcggagcccctgagaaggcccaacttccaattcttggaaccaaaatacgggtacttccactgtaaagactgtaagactcggtgggaatcagcctacgtgtggtgcatcagtgggactaataaggtctatttcaaacagttatgttgtaaatgtcaaaagtcttttaacccttatagagtcgaagccattcagtgtcagacttgttcaaagagccactgttcatgtccacagaaaaagaggcatattgatctgagaagaccacacaggcaggagctgtgcggaagatgtaaggataagcggttctcctgcggcaacatatatagttttaagtatgtgatgtag

SEQ ID NO: 61516 - DNA, 78 bp, Artificial Sequence
  Description of Artificial Sequence: Synthetic coding sequence
atggagcgcttcgtgagagtaccttacgggttgtatcagggttacggttccacagtcccattaggccaacctggatag

SEQ ID NO: 61517 - DNA, 504 bp, Artificial Sequence
  Description of Artificial Sequence: Synthetic coding sequence
atgttgaccgtggcgcttcttgccctattgtgcgcatccgccagcggaaacgctatccaggcacggtcttcctcatactctggtgagtacggaggcggaggcggaaagcgcttcagccattcagggaaccagctggatggcccaattacagccctgcgtgtgcgggtgaatacatactatatagtgggtcttcaggtgcgatatggaaaggtgtggtccgattacgttgggggacggaacggagacctggaggagatctttctccacccaggcgagtccgtgatccaagtgtccggcaagtacaaatggtacctgaaaaagctgttatttgtcacagataaagggcgttatctatctttcggcaaagactctggcaccagtttcaatgccgttccgcttcatcctaacaccgtgctcagattcatctccggcagaagtggctccctgattgatgcgatcgggctgcactgggacgtctatcctagcagctgctcacgttgctag

SEQ ID NO: 61518 - RNA, 1173 nt, Artificial Sequence
  Description of Artificial Sequence: Synthetic coding sequence
augcccccuagcgggcuucggcugcugccccuccuacugccucuucucuggcugcugguccugacuccugggagaccggccgcuggcuuaucgaccugcaagacaauugauauggaacuggugaaacgcaaacgcauugaagcuauaagagggcaaauucucucuaaacuuaggcuggcuucuccgcccucccagggggaaguaccccccggaccuuugcccgaagcuguccuggcccuuuacaauuccacccgcgaccggguugcuggagaauccgcagaaccugagccagaaccagaggccgauuacuacgcaaaagaaguaacgaggguccuuaugguagaaacacacaaugaaaucuaugacaaguuuaaacagucaacucauuccauauacauguucuuuaauacaagcgaguugcgugaggccguuccggaaccuguccuuuuaucccgagccgaguugcgccuucuccggcugaaguuaaaaguugaacaacauguggaauuauaccagaaauauagcaacaauuccuggagguaucuuagcaaucgccuguuagccccuagcgauagccccgaaugguugucuuuugacguuacgggagucgugcggcaguggcuaucucgcggcggcgagaucgagggcuuucgguuaagcgcgcauuguuccugcgauucaagggauaauacacuacagguugacauuaauggauuuacuacaggcaggcggggugaccuagcgacgauccacgguaugaauagacccuuucuccugcugauggcaacuccuuuagaacgggcacagcaucuccagucgucaaggcacaggcgggcacuggauacuaacuauuguuuuaguaguacagagaaaaacuguugcguccgucaauuauacauugauuuucgaaaggaccugggauggaaguggauacaugaaccuaaggguuaccaugcuaacuucugccuggggcccugcccguauaucuggucucucgauacucaguauucuaaagugcuugcacucuauaaccaacacaauccuggcgcuucugcugcuccaugcugcgucccacaggccuuagaaccucuuccuaucguguauuacgugggccgaaagccuaagguagagcaguuaagcaauaugaucgugcgcuccuguaaaugcagcuag

SEQ ID NO: 61519 - RNA, 9156 nt, Artificial Sequence
  Description of Artificial Sequence: Synthetic coding sequence
auggccaccaacccgcagccacaaccgccaccuccggcuccacccccuccccccccccagccucaaccucagcccccgccaccuccaccgggacccggagcuggcccaggggcuggaggcgcaggaggcgcuggagccggggccggagauccacaacucguugccaugauuguuaaccaccugaaaucacagggacucuuugaucaauuucggcgcgauuguuuagcugaugucgacacgaagccugccuaccagaaucugaggcagaggguugauaacuuuguugccaaucaucuggcuacucauaccugguccccgcaucugaacaagaaccaauuaagaaauaauauaagacaacagguucugaagagcggaaugcuggaauccggaaucgaccgaaucaucucacagguggucgaccccaaaaucaaccauacauuucggccucagguugaaaaagccgugcaugaauuccucgccacguuaaaccauaaggaggaaggcagcgguaauaccgcucccgacgaugagaagcccgacaccaguuugaucacacaaggcgucccuacaccaggucccuccgccaacguugcaaacgacgcgauguccaucuuagaaaccauuacaucucugaaucaggaagccucagcugcccgcgccagcaccgagacaagcaacgcaaaaaccagcgagagagcuaguaaaaaacugccaucccagccuacaaccgauacaucuaccgacaaagaacgaaccagcgaagacauggccgauaaagagaaauccaccgcggacagugggggcgaggggcuagagacagccccaaagagcgaagaguucuccgauuugccauguccagucgaggaaaucaagaauuacaccaaagaacauaacaauuuaauccugcucaauaaggacgugcagcaggaauccucagagcagaaaaauaagucgacugauaagggagaaaagaagccagacucuaaugaaaagggagaacgcaagaaagagaaaaaagaaaagaccgaaaagaaguucgaccacuccaagaagucagaggauacucagaagguuaaagaugaaaaacaggccaaggagaaagaggucgaaagccucaaacugccaucagagaaaaacagcaacaaagccaaaacugucgagggaaccaaggaagacuuuagccucauagauagcgauguggacggccugaccgauauuaccguuucgagcguucacacaagcgaucugagcucuuuugaggaagacacagaagaggaagucgugacaucugauucuauggaagagggugagaucacuagugaugaugaagagaagaacaaacaaaacaagaccaagacucaaaccagcgacucaucugaggggaagacaaagucagugagacacgcuuacguccauaagccuuaccucuacucuaaauauuacagcgacucagacgacgaacugacgguggagcaaagaagacaguccauagcaaaagaaaaagaagaacggcugcugcgccgacagauaaaucgcgagaagcucgaggagaaaaggaagcagaaagcagagaagacgaagagcucaaagacuaaggggcaagggagaagcagcgucgacuuggaggagucaucuacuaagucccuggagcccaaggccgcacggauuaaagaaguacucaaagagcgcaaggugcuugagaagaagguggccuugaguaaaaagaggaaaaaagacaguaggaauguggaagaaaauaguaagaaaaagcagcaauaugaggaagauagcaaagagacccugaaaacgagugagcacugcgaaaaagagaagaucaguucuucuaaggaauugaaacacgugcacgcuaagagcgaaccuucaaagcccgccagacgccucagcgagucgcuucacgugguggaugaaaauaaaaacgaaagcaaauuggagcgagagcacaagcggcggacuagcacacccgucaucauggaaggggugcaggaagagacugacacaagagaugugaaacgucaaguugagcgaagugaaauuugcaccgaagaaccacagaagcagaagucaacccugaagaaugagaaacaucuuaagaaagaugacucagaaacuccucaucugaagagcuuacuaaaaaaggaaguuaagucaaguaaggagaagccagagcgagaaaagaccccuucagaggauaaacugucugugaagcauaaguacaaaggggacugcaugcacaagaccggagaugagacggaacuccauaguagcgagaaagggcuaaaggucgaagagaauauccagaagcagagccagcaaaccaagcugucuagugacgacaagaccgagcgaaagucgaagcacagaaacgagaggaagcucuccguccuggggaaggaugggaaaccuguuuccgaauacauaauaaaaaccgaugagaaugugcggaaagagaauaacaaaaaggagagaaggcugagugcagagaagacuaaagcugaacacaagagccguagauccucugacucuaagauccagaaggacagccuggggucaaaacagcacggcaucacgcugcagcggcggucggaguccuauuccgaggauaaaugcgacauggacuccaccaacauggauagcaaccucaaacccgaggaggucguccauaaggagaagagaagaaccaaaucauuacuggaggagaagcucguacuuaaauccaaaucuaagacgcagggaaagcaggugaagguaguggagaccgaguugcaggagggggcuacuaagcaggcuaccacacccaaacccgauaaagaaaagaauacugaagaaaaugauagugagaaacagcgaaaaucuaaaguggaagacaagccguuugaggagaccgggguugaacccgugcucgagacagcuucaagcucugcccauagcacccagaaagacaguucgcaccgggcuaaguuaccucuagccaaggagaaauacaagucugauaaggacucuacaagcacgaggcuggagcggaagcuaagugacgggcacaagaguagaaguuugaaacacucuaguaaagauaucaagaagaaagaugagaauaaguccgacgauaaagauggcaaggaaguagacagcucacaugaaaaagcucgaggaaauagcucacugauggaaaagaagcuuagccgucguuugugcgagaaccggaggggaagccugagccaggagauggccaaaggggaggagaagcucgccgccaacacccuaucuacccccucugguaguucucugcagcgcccuaagaagucaggggacaugacucugauuccagagcaggagccaauggaaauugauucugaaccagguguugagaacgucuuugaggucuccaagacacaggauaaccgcaacaacaacagccagcaggauauugacagcgaaaauaugaaacagaaaacaagcgccaccgugcagaaagacgaacuuaggaccugcacggcagauucaaaggcuacagcuccugcuuacaagccgggaagaggcacgggggucaauuccaauagugaaaagcacgccgaccaucgguccacccucaccaagaaaaugcacauucagagugccgugagcaagaugaacccuggggaaaaggaacccauacaccggggcaccacugaagugaacaucgacucagaaacagugcacagaaugcuacuaucugcccccagcgaaaaugauagggugcaaaagaaucugaaaaauacugcugcugaagaacauguagcucagggcgacgccacacuggagcacuccaccaaucucgauuccucacccagcuuauccucaguuaccgugguacccuugagagaaaguuacgacccggacgugaucccacucuuugauaaaaggacuguucuggaggguagcacagccucaacuucccccgcugaucacuccgcgcucccuaaucagucacugaccgugcgagagagcgaaguguugaaaacaagcgauuccaaagaggggggagaggguuuuacuguggauacucccgcuaaggccagcaucacuucaaagaggcacaucccagaggcgcaucaagcgacgcugcuagauggaaaacaggggaagguuaucaugccccuggguucuaagcugaccggugucaucgucgaaaacgaaaacaucaccaaggagggaggcuuggucgauauggccaaaaaggaaaacgaccuuaacgcugaaccaaaccugaagcagacuaucaaggccacgguggagaacggaaaaaaggacggcaucgccguugaucacguugucggacuuaacaccgagaaauaugcagaaacaguaaaauuaaaacacaagcggagcccagguaaggugaaagacauuagcaucgacguggagcguagaaaugaaaacagcgaaguggacaccagcgccggcagcggcagcgcaccuagcguauuacaccagcggaacggccaaacagaagacguggcuacuggcccacguagggcagagaaaacgucuguggcgacuucaacugaaggaaaggauaaggacguuacucuuagccccgugaaggccgggccagccacaaccacaaguagugagacuagacaguccgagguggcccuuccaugcacaagcauugaggcagaugagggcuugauaauaggcacacacagcagaaauaauccccugcaugucggggccgaggcgagugaguguaccguguuugcugcugcagaggaggguggagccgucgugacggagggguucgccgagagcgagacguuucugaccuccacaaaggagggagaauccggagagugcgcaguugccgaguccgaagaucgugcagcagaucucuuggccguccacgcggugaagauagaggccaauguuaacaguguggugacugaggagaaggaugaugcgguuaccucggcaggaagugaggagaagugugauggaucuuuaucccgggacagcgaaaucguugagggcaccauuacauucauuucggaaguugaauccgauggugccgucacgagcgccgggacggagauuagggccgggagcauuucgucugaggagguggacgggucacagggcaauaugaugcggaugggccccaagaaggaaacagagggcacagugacgugcacaggugcugaaggcaggucugacaauuuugucauuugcagcguaacuggggccgggccacgagaagaaagaauggugacaggugcaggaguggucuugggcgauaaugacgcaccaccaggcacuucagccucccaagaaggagauggaucuguuaacgaugguacugaaggagaaucagccgugacuucuaccggcauaaccgaagacggcgaaggaccagcgaguuguaccggauccgaagauucaagugaaggauuugcgauaagcucagagagcgaagagaauggggagucagcaauggacucuaccguggccaaggaaggaaccaaugugccucugguggccgcaggcccaugugacgacgaggggauuguaacgucaacuggggcgaaagaagaagaugaggagggggaggacguggugacauccaccggucggggaaacgagauagggcaugcaucaacauguacuggccucggcgaggaaucagaaggcguccucauaugcgaauccgccgaaggagacagccagauugggacagugguggagcacgucgaagccgaagccggugcugcaauuaugaacgcaaaugagaacaacguugacaguaugagcggaacugaaaagggaagcaaagacacugacaucugcuccuccgcuaagggaaucguggaauccucugucaccagcgccguuuccggaaaggaugaggugaccccagugcccggggguugcgaaggcccuaugaccagcgcggcaucggaccaauccgacagccaauuggaaaaaguggaagauaccacaaucucaacgggacuggucggggggaguuacgacguccugguauccggagaggugccugaaugugaggucgcacauaccagucccuccgagaaggaggaugaagacauuaucacgucuguugaaaacgaggaaugugacggccuaauggcuaccacagcuagcggagauauuacaaaucaaaacucgcuugcuggcggcaagaaucaggguaagguuuugaucauuagcacgagcaccaccaacgacuacacaccucaggucagcgccauuacagacgucgaggggggucugagugacgcguugagaaccgaggaaaauauggagggcacgaggguuacaacugaagaauucgaggcaccgaugccauccgcggucucuggcgacgauagccaacugacugccaguaggucugaggagaaagacgaaugcgccaugauuuccaccagcauuggagaagaguucgaacugccgaucagcucugcuacaacaaucaaaugcgccgaaagucuucagccgguugcagcagcaguggaagaacgggcuacaggcccugugcugauaagcacagccgauuuugaaggaccuaugcccucugccccccccgaggcagaaucuccccucgccaguacgucgaaagaagagaaggacgaaugcgcgcuuauauccacgucuauugcugaggaaugugaagccucagugucuggaguuguagucgagucugagaaugagagggccgggacggugauggaggagaaagacggcucaggcaucauuucaaccuccucuguugaggauugcgagggccccguaucguccgcugugccccaagaagaaggugacccaucuguuacgccagccgaggagaugggagacacagccaugauuucuacaagcacuuccgaaggaugcgaggccguuaugauuggagccgugcuacaggacgaggacagacucacaaucacucgagucgaggacuugucugacgcugccaucaucagcacuucuacagccgaguguaugccaauuagugccuccaucgaccggcaugaggaaaaccagcugaccgcagauaaucccgagggcaacggugaucucagcgcgacagaagugucuaaacauaaagugccuaugccgaguuugaucgccgagaauaacuguagguguccgggcccagugcguggcggcaaggagccugggccuguucuugcgguguccacagaagaaggccacaauggaccuaguguacauaagccuucagccggucagggccauccaagugcagugugugccgagaaggaagagaaacacggaaaagagugcccagagauuggacccuucgcugggcgaggccagaaagaaaguacucuccaucucaucaacgccgaggagaaaaacguccuguugaacucucuucaaaaagaggauaagucuccagagacuggaaccgcgggaggaucgaguaccgcuagcuacagugccggucggggauuggaagggaaugcuaacucucccgcacauuugcgaggaccugaacagacaagugggcaaacugccaaggaccccagcguuucuauuagauaucuggcugccgucaacacuggggcgauaaaggcagacgauaugccccccguccagggcacuguugcagagcauucauuucugcccgcugagcagcaagggucggaagacaauuugaagacaucuacaaccaaauguaucacaggacaggaaagcaagauugcacccucucauacuaugaucccacccgcuaccuauaguguggcucuguuggcuccaaagugcgaacaagaccugaccaucaaaaacgacuacuccggaaaguggacagaccaggccucugcggaaaagaccggagacgacaauucgacacggaaaagcuuuccagaggagggagacaucauggugacugugucgucagaagaaaauguuugugauaucggcaacgaggagucacccuugaacguccuuggcggucucaaacuuaaggccaaccugaagauggaggcauacgugccuuccgaagaggagaagaacggagaaauccuugcuccgccggaaucccucugcggaggcaagccuagcggaauugccgaguugcagagagaaccccuauuggucaacgaaagucugaauguagaaaauuccggcuucaggaccaacgaagaaauacacuccgaaagcuauaacaaaggagagauuagcaguggacgcaaagacaacgccgaagccauuucuggccacucuguugaggccgauccgaaggaaguggaagaagaagagagacacaugccuaagaggaaaagaaagcagcacuaccugucuagcgaagacgagccugaugacaacccugaugugcuggacagccggauagaaacugcacaacgucagugcccugagacggaaccucacgauaccaaagaggagaauuccagggaccuggaggaacugccaaaaacuuccagugagaccaacaguaccacaucuagagucauggaggaaaaagaugaguauaguucuucugagacuaccggagagaaaccagagcaaaacgaugacgauacuaucaagucgcaggaggaagaccaaccaauaauaaucaaaaggaaaagaggacgaccacggaaguacccaguugagaccacacugaagaugaaagacgacaguaaaacugacacaggaaucgugacagucgagcagucaccaagcaguagcaaacugaaagugaugcagaccgaugagagcaauaaggaaaccgcgaaccuccaggagcgguccauuagcaaugaugacggagaggaaaaaauagugacuuccguaagacgccggggcaggaaacccaagcggucccugacuguguccgacgacgccgaauccagcgaaccagagcgcaagcgacaaaaaaguguaagugacccuguggaggacaagaaggagcaggagagcgacgaggaggaagaagaagaggaggaagacgaacccaguggcgcuaccacaaggaguacgacacguucggaggcacagcgcuccaagacgcagcucucacccucuaucaagcguaaaagagaagugucaccacccggcgcucggacaagaggacagcagagaguggaagaggcucccguaaaaaaagccaagcgcuag

SEQ ID NO: 61520 - RNA, 624 nt, Artificial Sequence
  Description of Artificial Sequence: Synthetic coding sequence
auggaugacgaucugauguuggcucugcggcugcaggaagaguggaacuuacaggaagcagagcgagaucaugcgcaggagucucugucuuugguugacgcuuccugggaacuaguggauccuacaccagaucuccaagcucucuuuguucaguucaacgaucaauucuuuuggggccagcuggaagcaguggaggucaaauggucaguuagaaugacucugugugccggaauuugcucuuacgaagguaagggggguaugugcucaauaaggcugagcgaaccccuacugaagcugcggccucggaaggaccucguagagguuuaccauacauuucacgaugagguagacgaauacagaagacacugguggcgcugcaauggcccuugucagcacagaccaccuuauuauggcuacguuaagagagcuacaaaucgcgaaccuagugcucacgauuauuggugggccgagcaucaaaagacaugugguggcacguauauaaaaauuaaagaaccugaaaacuauucaaaaaaaggcaagggcaaagcaaaguuagggaaggaaccuguauuggcggccgaaaauaagggcacuuucgucuacaucuugcuuauuuuuauguag

SEQ ID NO: 61521 - RNA, 864 nt, Artificial Sequence
  Description of Artificial Sequence: Synthetic coding sequence
augaacgcacuggcuaacaucccagacgugcccgugaaguaccguaagaacgauauuccaggaccaggauuuuacaaugugauacaccagucaccugucaguaacuccguuuccuuauccaaaaaagguacauguauguucccaaguaugugugcuagacuggacacuauuaucagcaaauaccccgccgcuaaugccuauacaaucccuagcgauuucauaucgaagcgcgacuucagcaacucuuguucuaguauguuucagcugccaagcuuuaugaaagcacugaaguucgaaacccccgcacccaacuacuauaacgcuuccgugagcuguuguaaacagagaaacaacgugugcacucgggccggcuuuauguccaagacgcagagaggcucauucgcauuugccgauaaaggaccaccacccggccacuaugacauaaacgagucacuggugaaacagagcccuaauacucuuaugucgugcuuuaagagcaagaccaacagaggguugaaacugaccucaacuggcccuggcccuggcuauuacaacccuucugacugcaccaaagucccuaaaaagacccuguuccccaaaaauccgauccuuaacuuuucugcacagccuuccccauuaccccccaagccuccuuuuccuggaccaggacaguaugagauuguagauuaucuagggccccguaagcauuuuauuucuuccgcaucauuugucucaaauaccuccagauggacagcugcaccuccucaacccggucugccugggccagccacuuauaagccagaacucccagggaagcaguccuuucuguauaacgaagauaaaaaguggauucccgugcuguag

SEQ ID NO: 61522 - RNA, 939 nt, Artificial Sequence
  Description of Artificial Sequence: Synthetic coding sequence
augggccgacgacgggcggcacggggaccgggcgcugagggcggaaggccaagacaccucccaacaaggucacucgaagcauuugccgaagagguuggcgcagcauugcaggccucuguggaaccgggcgcagcagacggagagggaggccccgguccagccgcuuuaccuugcaccuuagccaugugggaacucgggcacugugauccgcgccguuguaccggacggaaacuugcuaggcugggccuugugaggugcuuacgccugggccauagguuugggggucugguacucaguccuguuggcaagcaguacgcuucccccgcagacagacaguugguggcccaguccgguguggccgugauagauugcuccugggcacgccuugacgagaccccauuugggaaaaugagagggagccaccugcgguuauugccauaucuuguugccgccaauccugucaauuaugggcggccauauagacugaguugcgucgaagccuucgcugccaccuuuugcaucguaggauuuccugauuuggcugucauacuccugaggaaguuuaaaugggggaagggcuuucuggaccugaaccgccaguuacuggauaaauaugccgccuguggcagcccugaggaagugcugcaggcggaacaggaguuccucgcuaacgccaaggaguccccccaggaggaggagaucgaucccuuugacguggacucuggacgugaauucggcaacccaaacaggcccguggcuucuacccgguugcccucggacacugaugacagcgacgcaagugaggauccaggacccggagccgagcgcgggggcgccucaagcucgugcugugaggaagaacagacccagggaagaggugcugaagcaagggcuccugcugaaguuuggaagggcauuaagaagcgacagcgcgauuag

SEQ ID NO: 61523 - RNA, 1023 nt, Artificial Sequence
  Description of Artificial Sequence: Synthetic coding sequence
augaaauauggaaacccuaacuacggggggaugaagggcauccucucgaauucuuggaagcgcagauaucauuccagacggauacagcgagaugugauuaaaaagagggcccugauuggggacgauguuggacuaacgaguuacaaacaccgacacuccggcuuggugaaugugcccgaggagccuauugaagaagaagaagaggaggaggaagaggaagaagaagaggaggaggaagaccaggauauggacgccgacgauagaguaguuguugaauaucacgaggaguugccugcccugaagcagccacgggaaaggucagcaagccgaaggucaagcgcuagcucgucugauagcgacgaaauggauuacgauuuggaacucaaaaugauaucuaccccuucucccaaaaagucuaugaagaugaccauguacgcagaugagguagaaucacaacucaaaaauaucaggaacucuaugcgggcagauagugugagcaguucuaacaucaaaaaccgcaucgguaacaagcugccuccugaaaaauuugccgaugugaggcaucuccucgaugaaaagaggcaacacucacguccucggccaccagugucgucaacaaaaucagacauaagacagcggcugggaaaaagaccucacucuccugagaaagcauucagcagcaacccuguaguccguagagagccaagcuccgacgugcacagccgucugggugugcccagacaggacucuaaaggacuuuacgccgacacgagagaaaagaaaucugguaaucuguggacgagacuuggguccgcuccaaaaacaaaggagaaaaauacaaaaaagguugaccaccgugcaccuggugccgaggaggacgauucagaguuacagcgugcuuggggagcucugaucaaggaaaaagagcagagccgucaaaagaagucuagauuggauaaccuuccuucacuacagauugaggucagcagggaaucuagcuccgggagugaggccgaaaguuag

SEQ ID NO: 61524 - RNA, 921 nt, Artificial Sequence
  Description of Artificial Sequence: Synthetic coding sequence
auggguugcgauggggguacuaucccaaaacgccacgaguuaguuaaagggccuaaaaagguagaaaagguugauaaggaugccgagcugguagcucaauggaauuacugcacauuaucccaagaaauuuugcggagaccaauagucgcuugcgagcugggacgguuauacaacaaggaugcaguuaucgaguuucugcuugauaagucagcugaaaaggcacucggaaaagccgcuagucacaucaagucaauaaagaaugugacugaguugaagcugagcgacaacccagcaugggagggggauaagggaaauacaaaaggcgauaaacacgaugaccuucaaagagcaagguuuaucuguccagugguaggguuggaaaugaauggcagacaccgguucugcuuucucagauguugcggguguguguuuagcgaacgagcccuaaaggagauaaaagcugaaguuugccacacaugcggagcggccuuucaagaggacgaugucauuauguugaacgguaccaaagaggacgucgacguccuuaaaacacgaauggaagagaggcgccugagggcuaagcuggagaagaaaaccaagaaacccaaagcagcugaaucagucagcaagccugacguuucugaggaggcuccugggcccagcaaagucaagaccgggaagcccgaggaagcuagccucgacagccgggaaaaaaaaacaaaucuugcgccaaaaagcacagccaugaaugaaucuucuagcggcaaggccggcaaaccgccauguggagcaaccaaacgguccauugcugauuccgaagaaucagaggccuauaaaucuuuguuuacgacacauuccagcgcaaagagauccaaggaggaaagugcacauugggucacucauacaaguuacugcuucuag

SEQ ID NO: 61525 - RNA, 627 nt, Artificial Sequence
  Description of Artificial Sequence: Synthetic coding sequence
augcagcgacccgaguggccaaggccccaccccggugagggugcagccgcugccggcagggguccugcucccccagcaagggccggugagccauccggguuacgacuucaagaaccaagccuguauaccauuaaagcagucuuuauacuggacaacgaugggaggcguuuacuggcaaaguauuaugacgacacuuucccaucaaugaaagaacaaaugguguuugaaaagaauguuuucaauaagacaucccggaccgagucagaaauagcuuuuuuuggugggaugaccauaguuuauaaaaacuccauagaucucuuucucuacguuguuggauccaguuacgagaacgagcuuaugcucaugucuguguugacaugucucuucgagagucuuaaccacaugcuucgaaaaaauguugaaaaaagauggcuucuugaaaauauggacggggccuucuugguguuggaugagaucguugauggcggugugauucuugaaagcgauccccagcaggugauacaaaaggugaacuuuagagcagaugauggcggccucacagagcagaguguugcucagguccugcagagcgcaaaggagcagaucaaauggagccuccucaaauag

SEQ ID NO: 61526 - RNA, 486 nt, Artificial Sequence
  Description of Artificial Sequence: Synthetic coding sequence
augcccaagaaugcuaucccagucagcaaguccacaggcuucucgaaucccgcaagucagaguacaucucagcggcccaaauuaaaaagggugaugaaggaaaagacaaaaccucagggaggagaaggcaaaggggcucaaaguacuccaauucagcauagcuuucugaccgauguuuccgacguacaggagauggagaggggacuucugucuuuguuaaacgacuuucacaguggcaaguuacaagcuuuuggcaacgaguguaguauagagcaaauggaacaugugcgcggcaugcaggaaaaguuagcgcgacugaaccuggagcuguacggagaacuggaagagcugccggaagacaagcgaaagaccgcauccgauagcaacuuagacagacuauugagcgacuuagaagagcugaauagcagcauucagaagcugcacuuggcugaugcgcaagacguaccaaacacaagcgccucguag

SEQ ID NO: 61527 - RNA, 2748 nt, Artificial Sequence
  Description of Artificial Sequence: Synthetic coding sequence
augagaaaaagcagcagccccagccugaguaacugcaacucaguccucgcgaauaagauauucgguaucccuuuggaugagcugcagcagggaggccauccagauaaugaagucccauuuauaguccggcauguugucgacuacauugaggagcaugggggucuugaacagcaaggacuguuccaggugaacgggaaugcagaaaccguggaauggcugagacaacgauaugacucuggagaggaaguugauuuggugaaagaagcagacguuccuagcgcuauuucucugcuccgcuucuucuuacaagagcucccagagccaguaauccccgggucccuccauauccaucucaugcaguugucucaggauuauaauaacgaggaugaauucgggagaaaguugagguuucugcuccagcagcucccaccugugaacuacagucuccucaaguuucucugccgauucuuagccaacguugccucucaccacgaagagaucuggagcgcuaacuccuuagcagcgguauuugggccugauguuuuccauaucuacacagacguggaggauaugaaggagcaggagauugucucgagaauaauggcagguuuguuagagaacuauuacgaguucuuugaaaaugaggaagaagacuuuucuuccaaugaucucuccaguaucacugaacagguuaaugagcugagugaggaagaagaggaggaugagaaacuggagcauauagaggaacugcccgaggaaggcgcggaaaagucaaaugauaugcccgaggugguucaacuuagaaugacagagaauauccuggagucgaauucugucacagccaccaguacccacaucaguccgaucuccauccugccugccucuacugauauucuugaacgcacuaucagagcggccguggagcaacaucuguucgauuugcagagcucgaucgaucaugaccuuaagaauuugcagcagcaaagcgucguguguaacaaugaagcugagucaauucauugugacggggagggaagcaauaaccagaucgauauagccgacgacaucauuaacgccucagaguccaauagggacuguuccaagcccguagcuucaacuaaccuggacaacgaggccaugcagcaggacuguguuuuugaaaacgaagagaauacccaauccguggggaucuugcuggaaccuuguagcgaccguggcgacagugaggacggauguuuagagagggaggaauaucucuuguucgacuccgauaaguuaucccaccugaucuuagauucaaguuccaagaucugugaucucaaugcuaauacugagagugaagugccugggggucaaagugugggcgugcagggagaagccgcuuguguaaguauuccacaucuagaucuuaagaacguuuccgauggagauaagugggaagagccauucccugccuuuaaaaguuggcaggaggacagcgaaucuggcgaggcucaguugagcccacaggcaggucgcaugaaccaccacccauuagaggaggauugcccaccggugcucagucaccgcucucuugacuucgggcagagccaaagauuccugcacgauccugagaagcuugauagcucuucgaaagcacuaucauucacucgcauccgccggaguuccuuuaguaguaaggacgagaaaagagaggaucggacgcccuaccagcuggugaaaaaguugcaaaaaaaaauccgccaguuugaggagcaguucgagcgagagaggaacagcaaaccuucauauuccgauaucgccgcaaaccccaaggugcucaaauggaugacagaacuaacuaagcugagaaaacaaauuaaggacgcaaagcauaaaaacucugacggggaauucguaccccagaccagaccucgguccaacacacucccuaaaucuuucgguuccucccuggaucaugaggacgaggaaaaugaggacgagccaaaggugauucagaaggagaaaaagccaagcaaggaagccacccuugaacugauucugaaaagauugaaagagaagagaauugaacggugccugcccgaggauaucaaaaaaaugacaaaggaucaccugguagaagaaaaggcuagccuucagaaaagcuuacucuacuacgagucacaacacgggcggccgguuacaaaggaagagcggcauauugugaagccccuguacgaccgcuauagacuagugaagcagauguugacucgcgccucuauuacuccaguccuaggcucuccaaguaccaaaagaagggggcagauguugcagcccaucauugagggcgagaccgcucauuucuucgaagaaauuaaggaggaggaggaggaugggguaaacuuaucuagcgaauugggcgauaugcuuaaaaccgcaguacaggugcaaaguucacuggagaacucugagagugaugucgaggaaaaccaggagaaacuggcccuggaucugagacugucauccucucgcgccgcuagcaugccugaguuauuagagcagcucuggaaagcuagggccgaaaagaagaaacugagaaagacgcugagagaguucgaagaggcauucuaucaacagaauggacggaacgcacagaaagaagacaggguacccguccucgaagaauaccgagaauacaaaaagauaaaggcuaaacugcggcuccuggaaguguugaucuccaaacaggacucuucuaagucgauauag

SEQ ID NO: 61528 - RNA, 735 nt, Artificial Sequence
  Description of Artificial Sequence: Synthetic coding sequence
augaaccccguguacaguccugugcagccuggagcacccuacggcaaccccaagaauauggcauacacaggcuauccaacugccuacccagccgccgcgccagccuauaacccaagucuguacccuaccaauucacccucauacgcuccugaguuucaguuccuccacagcgccuacgccacccuccugaugaagcaagcuuggccucagaauuccaguuccugugggaccgagggcacguuucauuugccugucgauacuggaaccgaaaaccguaccuaucaggcuucuucugcugcauuccgcuacacugcagguacacccuacaaaguccccccgacucagagcaauacagcgccaccacccuauucuccaagcccaaauccauaccagaccgccauguaccccauacggagcgccuacccucagcagaaucucuacgcucagggcgccuauuauacccaaccgguauacgccgcucagccacacguaauucaccauaccacaguuguacaaccaaauaguaucccauccgccauuuaccccgccccgguugcagcuccgagaacaaacgggguggccaugggcaugguugcugggaccacgauggcuaugucagccgggacccuccucacaacaccacagcacacggccauuggagcccacccuguuucgaugccuacuuaccgcgcccaagggaccccagccuauuccuacguuccaccgcacugguag

SEQ ID NO: 61529 - RNA, 2841 nt, Artificial Sequence
  Description of Artificial Sequence: Synthetic coding sequence
augucgguaaggcuccgguuucugucucccggcgauaccggugccgucggcgugguaggccguagcgcuucauuugcagguuucagcagcgcccagaguaggaggauugcuaagaguauaaaccggaauuccguacgguccaggaugcccgcaaagucaucgaagauguaugggacccugcggaaagguuccgugugcgcugaccccaagccccagcagguaaagaaaauuuucgaggcuuugaagagagggcugaaagaauaccucuguguucagcaagcggaacuggaucaucugucuggcagacauaaggauacaagacgcaacagccggcuagccuucuauuacgaucucgacaaacagacacguugugucgaaaggcauauccgaaagauggaauuccauauuaguaaaguagaugaguuguacgaggacuacuguauucaaugcagacugagagauggagcuuccagcaugcagagggcuuucgccaggugccccccuaguagagcagcucgugaaagucuccaggaacuuggccggaguuugcaugaaugugccgaggacauguggcuuaucgaaggggcucucgagguucaccuuggagaauuucauaucaggaugaagggccuggucggcuaugcuaggcucugucccggggaucacuacgaggugcugaugcgucuuggcagacagcgauggaaacuuaaagggcggaucgaauccgacgacagucagacgugggacgaagaggagaaagcauucaucccuacccugcaugaaaacuuggacauuaagguuacagagcugcgcggccugggaagucuggcagugggggccgugaccugcgacauugcagauuucuucacuacccggccucagguaauugucguggauaucacagagcucggaacaauuaaacugcagcuggaggugcaauggaacccuuuugacacagagagcuuucucgugagcccaucccccacuggcaaguuuucuaugggaaguagaaaaggcaguuuauacaacuggacccccccaucuacaccgaguuucagagagcgguacuauuuaucuguccuccaacagccuacucagcaggcgcuauugcucgggggcccaagagcaacaagcauuuuaucauacuuguccgacagcgaucuccgggggccuucucuaagaucccagucucaggaauugccggaaauggauagcuucagcagcgaggauccgcgggacacugagacauccaccuccgccagcacauccgacgugggcuuuuugccccucacuuuuggcccccacgcaagcaucgaagaagaggcaagagaagacccacucccaccugggcugcuccccgaaauggcccaccugucuggcgggcccuucgccgagcaaccaggguggcgaaaccugggcggugagagcccuucccugccacagggaucacuguuccacucaggaacugcauccagcagucagaacggacaugaagagggcgccacuggggaucgggaggacgguccuggaguagcacuugagggcccucugcaggaagugcucgaacuccuuaggcccaccgacaguacacagccccaguugcgagaauuagaauaccaaguuuuaggguucagagauagauuaaagccauguagagcuagacaagaacacacgagugcagaaucccugauggagugcauacuagaguccuuugcauuucuaaaugccgauuucgccuuagaugaacuguccuuguucgggggcucacaggggcuccguaaagaucgaccccugccacccccuagcucccugaaagccucaucucgugaacugaccgccggugcgccagaacucgauguccugcugauggugcaucugcagguaugcaaggcauuacugcagaaguuagcuucgccaaaccuaucacgauugguccaagagugucuccuggaagagguggcccagcagaagcauguguuagagacucuuagcgugcuggacuuugagaaggugggcaaggcaacgucgauugaggagauuauuccucaagcaucgcgcacaaaagggugucucaagcucuggcgagguugcaccggucccgguagaguucugucuugcccugccacaacccucuugaaucaauugaagaaaacguuccagcaccggguccgaggcaaguacccggggcaauuggaaauugccugccgacggcuacucgagcaaguaguuucaugcggaggccucuuaccaggggcgggacugccagaagaacagaucauuacaugguuucaguuucacucuuaucuccagcggcagucggugagugaucucgagaagcauuuuacucaguuaacuaaagaggugacccugauugaagaacugcacugcgcagggcaggcuaaggucguaaggaaacugcagggaaagagacugggucaguugcagccccugccacagacguugagggcaugggcccuguuacagcuggacgguacaccccgggucugcagagcugccucagcucgacucgcaggggcaguccggaaucgcaguuuucgagagaaggcccugcuguuuuauacgaacgcccuggcugagaaugacgcccgcuugcagcaggcugcauguuuggcccugaagcacuugaaagggauugagucaauagaucagacugcaagcuugugucagagcgaccucgaggccguucgagccgcugcccgcgagaccacguuaagcuuuggugagaaggggcgccuggccuucgagaaaauggacaaacuuuguagcgaacaaagagaaguuuucugucaggaggccgauguagagaucacaaucuucuag

SEQ ID NO: 61530 - RNA, 1026 nt, Artificial Sequence
  Description of Artificial Sequence: Synthetic coding sequence
auggcugcucuguacgccugcaccaagugccaucagcgcuuccccuuugaggccuuaucccaaggccaacaguuguguaaagaaugccggaucgcucauccaguagugaaauguacauacugcaggaccgaauaccagcaagaacgccuggaaugcaacgggacuaucuccgcacauuguaaccuucaccugccaggcucuagcgacucgcccgcaaguaguucgcgcguugcgggaauuacagguauuaagaccaacacaaucugcaagaaaugugcccagaacguccaacuuuaugguaccccuaaaccaugucaguacugcaauauaauugccgcguucauuggaaauaagugccagagauguacaaauagcgaaaagaaguaugguccuccauacucuugcgagcagugcaaacaacaaugcgcuuucgaucggaaggaugauaggaagaaggucgacgggaagcuuuuaugcuggcugugcacacucagcuauaaacgaguucuacagaaaaccaaagagcaaaggaagcaccugucuagcucuucuagagcuggccaucaggaaaaagaacaguacucacgccugucuggaggcggccauuauaacucacaaaagacuuuaagcacguccaguauucagaaugagauccccaaaaagaagucgaaauuugaaaguaucacaacaaacggagacagcuuuagcccagauuuggcucuggacagcccuggcacugaucauuuugugauuauagcucagcugaaggaagaagucgccacucugaagaaaauguuacaccagaaggaucagaugauuuuggagaaagagaaaaagauaacugaacugaaggcugauuuucaauaucaggagucacagaugcgcgccaagaugaaccagauggagaagacccauaaagaaguuacugaacagcuucaggcuaagaauagagaguuauugaaacaggcagcugcacuuucuaagucuaagaaguccgaaaagucuggagccauuacaagccccuag

SEQ ID NO: 61531 - RNA, 975 nt, Artificial Sequence
  Description of Artificial Sequence: Synthetic coding sequence
auggcaucugaggcucuacaucagguuggagauggcgaagaagcuguucugaaaaaagaaaauuucaauaugaugaacgcucucgaccagcuuccaaagcccuuuucaaaccccaaaucuaugaaccgaaccgugacaacuaagggcuuaccccuggccagcaaaggaaaucugguuaauuuccucgaagaugauacaauuaaucuccuuaagccccuucccguagaagauagcgacuguucuagugaugagacaagcaucucugcauucucuagcacgcugcucaacccgaucaaauuggcggucacacagccuaacucuucuuucuuugcugggauguuagaaggcgaacugaacaaacucuccuucucaccuauggccaaaaaugcggagaacgaagaucuagccuugggcccaugucccugcccaucaaaaagccagauggcuacuaggggacuucucgaucucgacaaucccgaguuagagacugaaaccucuucuacccauagcgaauccucaguagugguugaccuccccgacacacccuuuauuuuugaacauacugucaauaauagcacagcagucaucagcuggacguacgcccuggguaaacagccgguuagcuuuuaccagcuguugcuucaagaaguggcgaagacccaggagaacgaauugccggaggcuaagaaucggcccuggauuuuuaacaaaauccuugguaccaccguaaaguugauggaauuaaagcccaacaccugcuauugccucagcguaagggcagcgaauacagcuggggugggaaaauggugcaagccauacaaauucgccacccuugcaacugacuuuucaucguucccugagaauuacccgauucagaucacaguucgucggaaggaaccgcgucagaaaauugugaguauugggcccgaggagaugcgccggcucgaagacuuagaauauuuauuuccauguuag

SEQ ID NO: 61532 - RNA, 3948 nt, Artificial Sequence
  Description of Artificial Sequence: Synthetic coding sequence
augaacuuuuugucuaccgcagagagcaggaccgcacaggcugccgccuccggcacuacccuucuuccccaguuucgcgcgcccucauggcagaccggcaugcacagcuccgccgcuaccgaacuuuuugcaaccggucccuugcccucaaccggcacucuaccaccuucacucuccgcguaucaacacccuaccaccuuuucuaauaggaacuucgcuacuacaucaccccuggugcuccaggacucaacuuuuaacaccacuuccaacgggauccucagucaccacgauccccuccugcagaucaagacaucacagggaacggugcccaccgccuuggcuuuugagagguugggcucuucaguuuugucaaacuccauuccuccacagucaucaacguaucgaagcgcccaagaaucugccccucaucucuuacagccccaguuuucucugcuaccuagcgcucugggcgggagccagcagacaccucaagcauacuccagcacucuuuucaccucuucaacagcuucgauugagagagccuuguugcgugaguguuccguuaucaaacaucaucaaaggccuuccgguacucagucaauucaggcucaacugaccggcagccagcacagccugcauaguuaccugucaaauagcucugucgucaauuuccaggaaacuacacgccaaucuucuuugucauguagccccaucggcgacaguacacaaaaucuacccgauaguucuccgacacaaaacuauauaucuaugcauagcucacaaaacgugcagacacaagagagcuccucaccccagucccagaaguuuuuaccggcaguacaaucuucgucuuuugccuccaguacacauugccaaacucuucaaaauaauauuacauccccugauccaaaaagcuacgcugaacgcaagcucgauagcgaugucuaucccagcucaaaacaggaggauggguuuccaaugcaggaauuacaaguguugcaaccucaggcuucuuuggaaagcagcacccagcggcucucugacggggaaaucaaugcccaggaauccacauauaaagugagcaaagcagacgaucgguauucccagagcguaauccgaaguaauucacggcuggaggaccagguaaucggaguggcccuucaggccaguaagaaagaagaaucgguggugggcagcgugacccagcugaaccagcagauaggucaggugaauaaugcagcuacacuagaccuuaagaacuccaccaaccugauucagacaccucaaauacgacugaacacaaaagaccugaaacagcagcauccucucauccuaaaaguccaugagucaaaaguccaggaacagcaugaccaaauuauuaaugcgagcagccaaauccaaauaccuaaucaugcccugggacaugggcaccaggccagccugccaaauacccagguacuccucgacagugcgugugacuugcaaaucuugcagcaaagcauucuccaggcuggacugggucaggugaaagcuucccuccaggcccaacgcgugcaaagcccccaacagauuguccaucccuuucugcagauggagggucacgugauccagucuaacggggaucacucucagcagcaacuucacccacagaacuccgaaguaaugaagauggauuugucagagaguagcaaaccccuucagcaacaucuaacaacuaagggccacuucucugaaacuaaucagcacgacaguaaaaaucaguuugucucccuaggcagcaugugcuuuccugaagcugugcugcuuagcgaugagcggaacauccucaguaacguagacgacauucuggcugcaacagcagcugcuugcggagucaccccaacagauuuuagcaaauccaccucuaacgaaacuaugcaggcgguggaagauggugauagcaaaucucauuuccagcagagccuggacguaagacaugugaccagcgauuucaacuccaugacugcgacugugggcaagccccaaaauauuaacgacacaagccucaacggaaaccaaguuacggugaaucuuaguccugugccugcauugcagagcaagaugacacucgaccaacagcacauugaaacccccggacaaaauaucccgacuaagguaacaagcgcaguugugggcccaagccaugaaguucaggagcagaguagcgggccauucaaaaaacagucagcaacuaaccuggaaucggaagaagacagcgaagcuccuguugauucgacuuuaaacaauaacaggaaccaggaauucgugagcucuucccguucuaucagcggcgaaaacgcuacaucagagagugaguuuacucugggcggggacgauuccggagugagcaugaacccugcuaggagugcccucgcacuacuggccauggcccaaucgggcgaugcuguguccgugaaaauugaagaggaaaaccaggaucugaugcacuucaaucugcaaaagaagcgggccaaagguaaggggcaggucaaagaggaagacaacuccaaccagaagcaacugaaaagaccugcccagggaaaaagacagaauccuagagggacagacaucuaucuuccauauaccccuccgucgucugagucuugucacgacggguaucagcaccaggagaaaaugaggcaaaaaaucaaagaagucgaggagaagcaaccugaagugaagacagguuucauugccagcuuccuugacuuccugaaaaguggccccaaacagcaauuuagcacacucgccgucagaaugccuaacaggacccgccggccugggacacagaugguccgcacauucuguccacccccucuccccaaacccuccagcaccacuccaaccccacugguaucagaaaccgggggaaacagcccaucggacaagguggauaacgaacuaaagaaccuggagcaccucucaucguucagcucagacgaagaugacccaggauauucucaggaugcuuacaagagcguguccacaccccucacgacacucgaugcaaccucagacaagaaaaaaaagacugaggcauugcaaguggcuacuaccaguccuaccgccaacacgacaggaaccgcaaccacguccucuacgaccgugggcgcgguuaagcaagagccccuccauagcaccaguuacgccguuaacauauuagagaauauuucuucaucagaguccagcaagcccaucgaguuagacgggcugccuuccgaccaauucgcaaaaggccaagauacuguugccauugaaggcuucacagacgaggaggauaccgaguccgguggcgaggggcaguacagagagcgggaugaauucguugucaagaucgaagauaucgagaccuuuaaggaagcacuuaagacggggaaggagccacccgcuauauggaaaguacagaaagcccuccugcaaaaguucguccccgagauccgggacgggcagagggaauuugcagcuacuaacaguuacuugggguacuucggagaugcuaaguccaaauauaagcgcaucuauguaaaguuuauagaaaacgcaaacaaaaaggaauaugugagaguguguagcaagaagccuagaaacaagccuucccagaccauucguaccguucaggcuaaaccaucgucaagcaguaaaaccuccgauccacuugccuccaagaccaccacaacuaaagcuccuagugucaagccgaagguaaaacagccgaaggugaaagcagaacccccuccaaaaaagaggaagaaguggaaggaagaguuuucuagcucacaguccgacucaucucccgagauccauacgucaucuucugacgacgaggaauucgagccaccagccccauuuguuacccgauuccuuaacacaagagcaaugaaagaaacguuuaaaagcuauauggaauag

SEQ ID NO: 61533 - RNA, 693 nt, Artificial Sequence
  Description of Artificial Sequence: Synthetic coding sequence
augaagcugauagugggaauagggggcaugacaaaugguggcaagaccacacuuaccaauucuuugcuuagagcacucccaaauuguugcgugauucaccaagaugacuucuucaagccucaggaucagauagcuguuggggaagacggguucaagcagugggacguccuggagucccuggacauggaagcaauguuggacaccguucaagcguggcucucuucuccacaaaaguucgcacgcgcgcacgguguguccguucagccugaggccucugacacacacauacuccuccuugaggguuuucuccuuuacucuuauaagccccuuguggaucuguauagucgacguuacuuccuaacugugccguaugaagagugcaaguggcggcggucuacacguaacuacacaguaccugaucccccuggguuguucgacggucauguauggccuauguaucagaaauaucgacaggagauggaggcaaauggaguggaggucguguaccuggaugguaugaagagccgcgaagaguuguucagagaggugcuagaggacauucagaacucccugcuuaaccgaagccaggaaagugccccaucaccagcccggccugcacgaacacagggucccgggcgcggcuguggacacagaacugcaagaccggcugcuagucagcaggacuccauguag

SEQ ID NO: 61534 - RNA, 1032 nt, Artificial Sequence
  Description of Artificial Sequence: Synthetic coding sequence
auguccgacgaagacgaccuugaagacagugaaccagaccaggaugauucggaaaaagaagaagacgagaaagagaccgaggagggugaagauuaccgcaaggagggugaggaguucccagaggaauggcucccuacuccucugaccgaagacaugaugaaggagggccuuucucuacuuugcaaaacugggaauggacuagcccaugcguaugucaagcucgaagugaaagagagggaccugacagacauuuauuugcucagauccuauauccaccugcgguauguggacauuucagagaaccaccuaacggaccuuucuccacugaacuaccugacucauuugcuuugguugaaagcagacgguaauagacuucgcuccgcccaaaugaacgaacugccguaccugcagauugcaagcuuugccuauaaccagaucaccgacacagaagguaucagccaucccagauuagaaacgcugaaucugaaggguaauuccauacauauggugaccggccuggauccagaaaagcucauuucgcugcacaccguggaacucaggggaaaccagcuagaaucuacucugggaauuaauuuaccuaaacucaagaaucucuaucuugcccaaaacaugcucaaaaaaguggaaggauuagaggaccuguccaaucugacaacucuccaccuacgcgauaaucagaucgacaccuuaagugguuucagucgggagaugaagucccuccaauaccucaaccuuagggguaacaugguggcuaaccucggcgagcucgccaagcugcgugauuuacccaaacugcgcgcccucguacugcucgacaaccccuguacugacgagacauccuaccgucaggaggcucuggugcagaugccauaccuagaacgacuggacaaggaguuuuacgaagaagaggagagggcugaggcugacgugauaaggcagcggcuaaaggaagaaaaggaacaggaaccagagccccagcgcgaccuggaaccagagcagagccugauauag

SEQ ID NO: 61535 - RNA, 618 nt, Artificial Sequence
  Description of Artificial Sequence: Synthetic coding sequence
auggugcagcucgcccccgccgccgccauggaugaagugacguuccguucagacaccgugcucagugacgugcacuuauacacccccaaccaucggcaucuaaugguuaggcugaacagcgugggccagccugucuuucucucucaguuuaagcuuuuguggucucaggacaguuggaccgauuccggcgcaaaaggggggucccacagagaugugcacacgaaggaaccaccaucugcugaaacggguucgacagggucccccccuggcagcggacacgguaacgaaggguucuccuugcaagcaggcacugacacaacuggacaagaaguggccgaagcccaacuggaugaggauggggauuuagacgucgugcggagacccagggcagcgucagacucaaauccugccgguccuuuacgcgauaaagugcacccaaugaucuuagcccaagaagaagaugacguguuaggcgaagaggcccaaggauccccucacgauauaauccggauagggguggccggccgaccagcccccggacggcugcacccggugccaaccggcccgcucccgagaauguacucagcaggagcccggggcagacauggcgcccgcuag

SEQ ID NO: 61536 - RNA, 762 nt, Artificial Sequence
  Description of Artificial Sequence: Synthetic coding sequence
augcccuugcugcccuccacaguuggauuagcugguuuauuguucugggcugggcaggcagugaaugcacuuaucaugccaaacgcaacucccgccccggcucagcccgaaucuacugccaugaggcugcuaucuggccuggaggucccccgguaccgacguaaaaggcacauuucagugcgcgacaugaacgcacuccucgacuaucacaaccacauaagggcuaguguuuaucccccagcggccaauauggaguacauggugugggauaagagacuggcacgugccgcugaagcuugggcaacucaaugcauuugggcccauggacccucacaguugaugagauacguuggacagaaccucucuauucauagcggacaguaccggucuguggucgacuuaaugaagagcuggagcgaagagaaguggcacuaucuguucccagcacccagagauugcaauccccauuguccauggagaugugacggucccaccugcucccacuacacccagauggucugggcaucaagcaaucgacuuggaugcgcaauccacacauguucgucgaucuccgugugggggaacaccuggcauagagcugccuaccuaguuugcaacuacgcaauaaaggggaacuggauuggcgaaucgcccuacaagaugggaaaacccugcaguuccugucccccaagcuaucagggcuccugcaauucuaacauguguuucaaggggcugaagucaaauaaauucaccugguucuag

SEQ ID NO: 61537 - RNA, 6708 nt, Artificial Sequence
  Description of Artificial Sequence: Synthetic coding sequence
augccauuguuuuucagcgccuugcuuguacuccugcuuguggcacuaucggcacucuuucucgggagauggcuaguggugcgccucgcaaccaaauggugucagcguaaacuucaggcggaacuuaagaucggaucguuccguuuuuuuuggauccagaauguaucuuugaaguuccaacagcaucagcagaccguugaaauugacaaucucuggaucucaucaaagcugcugagccacgaccugccccacuauguggcucuauguuucggugagguucggauccgcaccgaucuacagaaagugagcgaucugucugcuccuuucagccagagugcugggguggaucagaaggaacucaguuucagccccuccuuacucaaaauauucugucagcuauuuaguauucacguagaugcuauuaacaucaugguucugaaagucgauacauccgagucucuguggcauauccaaauuucaagaagccgcuuucuguuagacuccgacggcaagaggcuuaucugcgaggucucacuguguaagaucaacagcaaaguuuugaaaucaggacagcuggaagauaccugccugguggagcuaucacuggcucucgaucugugucuuaagguugguaucucuaguaggcaucuaaccgcuaucacaguagacguauggacucugcaugccgaguugcaugaaggguuauuucagucucaacuccuuugccagggaccaucucuggcuagcaaaccaguaccgugcagcgaggugacagaaaaucugguugagcccacacugcccgggcuauuucuacuccagcagcuccccgaccaagugaaagugaaaauggaaaauacaagugugguccugagcaugaauucgcagaaaaggcaucuaaccuggacccuuaaacuacuccaguuuuuguaucacagggacgaggaucagcugccacucagauccuuuaccgcaaauagugacauggcacagaugagcacagaguugcugcuggaagauggccugcugcucucccagucaagacagcguauugugugccuuaauucucugaaggccagcgugcaggucacuacuaucgaccugagugccagccugguccuaaauaccugcauaauccacuacagacaccaggaauucucucacuggcugcaccugcucgcccuggaaacgcaagguagcuccucacccgugcugaagcagagaaagaagcgcaccuucccccaaauccuggcaccaauaauuuucagcaccagcaucucuaacgugaauaucagcauucagcugggggacacuccaccuuuugcgcuggguuucaauucaaucucacucgacuaccagcaccugagaccccagaguauucaccaaaggggcgugcuaaccguggaucacuuguguuggaggguugggucagacucucacauccaaagggcaccccacccucccaauaugcacguuuggggcgaggcgcuggugcucgacucuuuuacucugcagggauccuauaaucaaccccugggccucagcucgacucaguccgacacucuguucuuggauugcaccauccgcgguuugcaggucgaggcgagcgauaccugugcucagugccuguccagaauccugucccuuauggguccucagaguggaaaaagugccgugucccgccacaguuccuuuggggaaagugugagcuuacuguggaagguagaccucaagguggaggacaugaaccucuucacgcugucagcucuggugggugcgucagaggugaggcuggacacucuaacaauacuuggcucggcugagacuuccaccgucgggauccaaggcuugguucuagcccuggucaagagcguuacagaaaaaaugcagccaugcugcaaggcuccggauauuccaacucccgugcugagccuaagcauguuaagcauuaccuaccauucguccauacggagucucgagguacaguguggcgccgggcuuacauuacuguggucacccccugaucacauguaccucuaccaacacguguuggcgacccuacagugucgcgaccugcuucgcgcaacagucuucccagagaccgugcccucgcuggcucuggagacgagcggcaccacauccgaguuggaaggccgagcacccgagccgcuccccccuaagcgacuguuaaauuuaacauuagaagugaguacagcuaaacucaccgcuuucguggcugaagauaaauuuaucacgcucgcugccgaaagcguaucacuaagcagacauggcgguucucugcaggccuauuguccugagcuggcagccggcuucgacggaaacucuaucuuuaauuucaaagaaguugaaguacaacuacugccagagcuggaagagaugauucuucaccggaaucccuuuccagcacugcaaacauugcgcaaucgaguguggcuuuuaucauuugggagcguuucuguugaguucccauaucaguacgauuucucucguaccuuagaugaggcugugggcgugcagaaauggcuuaaaggguugcaucaaggaaccagggccugggcuuccccaucgccagugccacuaccuccggaccugcugcuuaaaguggaacacuuuaguuggguuuuccuugaugauguguucgaagucaaguuacaugauaauuacgaacugaugaaggacgagucgaaggagucagccaaaaggcuucagcuccuggaugcuaaggucgcugcucuccggaagcagcauggggagcuuuugccugcacgcaagaucgaagagcuauaugccucccuugagagaaagaauaucgaaaucuauauccagcggucuagacgcuuguaugguaacacuccgaugagaagggcauugcugacuuggagccucgcgggccuugagcucguggcccuugcugacgccucauuccacggcccggagcaugugguggagcaaguucaagaauuggacccugggucaccuuucccuccggaagggcuggacuuagucauucagugguguaggaugcuaaagugcaauguaaaaagcuuccuggugcgaauccgggacuauccucgguacuuauuugaaauuagagauuggagacugaugggccgacuugucggaacagagcagagcggccagcccugcucccgcagaagacagauccuucaucugggccuucccuggggcaacgucgcaguggagcgaaauaugccaccgcucaaauuuuaccacgacuuucacagcgaaaucuuucaauacacagucguguggggccccugcugggaucccgcuuggacauugauugggcagugcgucgaccugcucacaaagcccagcgcagacccaaguccaccccugcccuggugggacaagagccggcuguuauuucacggcgacuggcacauggauauugagcaggccaacuuacaucaacuggccaccgaggacccauacaauacaacagagaacaugcauugggaguggucccauuugagcuuccauuggaaaccuggucaauucguuuuuaaaggggaucuggauauuaacgugagaaccgcaucaaaguaugacgacugcugcuuccugcaccugccugaccucuguaugacacucgaucuucaauggcuuugucaugggaauccccaugaccaucauagcgucacucuucgagcuccugaauuccuccccgaaguaccuuuagggcagcuucacgauaguuaccgugccuuucgauccgaaaaccuaaaucuguccaucaaaauggaccugaccaggcauagcgggacuauuagccaaccccgaauccuccuuuauucgagcacacugagauggaugcagaacuucugggccacuuggacaucggucacccguccuaucugucggggcaagcucuuuaacaauuugaaacccagcaaaaagaagcuggggcagcauuauaagcagcuguccuacaccgcgcuguucccccaacugcaggugcacuauugggccagcuucgcacagcagcgaggaauccagaucgagugcagucagggacacguuuucacccgagguacacagcgccucaucccucaggcaggcacggugaugaggagacugauuagugauuggucggucacccagauggugucugaccuuucccaagugacaguucacuuaauggcuucuccuacagaggagaacgcggaccacugucucgauccacuggugacaaagacccaccugcucucacucucgucacuuaccuaccaaaggcacucaaacaggaccgccgaggaagagcuuagcgcgagggacggggacccaacuuuccauacccaccagcuccaccucgucgacuuaagaaucucuuggacaacaacgaacagggacaucgcauuugggcuguaugauggauacaagaaggccgccgugcucaagcguaaccugucgacugaggcccugaagggcuuaaagaucgacccgcagaugcccgccaaaaagccuaagcgaggagugcccaccagugcuagugcccccccccgcguaaacacaccgaguuuuucuggacagccggacaagggaagcagcggcggugccuacauguuacagaaguugauagaggagacugaccgguuugucgucuuuaccgaagaggaaagcggcaugucugaccaguuaugugguauugcugcuugccagacugaugauauauauaaucgcaauugccugauugagcucguuaacugccagauggugcucagaggagcugaaaccgagggcugugucaucguuagcgcugcaaaagcgcaguuacuacagugucaacaucauccugcuugguacggagauacccugaagcagaagacaagcuggaccugcuuacuggauggaaugcaauauuucgcuacuaccgaaagcuccccaacugaacaggacggacggcagcuuuggcuggagguaaagaacaucgaggagcaccgacaacggucguuagauuccgugcaggaacugauggagagcggccaggcggucgguggcauggucacuaccacaacugauuggaaccaacccgcagaggcacagcaggcccaacagguucagaggauuauuucuagaugcaauugcaggauguacuacauuagcuauagccacgacaucgauccagagcuugcaacccagaucaaaccccccgagguuuuggagaaucaagaaaaagaggaccuuuugaagaagcaggagggcgccguggauacuuuuacccucauccaucaugaauuagagauuagcaccaacccugcccaguacgccaugauucucgauauugucaauaaccuguugcuucacgucgagccuaaacggaaggagcauucugaaaagaagcaacgcgugcgcuuccagcuggaaaucucuuccaacccggaagagcaacggagcuccauucugcaucuucaggaagcugucagacaacacguggcccagauaagacagcuggagaaacagauguauagcaucaugaaaucacugcaggaugacaguaagaaugaaaaccugcuggaccuuaaccagaaacugcaguugcagcucaaucaagagaaggcaaaccuccaacuggagucugaggaacuuaacauuuugauuaggugcuucaaggauuuucaguugcaaagagccaacaaaauggagcugagaaagcagcaagaagauguguccgugguaaggagaaccgaauuuuacuucgcacaggcccguuggcggcuaacggaggaagacggccaguugggcauugcagaacuggaauuacagcgauuucuguacagcaaagugaacaaguccgacgacaccgcggaacaccugcuggaauugggaugguucaccaugaacaauuuacugccaaacgccguuuauaaaguuguacuuagaccacagagcucuugccaaucggggaggcaguuagcgcuacggcuguuuucgaaagugcgcccacccguugggggcauuuccgugaaggagcauuuugaggucaacgucgugccacuuacgauccaacuaacucaccaauuuuuucacagaaugauggguuucuuuuuucccggucgcaguguagaagaugaugaggugggggacgaggaggauaaaagcaaacuugugacgacggggauuccuguugugaagccacgucagcuaaucgcuacggaugaugcaguuccccugggcccuggcaaagggguggcucaaggccuaacccggagcagcggcgugaggcggagcuucaggaagagccccgagcaucccguugacgacauugauaaaaugaaagagcgcgccgccaugaacaauucauuuauuuacaucaagauaccacaggucccucuguguguuucuuacaaaggcgagaagaauucaguagauuggggagaucugaaucuggucuugcccugccucgaguaccacaauaauaccuggaccuggcuagauuuugcaauggcaguaaaacgcgacucgcgcaaagcucugguugcgcaggucauaaaagagaagcugcgacuuaagagugccacagggucagagguuagagguaaacuugaaacaaaaagugacuugaauaugcaacagcaggaggaggaggagaaggcccgcuugcugaucggacugagcguuggugauaagaauccugguaagaaaucuaucuucgggcguaggaaguag

SEQ ID NO: 61538 - RNA, 6618 nt, Artificial Sequence
  Description of Artificial Sequence: Synthetic coding sequence
augccccucuuuuucucagcgcucuugguccuuuugcucgucgcucucuccgcacuguuucugggcagauggcuggucgugagacucgcuaccaaauggugccagcggaaacugcaagcugagcugaaaaucggaagcuucagauuuuuuuggauucaaaaugugagccugaaguuccagcaacaccaacagaccguggagauagauaaccuguggaucucuucuaaauugcucucacacgauuuaccucauuacguggcacuguguuuuggcgaagugagaaucaggacagacuuacagaaaguuucggaccuaucugcccccuuuucccagucagccggcguagaucagaaggagcugucuuuuucuccuucacuuuuaaagaucuucugucagcuguucucgauccacguagacgcuaucaacauaauggucuugaagguggacacauccgaaagcuuguggcauauucagaucagccggucuagguuucuccuggacuccgauggaaagcggcugaucugcgaagugagccuguguaagauuaacuccaagguucuuaagucuggccaacuggaagacacgugcuugguggagcugucgcuugcacuggauuuguguuugaaaguagggauaucaagccgccaccucacugcuauuacaguugacguguggacccuucaugcagaacuccacgaaggauuguuccagagccagcugcuuugucaagggccuagccucgccucgaaacccguuccguguuccgaggucaccgaaaaccucguggagccgacacuccccgguuuauuccugcugcagcaguugccggaccaaguuaagguuaagauggagaacacaucaguggugcugagcaugaacucccagaagcgccaucucaccuggacucucaaacugcugcaguuccucuaucaucgcgacgaagaucaacuuccucugaggucuuuuacagcuaauucagacauggcccagaugucaaccgagcuacuguuggaggacgggcuucugcugucccagucaaggcagagaauuguuugccugaauagccugaaggcaaguguccaaguuaccacgaucgacuuaucugccagccucguacugaacaccugcauuauccauuaucgacaccaagaauuuagccauuggcugcaccuccuagcccucgaaacacaaggcuccuccaguccugugcugaaacagagaaaaaagcgcaccuucccacaaauucucgcacccauuaucuuuuccacaucaaucuccaaugugaacauuagcauucagcugggcgacacccccccauucgcuuugggauucaacaguaucagcuuggauuaccaacaccugcguccgcagaguauucaucagagagggguucuaacaguggaccaccucugcuggcggguagguucugauagucacauucagagggcgccucauccuccaaauaugcacguauggggggaagcacuggugcuggauucauucacccugcaaggaucguauaaccaaccccuuggccugucuucuacccagagugauacacucuuccucgauugcacuauuagggggcugcaaguggaagcgucagauacaugcgcccagugccuuucuaggauucuaagucuaaugggaccucagagcgguaagagugcugucagccgccauuccucauucggggaguccgugagucuccuguggaaaguugaucugaaaguagaggauaugaaccuuuuuacucucucugcucugguaggcgccagcgagguucggcuggacacccugacuauucucgggagcgccgagaccaguaccguagguauucaaggucuuguccuggcucugguuaaguccgugacugagaaaaugcaaccauguuguaaggcaccggacauuccaacacccguacuaucguugaguaugcuuucuauuacguaccauuccuccauacgcagccucgaggugcaguguggagcaggccucacguuacucuggucccccccagaccacauguacuuguaccaacacguucuggcaacccuccaaugccgggaccugcugcgagccacugucuucccagagaccgugccaucacuugcucuagaaaccagcgggaccaccagcgagcuagaggggcgagcgcccgagccacucccacccaagagacugcucaaccugacacuggaggucuccaccgccaaguuaacagcauucguggccgaagacaaguucaucacccucgccgcugaauccguguccuuaagucgacauggcgguagccugcaggcauacugcccugaacucgccgccggauucgaugguaauuccauuuucaacuucaaagaggucgaggugcagcugcucccagagguggaguuuccuuaccaauacgacuucaguaggacgcuagacgaggcagucggcguacagaaaugguuaaagggcuugcaucaggguacuagggccugggccucucccagcccuguuccucugccuccugaccuguugcuuaaaguggagcacuucucuuggguguuucuugacgacguguuugaggugaaacuucacgauaauuaugagcugaugaaagacgagagcaaagagagcgcuaaaagguugcaacugcuggacgcuaagguggcugcacugagaaaacaacauggagagcuccugccggcuaggaagaucgaggaacuguacgcuaguuuggaacgcaagaacaucgagaucuauauccagagaucccguagguuauauggcaacacaccgaugcgucgcgcccuccucaccuggagucuagcuggccuggaguuaguagcacuggccgacgccagcuuccacgggcccgagcacgucguggaacaggugcaggaauuagacccuggguccccauucccccccgagggacuagauuuaguuauccaauggugccgcaugcuuaagugcaaugucaaaucuuuccuuguccgaauucgagacuacccccgcuaccuguuugagauucgugacuggcgacugauggguaggcuggucggcaccgaacagagcggccaaccaugcaguaggagaaggcaaauccuucaccugggacuuccaugggggaacguggcuguggagcguaauaugccuccccugaaguucuaccaugacuuucacucugaaauuuuucaguacacagucguguggggaccuugcugggaccccgcguggacccucauuggacagugcguugaucuccugaccaagcccuccgccgacccauccccgccacugcccuggugggauaaaagucgccugcucuuccacggagacuggcauauggacauugaacaggccaauuugcaccagcuugcaacugaggaucccuauaacacuaccgagaacaugcacugggaauggucacaccugucauuccauuggaagcccggccaguuuguuuuuaagggggacuuagacaucaacgugcgcacagccucuaaguaugacgacuguugcuuucugcaccuucccgaucuguguaugacgcuggaccugcaauggcuaugucacgggaauccccaugaucaucacuccgugacgcucagagcaccagaguuucugcccgaggugccuuugggccagcugcacgauucauacagagcauuuagguccgaaaaccuuaacuugucuaucaaaauggaucugacacgacauagugggacaaucucucagccccggauccuacuuuacuccagcacccucagguggaugcagaauuucugggcuaccuggacaagugugaccaggcccauaugucgcgggaagcuauucaauaaccuuaaacccuccaagaagaagcuagggcaacacuacaagcagcugucguauacagcccuuuuuccgcaacugcagguacauuacugggcuuccuuugcacaacagagaggcauucagauugaaugcagccaggggcacguauuuaccagagggacucagcgcuuaauaccucaggcaggaaccgugaugcgacgccuaauuagugacuggucagugacacagauggugucggaccugagucaaguuaccgugcauuugauggcuagcccuacagaagagaaugccgaucauugccuggacccauuaguaacuaaaacccacuugcucuccuugucuucccugacuuaucagcggcacaguaauaggaccgccgaagaggagcuuagcgcacgugacggcgauccuaccuuccacacacaccagcugcaccucguggaucuccggaucucguggacaacuacuaauagggauaucgccuucggucuguacgauggauacaaaaaagcugcugugcugaagcgaaaccuaucgacagaggcccucaagggacugaaaauugauccccagaugccggcaaagaaaccaaagcgcggggugccgacauccgccagugcucccccucgaguuaacaccccaucuuucaguggccaaccugacaaggggucuucaggcggggcauacaugcugcagaagcucaucgaagagacugauagauucgucguguucacagaggaggagagcggcaugucagaucagcugugcgggauugccgcuugucagaccgacgauauuuauaacaggaacugccugauugaguuggugaauugucagaugguccugaggggugccgagacagaagggugugucauuguaucugccgccaaggcccaacuacugcagugccagcaccauccagccugguauggagacacacugaagcagaagacaucuuggacaugccuccuugauggaaugcaguauuuugcaacaacugagucaucucccaccgaacaggauggaaggcaacuguggcuagagguaaaaaacauugaggaacaucgccagcgaucucuggacaguguucaggagcugauggaaagcggacaagcaguuggcgggaugguuaccaccacgacugacuggaaucaaccagcggaggcucagcaagcacaacaggugcagcgcaucaucagccgcuguaauugccggauguauuacauuuccuacagccacgacaucgauccugaguuggcuacacagaucaaaccccccgagguccuggagaaucaggaaaaggaagauuugcugaaaaaacaagaaggcgccgucgacacauucacguugauccaucacgagcucgagaucaguaccaauccagcccaguacgcuaugaucuuggauaucguuaauaaccugcuguugcauguugaacccaagagaaaggagcacuccgaaaagaaacagcgcguacgcuuucagcuugaaauuaguuccaacccugaggagcagaggaguagcauccuucaccuccaggaggcugucagacagcaugucgcgcagauacggcagcucgaaaaacaaauguacucuauaaugaagagucugcaggaugacucuaaaaacgaaaaccugcuggaucugaaccagaaauugcagcuccagcucaaccaggagaaggcgaaucugcagcuugagagugaggaacuuaacauacuuauuagauguuuuaaggauuuccagcuucagcgggcuaauaaaauggaacuacgcaaacaacaggaggaugugaguguggucagacggacagaguuuuauuuugcucaagccagauggcggcugaccgaagaagacggccaacuaggcaucgcagaguuggagcuucagagauuccuguauaguaaaguaaauaaaagcgacgacacugcugagcaucuacuugagcugggaugguuuacaaugaauaaccugcucccuaacgcaguguacaaggugguauugcggccucagagcagcugccagagcggcaggcagcuugcgcuacggcuguuuucuaaaguccgcccuccuguagggggcaucucggugaaagaacauuuugaggugaacguuguaccucuaacaauucagcuaacgcaucaguuuuuccauaggaugauggguuucuuuuuucccgggagauccguggaagaugaugagguuggcgacgaagaggauaagagcaagcuggugacaacuggaauuccaguaguuaaaccuaggcagcugaucgccaccgaugacgcaguacccuuaggaccagggaaggguguggcacagggucugacccgguccagcggggugcgccguucuuuccgaaaaucuccagaacacccaguggacgacauugacaagaugaaagagcgggcugccaugaacaacucuuuuauuuacauuaaaauaccccaggugccucuuugugucaguuacaagggugagaaaaauucgguugauuggggagaccucaaccuuguacuuccaugccuggaguaucacaacaauacauggacaugguuggauuucgccauggcugucaagagggauaguaggaaggccuuaguugcacaggugauuaaagagaaguuaagguugaagucagcaaccggcuccgaggugaggggaaagcuggagaccaagagugaucugaacaugcagcaacaagaagaggaagagaaggcccgauuguuaauuggauugagcguuggcgauaaaaauccaggaaagaagagcaucuuuggccggcgcaaauag

SEQ ID NO: 61539 - RNA, 6708 nt, Artificial Sequence
  Description of Artificial Sequence: Synthetic coding sequence
augccacuguuuuuuuccgcucugcugguacuauugcucgucgcucuuagcgcccuguuccucggccgguggcucguagugcggcuggcaaccaaauggugucaacggaaacugcaggcagaacuuaaaauugguagcuuccgcuucuucuggauucaaaacguuucacucaaguuucaacagcaccagcaaaccguagagaucgacaaccuauggauuuccaguaagcucuugagucaugaucugccucacuacguggcccugugcuucggcgaggugagaauccguaccgaucuucagaaagucucugacuugucugcucccuucagccagucagcuggcguggaccaaaaagaguuguccuuuucaccaagucuucugaagauuuucugccagcucuucucuauccauguggaugcgaucaacauuaugguacugaaaguggacaccagcgaaaguuuauggcacauucagauuucucguuccagauuucuacuggauucggacgguaagaggcuaaucugcgaagucagcuugugcaaaauaaauagcaagguacuaaagucaggccaguuggaagacacuugccuggucgagcugucccucgcucuggaccuaugccugaaagugggcauuucuucccggcaucugacugccaucacaguagacguguggacccugcacgcugaauuacaugagggucuuuuucaaagccaguuguuaugucaagggcccucacuggccagcaaaccagucccauguucugaagucacagaaaaucucgucgaaccgacccugcccggucuguuucuucugcagcagcuuccagaccaggugaaaguuaaaauggagaauacaagcguagugcucuccaugaauucacaaaaacggcaccucacauggacccucaaguugcugcaguuccuguaucaccgcgacgaagaccaauuaccgcuucgcagcuucacagccaauucugauauggcccaaaugagcacugagcugcugcucgaagauggcuugcuccuuucucagucccggcagcguauugugugucugaacucuuuaaaagcuuccguacaggugaccacgauugacuugucagcaucucugguuuugaacacuugcauuauucacuaccggcaccaggaauucucacacugguuacaucugcuugcgcuggagacccaaggcaguucaucucccgugcuuaagcaaagaaagaaaagaacauuuccucagauacuggcuccaauuauuuucagcacaagcauuaguaauguaaauauuaguauucagcucggcgauacacccccauuugcucuggguuucaacaguauaucacuggauuaucaacaccuccggccacaaaguauucaccagcgcggcguguuaaccguggaucaucucuguuggagggucgggagugacucccacauacagcgggcuccucaccccccaaacaugcacguguggggcgaagcucuggugcuggauucauucacucuccagggaagcuacaaucaaccucuuggccucucuaguacgcaaucugauacccuauuucuggauuguacuauacgggggcuucaagucgaagccagugauacuugugcccagugccucagccgcauacugucucugauggguccccaaucugggaaauccgccgugucacgucacaguucuuuuggugaaagugucagucugcuuuggaaaguggacuugaaagucgaggauaugaaccucuucacucugucggcccuagugggugccucugaggugagacuggacacucuaacgauacuugggagcgccgaaacuucaacgguaggaauccaaggccuggugcucgcccuggugaaaucugugacugagaagaugcagcccugcuguaaagccccugacaucccaacaccugugcucucacuuagcauguugucaaucacauaccauucaagcaucagaucucuugaagugcaguguggcgccggacucacccugcugugguccccacccgaccacauguaccucuaccagcacguucucgcaacgcuccagugcagggaucuacugcgagccacaguguuucccgaaacggugcccucgcucgcucucgaaaccagcggcaccacguccgaacuggagggccgagcaccugagccucugccacccaaacgccugcuaaacuuaacgcuggaagugagcacugccaaacuaacggcuuuuguugccgaagacaaguucauuacauuagcagccgagucugugagccugagcagacacgggggaucucugcaggccuacuguccagagcuggccgcaggcuuugacggcaauagcauauuuaacuucaaggagguggagguccaguuauuaccugagcucgaggagaugauuuugcaucgcaaucccuuuccugcccugcagacccucaggaaccgggucuggcugcugaguuuuggaucaguaucaguagaauucccuuaccaguacgacuuuuccaggacucuugacgaagccgucggaguucagaaguggcugaaaggucuccaccagggaacgcgugcuugggccagcccuucacccguuccgcucccuccugaccugcuccugaaggucgagcauuucagcugggucuuucuugacgacguuuucgaagugaagcuucaugauaacuacgaacuuaugaaggacgagagcaaggaguccgccaaacggcugcagcugcuugaugccaaggucgcugcucuccggaaacagcacggggaacuacuuccagcacgaaagaucgaagagcucuacgccucucuagaaaggaaaaacauagagauuuauauccagaggucucgcaggcuguacgggaacacuccuaugcgccgagcccugcugaccuggagucuugccggucuggaacucguggcccuagcagacgccuccuuucacggcccagaacauguggucgagcagguacaggagcuggaucccggcagucccuuuccuccagaggguuuggaccuggucauccaguggugucggauguuaaagugcaauguaaagucauuucuugugcgaauuagagauuacccgcgguaucucuucgaaauaagggauuggagacugaugggaaggcucguuggcacagagcaauccggacagccauguucaaggcgucggcaaauucugcacuugggguugccuugggggaauguggcugucgagcgaaacaugccaccacuuaaguucuaucacgacuuucacucagaaauauuucaauauacgguggugugggggccaugcugggaucccgccuggacucugaucggccaaugugucgaccugcuaacaaaacccucugccgauccuagcccaccacucccauggugggacaaaaguagacuucuuuuccacggcgacuggcacauggauauugaacaggcuaaucuccaccagcuggccaccgaggauccauauaacaccaccgagaacaugcauugggaguggucucauuuguccuuccacuggaagcccggacaguuuguguucaagggagaucuugauauuaauguccguacggccagcaaauacgacgacugcugcuuucugcaucucccugauuuguguaugacgcuggaucugcaguggcucugucacggaaauccucacgaccaccacagcgucacgcugcgugcaccugaguuucugccagagguuccucuugggcaguuacaugacagcuaccgcgcauucaggucugagaaccugaaccuaucaaucaaaauggaccuuacacgccauuccggaaccaucucccagccucggauucuccuuuauaguucaacuuugcgauggaugcagaauuuuugggccaccuggaccucuguuacucgaccgaucugucgggggaaguuguucaacaaucucaaacccagcaagaaaaaacuuggccagcacuacaaacagcucucauacacugcccuguuuccccaguuacagguucauuacugggcaagcuucgcccagcagcgugggauucagaucgaguguucucagggacacgucuucacuaggggaacccaacgucucaucccucaagccgggacuguuaugagaaggcuuauuuccgauugguccgugacucaaauggucagcgaucugucccaggugaccgugcaccuaauggcgagcccuacggaggaaaacgccgaccacugccuggauccucugguuacaaaaacucaucuccugagccugucuagucugacuuaccagcggcacaguaauaggacggccgaggaagaacuguccgcuagagauggugaccccacuuuucacacucaccaauuacaccucguugaccuaaggaucuccuggacuacgaccaacagagauauagcauuugggcuuuaugacggcuauaaaaaagccgccgugcugaaacgcaaccugagcacagaagccuugaaaggacucaagauagauccucagaugcccgcaaagaagccuaaaagaggcgugccgacgagugcaucugcuccccccagaguuaacacccccuccuuuuccggccagcccgauaaagguucauccggcggagcauauaugcugcagaaacucauugaggaaacugaucgcuuugucguguucacugaggaggaguccggcaugagugaucagcuguguggaaucgccgccugccagaccgacgacaucuauaaucgaaacugccuuauugagcuggugaauugccaaauggugcugcgcggagcagagaccgagggcugcguuauugucucugcugccaaggcccagcuucuucagugccagcaccacccagcuugguacggagauacucucaaacagaagacuucauggacuugucugcuugacgguaugcaguauuucgcuaccaccgagagcaguccuacagagcaggauggaagacaguuguggcucgaaguaaagaauaucgaggagcaccgucagaggagccuagauucaguccaggaacugauggaauccggacaggcaguaggagguauggugacaaccacgacugauuggaaucagccugcggaggcucagcaggcgcaacagguacagcggaucauuucucggugcaacugccggauguacuacauaucuuauucgcaugauaucgacccugaacuugcgacucagaucaagccuccggaagugcuggaaaaccaggaaaaggaagaccuguugaaaaagcaggaaggagcgguggauacuuucacacugauccaucacgagcuggaaaucuccaccaacccagcccaguaugcuaugauucuggauaucgucaacaaccuccuacuucauguggaaccuaagagaaaagaacacucugaaaagaagcaaagagugcgauuucagcucgaaaucaguucaaaccccgaagaacaaagauccucaauucugcaucugcaggaggccgugcgccagcacguggcccagauccgccagcucgagaaacaaauguauaguaucaugaagucuuugcaggacgauucaaagaaugaaaauuugcuggaccugaaucagaaacuacaacuccagcugaaccaggagaaagcaaaccugcaauuagaaucggaggaacugaacauucugaucaggugcuucaaagacuuucagcugcagcgcgccaauaagauggagcuaagaaaacaacaggaggacguaagcgugguucgacggacugaauucuauuuugcucaggcgagguggcgacucacagaagaagacggacaauuggggauagcugagcucgagcugcagagauuuuuguacagcaagguuaacaagagcgaugacaccgcagagcauuuacucgaguuggggugguuuacuaugaauaauuuacugcccaaugccgucuauaaggcuaucuugcggccacaaucgucuugccaguccggccgccagcucgcacucaggcuauucuccaaaguccgaccccccguggggggcaucagcguuaaggagcauuuugaggugaauguaguaccccugaccauccaacuuacacaucaguucuuucaccguaugaugggcuucuucuuuccaggacgaucaguggaggaugaugaggugggcgacgaagaggauaagucaaaauuagugacaacugguaucccaguggugaaaccccgacagcugauagccaccgacgaugccgugcccuugggcccuggaaaggggguggcgcagggucuaaccagauccucuggcgugcgucgcuccuuccgcaagucacccgagcacccaguggaugauaucgacaagaugaaggagcgcgcagcaaugaauaacuccuucaucuacauaaagaucccccaggucccccucugcgucucuuauaagggugagaagaauucaguugauuggggagauuugaaucucguccucccgugccuggaauaccacaauaauacguggaccuggcuggauuucgccauggcuguaaaaagagauagcaggaaggcacugguggcccaggucaucaaggaaaagcugcgccuaaaaagcgcuaccggcagcgaggugcgugguaaguuggaaaccaaaagugaucugaacaugcagcaacaagaggaagaagaaaaagccagacugcucauuggccugagcgugggcgauaagaacccagguaaaaagagcaucuucggucgcaggaaauag

SEQ ID NO: 61540 - RNA, 6279 nt, Artificial Sequence
  Description of Artificial Sequence: Synthetic coding sequence
augguccuaaaaguggacaccuccgaaucacucuggcauauacagauuucgcgaagcagauuuuugcucgacucagauggaaaacgccucauuugugaaguuagucuuugcaagaucaacuccaaggugcuuaaauccggacaguuagaagacacgugccucguugagcugucucucgcccuggaccugugccugaagguggguaucagcucccgucaucuuacagccaucaccguugauguguggacccuccacgcugaacugcacgagggccuuuuccagucucagcuauugugucagggccccagccuggccucgaaaccaguuccaugcucggaaguaacagaaaaccuaguugagcccacccugccgggccuguuccuguugcaacagcucccagaccagguaaaggugaaaauggagaacacauccgucguucugucaaugaauucccagaaaaggcaucuaacauggaccuuaaaacugcugcaguucuuauaccaucgggacgaggaccagcuuccauugcggucuuucacggccaacagcgacauggcucagaugucuacugaauuacuccucgaagacgggcuccuccugucccaaucucggcaacguauugucugccuaaacucuuuaaaggccuccgugcagguaaccacuauugaucugagcgccucucugguccugaauaccugcauaauccacuauagacaucaagaauucagucacuggcuccaccuacuggcuuuggagacacagggguccagcuccccaguguuaaagcagaggaagaaacguaccuuuccccaaauccuggcuccaauuaucuuuagcaccagcaucagcaacgugaauaucucuauccagcucggagacacgcccccuuuugcauugggcuucaacaguaucucccuagacuaccagcaucuccguccucaauccauucaccaacggggaguccuaacgguggaccaucugugcuggcgggugggaagcgacagucacauccagcgugccccgcaucccccaaacaugcacgucuggggggaggcacucguccucgauaguuuuacucuccaagguuccuacaaccaaccacuugggcuuaguuccacucagagcgacacacuauuucuggacugcacaauucggggauugcaggucgaggcguccgauacuugugcucagugucuuagccggauucuuucauuaaugggaccucagucugggaagucugcaguaucccgccauucaucuuuuggcgaaucggugagucuccuguggaaaguagauuugaaaguggaagacaugaaccucuucacuuuauccgcccuggugggugccagcgaggugagacuugauacucuaaccauucuggggucagcugagaccucuacuguuggaauucagggauugguccucgcccucgugaaaucaguuaccgagaagaugcagcccuguugcaaggcuccagacauuccgacaccuguguugucccuuagcauguugagcaucacuuaccauuccucaauaaggucuuuagagguccagugcggggccgggcugacauuacugugguccccuccagaccauauguaccuguaucaacauguucuggcuacuuuacaguguagggaucuccuaagagccacaguguuuccugaaaccgucccgagccucgcccuggaaaccucuggcacuacaagcgaacuagaagguagagcaccagaaccacuaccaccuaagagauuauugaauuuaacccuggaggucucaaccgcuaaacucacugcguucguggcugaggauaaguuuauuacacuugccgccgaaucaguuagccugucuagacauggagggagucugcaagcauacugcccagaacuggcugcaggguuugacggcaauucaaucuucaauuuuaaagaggucgaaguccaguuacuucccgaacuggaagagaugauucuucacagaaacccauuuccagcccuucagacacugcggaacagaguguggcuacugucuuuuggaagcguaucuguggaguucccauaccaguacgacuuuagccggacacuggaugaggcuguaggugugcagaaguggcuuaagggauugcaccaggggaccagagcuugggcuaguccuaguccaguacccuugccaccggaccugcuccuaaagguagaacacuucaguuggguguuccuggaugauguguuugagguuaaauugcacgacaacuacgaacugaugaaagacgagagcaaggaguccgccaagaggcugcaacugcuggaugcaaaagucgccgcacuucggaaacagcacggcgagcuacugcccgcucggaagaucgaagaacuguacgcgucccuggaaaggaaaaacaucgaaauauauauucagcggaguagaagacuguacgggaacacuccuaugcgccgggcccuucuuacauggagucuggcaggcuuggaauugguugcucucgccgacgcuaguuuccacgguccagaacacgugguggaacaggugcaagaauuggaucccggcucccccuucccucccgaagggcuagaccugguaauccaguggugucggaugcugaagugcaacgugaagagcuuccucgugcgaauccgggacuacccgagauaucuguucgaaauccgggacuggaggcugauggggcggcuuguuggcacugagcaguccggacagcccugcagcagacggcgacagauucugcaucugggccuucccuggggcaaugucgcggucgagcgcaauaugccuccccucaaauuuuaucacgauuuccacuccgaaaucuuccaguacacuguuguguggggucccuguugggaccccgccuggacuuuaaucggacaguguguagaccugcucacuaagcccagugcagacccuucacccccccuuccguggugggauaagucacgacugcuguuccacggcgacuggcacauggacaucgagcaggccaaucuucaccagcucgccacugaggauccauacaauacaacugagaauaugcacugggaguggagucaucuuucauuccauuggaaacccgggcaauucguuuucaaaggugaucuggacaucaaugugcgaaccgccaguaaguacgacgacuguugcuuccuacaucuaccggaccugugcaugacccuugaccuccaguggcucugucauggaaauccucacgaccaccauucugugacuuugcgggcccccgaauuccucccugaaguuccauugggucaacuucacgacagcuaccgcgcguuccggucugaaaauuuaaaccucagcauuaagauggaccugacacggcacuccgguaccauaucucagccacgaauauugcuuuacagcuccacauuacgguggaugcagaacuucugggcaacguggaccuccguuacacggcccauaugucguggcaaacucuuuaauaaucugaaacccagcaagaagaaacugggccagcauuacaaacaacuguccuacacagcucuauuuccccaacugcaaguacauuauugggccuccuuugcacagcagagagggauucagaucgaguguagucagggccauguguuuacuagaggaacccaaagacuuaucccucaggcgggcaccgucaugcggagguugauuagcgacugguccgugacgcagauggucuccgaucugagucaggugacugugcaucuaauggcuucucccacagaagagaacgccgaucacugcuuagacccgcucguaaccaaaacacaucugcugucauuauccucacuaacuuaucagagacacaguaauaggacugccgaggaagaacuuuccgccagggacggcgacccgaccuuccacacccaucaacuucaccugguggauuugcgaaucuccuggaccaccacuaaccgugacaucgcuuucggccuguacgauggguacaaaaaagcagccgugcugaagagaaaucuuuccaccgaagcccucaaaggacugaaaauugacccccagaugccugccaagaaacccaagagaggugugccaacaagcgccucugcaccgccucgugugaauacgccuagcuucaguggacagccagacaagggaagcagcggcggagcauauauguugcaaaaacugauugaggagacugaccguuuuguaguguuuaccgaggaggaguccgggaugucagaucaguuaugugggaucgccgccugucaaacggacgacaucuauaaccgaaauuguuugauugagcuggucaauugucagauggugcugaggggggcagagacugaagguuguguuauugucuccgcggccaaggcucaguugcuacagugccaacaucacccagccugguacggggacacucugaaacagaaaaccucauggacuugucuguuagauggaaugcaauauuuugccacaacugagaguucaccuaccgagcaggacggccgccaacuuuggcucgaggugaagaacaucgaggagcacagacagcguucacucgauaguguucaggaauugauggagaguggccaggccgugggagggaugguaacgacuacaacggauuggaaccagcccgccgaagcucagcaggcucaacaggugcagagaauaauaucaaggugcaacugcaggauguacuacaucagcuauucccacgacaucgauccugaauuggcaacacaaaucaagcccccggaggugcuggaaaaccaagagaaggaggaccugcugaagaagcaggaaggcgcaguagauaccuucacacuuauccaucacgaauuggaaaucagcacgaaucccgcucaauaugcuaugauccucgauauugugaauaaccuuuuacuucauguggagcccaagagaaaagaacauucggaaaaaaagcagcgcgugagguuccagcucgaaauaucgucuaauccugaagaacagcggucaucuauuuugcaucuccaggaggccguucgccagcaugucgcgcaaauucgucagcucgaaaagcagauguauaguauuaugaagucacuucaggaugacucuaagaacgagaaucugcucgaccugaaucagaagcuccaacuccagcucaaucaagagaaggcuaaucugcagcuggagagcgaggaacucaacauacugauuaggugcuuuaaggauuuucaacugcaacgugcuaacaaaauggaacuacgaaagcaacaagaagaugucucaguugugagacggacggaguucuacuucgcccaagccagguggcggcugaccgaagaggacggacaauuaggcaucgcugagcuagaacugcagcgauuucuguacaguaaagugaacaagagugacgacaccgcugaacaucuacucgaauugggcugguuuaccaugaacaaccuguugcccaaugcaguguacaagguaguguugaggccacagucaagcugucaaagcggaagacagcuggcgcucaggcuguuuaguaaagugcgcccacccgucgggggaaucuccgucaaggaacauuucgaggugaaugucguuccccugacuauacaacugacacaucaguuuuuccaucgcaugaugggauuuuucuuuccgggucggagcguagaagacgaugaggugggagaugaggaggauaaaucuaaacugguaacuaccggcaucccagucgugaaaccacgccaguugaucgcuaccgaugaugcggugccccuggguccuggcaagggaguagcgcaaggccugacaagguccuccggggugcgccgcucuuuccggaaaucacccgaacaucccgucgacgacaucgacaagaugaaggagagggccgcgaugaacaauucuuuuauauacaucaagauaccucaggugccccugugcguuuccuauaagggcgaaaagaacaguguagacuggggagacuuaaaucucguauugccuugucucgaauaccacaauaauaccuggacaugguuggauuucgcaauggcuguaaagcgcgauucgcggaaagcacugguggcacaggucaucaaagagaaacuccgucucaagucagccacugguuccgaggugcggggcaagcuggaaacuaaguccgaucucaacaugcagcagcaggaggaggaggagaaagcccgacuccugaucggccugucugugggggacaagaaucccggcaagaagucuauuuuugggagacgcaaguag

SEQ ID NO: 61541 - RNA, 3864 nt, Artificial Sequence
  Description of Artificial Sequence: Synthetic coding sequence
augguagcuagaucaacugauucccuggauggcccuggagaggguuccgugcagccucucccuacugccggagguccguccguuaaggggaaaccuggaaagcguuugagcgcuccgagaggaccguucccuagacuggccgacugcgcucacuuucacuacgagaauguugauuucggacacauucagcugcucuugagccccgauagagaaggaccuagccuuuccggugagaaugagcucgucuuuggggugcaagugacaugccagggaaggaguuggccggugcuucgguccuacgaugacuuccguagccuggacgcucaccuccaucgauguauuuucgauagaagguucucuugccucccagagcuuccaccuccacccgagggggccagggccgcccaaaugcuugugccuuuacugcugcaguaccuugagacccugagcggccugguggacagcaauuugaauugcggucccgugcuuaccuggauggaacuggauaaccacgggagaagauuauuauuauccgaggaggcaagccugaauaucccagccguagcggcagcucacgucauuaaaagauauacugcccaggcacccgacgagcugucauucgaagucggugauaucguaucugugauugacaugcccccuacggaggacagauccugguggagaggaaagcgaggcuuccaggucggguucuucccgagcgaauguguggaacuguuuacugaacgaccuggaccuggccugaaagccgacgccgaugggccaccuugcggaaucccugcgccacaaggaaucuccagccucacaucugccgucccucgccccaggggcaagcuugcuggcuugcuucggacuuucaugagaagucggccgucucgccagagguugcgacagcgcggcauucuucgacaaagaguguucggaugugaucuuggggagcaccugucaaauagcggccaggacgucccccagguguuacgcugcugcagcgaauuuaucgaggcccacggagucguagauggcauauacaggcugagcggggucagcucuaacauccaaaggcugagacaugaauuugauagcgaacgaaucccagagcuuucgggcccugcuuuucugcaggauauucacucaguguccucauuauguaagcuguacuucagagaguuaccuaauccacuuuuaacguaccaauuguacgggaaauuuagcgaggcuauguccgugcccggcgaggaggagcggcuugugcgaguacaugacgucauacagcaguugccaccaccucacuacaggacguuggaguaccuccugcggcaucuugcacggauggcuaggcacucugcuaacaccucuaugcacgcacguaaccuugcaauuguaugggcgcccaaccuccugcgauccauggaacuagagucugucggcauggguggggcggccgccuucagggaagugcgcguccaaucaguugugguggaguuccugcugacccaugucgauguuuuauuuagcgacacuuucaccagugccggacucgauccugccggccggugucugcucccuagaccuaagucccucgcggggaguugucccucaacgcgccuucucacccuggaagaagcacaggcccggacccaggggcgccucgggacucccaccgagcccacuacaccaaaggcucccgcguccccagccgaacgcagaaagggggagcgaggagagaagcaacgcaaacccggagguucuucuuggaaaacuuuuuucgcucucgguagagggccuuccgucccccgcaagaagccguugccguggcucgguggcacacgagcccccccucaaccuaguggcagccgcccggacacagugacauuaagaucagcuaaguccgaggagucccuaucuagccaggcuucuggcgcaggccuacagagacuucacagauugaggcggccgcacuccucuagugacgcuuuucccguugguccagcaccagcugggagcugcgaaagccucucaaguucguccucuagugagucuucuuccagcgagucuagcaguuccucaagugagucuagugcugccggucugggggcccugucugggucaccuagccacagaacaucugcauggcuagacgauggggacgaacuggacuucaguccaccaagaugcuuggagggucuuagaggacucgacuucgaccccuugacauuccgcugcaguucaccaacucccggugauccggcuccccccgcgaguccagcuccaccugcuccagcuucugccuucccgccuagagugacaccgcaggccauaucaccucgugguccaacauccccugcuuccccugccgccuuggauauauccgagccucucgccgugagugugccuccggcggugcuagaacuccugggugcuggcggggcaccugcaucugcuaccccuacuccagcauugucuccuggccguagucuacgcccucaucugaucccauuacuguugcggggggcugaggcccccuuaacugaugcuugccagcaggaaauguguuccaaguugcggggcgcacaaggaccucucggacccgauauggagaguccccugccacccccgccauugucccuacugaggccuggaggggccccuccuccgccacccaagaacccagccaggcuuauggcucucgcauuagccgagcgugcccagcaggucgccgagcagcagucccagcaggaauguggggguaccccaccagcaucccagucaccuuuccacagaucauugagucuggagguuggaggagagccucucggcacuaguggguccgguccuccuccaaacagucucgcccauccuggggccugggucccggggccaccccccuaccugccgaggcaacaguccgacggcagccugcugcgaagucagagacccaugggcacaucgcggcggggauugagggggccagcucaagucucagcccaacuucgcgcaggaggagguggccgugacgcucccgaagccgccgcucagucucccugcuccgucccaucccagguccccaccccaggguucuucagucccgcccccagagagugucugcccccguuccucggcgucccaaaaccagguuuguauccucucggcccaccuucauuucaaccuaguagcccugcucccgucuggcgcagcagucuaggcccgcccgccccccucgaucggggcgagaaucuuuauuacgaaauaggcgcgucagaagguucacccuauagcggccccacccggucuuggucgccuuucaggagcaugccuccagacagacucaacgccuccuacggaauguugggucagucuccuccucuccacagaucgccggauuucuugcuuuccuauccccccgcgcccaguugcuucccaccggaccacuuaggcuauagcgccccccaacaccccgcucguagaccaacucccccagaaccccuguacguuaaccuggcucugggcccucgggggcccagucccgcgucuagcaguaguaguaguccucccgcccauccacgcagccgcuccgauccuggcccaccuguuccacgacugccucagaagcagagggcccccuggggcccaaggaccccucauagggugccugguccaugggggccgccagaaccccuccuccuuuaccgugcggcuccuccagccuauggaagaggcggcgagcugcaccguggcucacuguaucggaacggggggcagcgaggagaaggggccggaccucccccuccguauccaacaccaagcuggucccugcacagcgaaggccaaacucgcucauacuguuag

SEQ ID NO: 61542 - RNA, 432 nt, Artificial Sequence
  Description of Artificial Sequence: Synthetic coding sequence
auggagacauuuccacucuuacuucuuucucuaggucuuguccucgcagaggcaucagagucuaccaugaaaauuauuaaggaggaauucaccgaugaggagaugcaguacgacauggccaaaucaggacaagaaaaacagacaauugagauucuuaugaacccuaucuuacucgugaaaaacacaucccugaguauguccaaagaugacaugucaucuaccuugcucacauuccggagccugcauuauaaugauccaaaaggaaauucguccggcaaugauaaggaguguuguaaugacaugacaguguggcgaaaaguguccgaagccaaugguuccuguaaguggagcaacaacuucauccgcucgucgaccgaggugaugagacggguucaucgagccccaucuugcaaauucgugcaaaaccccuag

SEQ ID NO: 61543 - RNA, 939 nt, Artificial Sequence
  Description of Artificial Sequence: Synthetic coding sequence
auggagccuggcagcgucgagaaucugucaaucguguaccggagccgugauuuucuggucguaaauaagcauugggauguucgcauugauuccaaggcauggcgggagaccuuaacguugcaaaaacaauuaagauacagauucccugaacuggcggacccugauaccuguuaugguuucagauuuugucaucaacuggacuucuccacaucaggggcacuguguguagcauugaacaaagcagcagccggcuccgcuuaccguugcuuuaaggaacgccgcguuaccaaagcauaccuggcccuccuucggggccauauucaggaaagccgcguuacaauuucgcaugcaaucggcaggaacucaacagaagguagagcucacacaaugugcaucgagggaucccagggcugcgagaaucccaaacccuccuugaccgacuugguaguccuggaacaugggcucuaugcaggagacccaguguccaaaguauugcucaaaccccucacuggacgcacccaccaacugaggguccacuguagcgcacuuggacacccugugguaggcgacuuaacuuacggagaaguuuccggaagggaagaucgaccauucagaaugaugcuccacgcauucuaucuccggauucccaccgauacagagugcguagagguuugcacaccagacccauuccugccuucucuugaugcuugcuggucaccccacacucuguugcaguccuuagaucaacuggugcaggcacuuagggccacuccggauccugacccagaagaucggggcccuagacccggcagccccuccgccuuacugccagggcccggaagacccccaccucccccaacaaaaccuccugagacugaagcucagaggggaccauguuuacaguggcugagcgaauggacuuuagaaccggacucauag

SEQ ID NO: 61544 - RNA, 1140 nt, Artificial Sequence
  Description of Artificial Sequence: Synthetic coding sequence
auggagcagcuaucaagcgcaaauacacgauucgcucuugaucuguuccuagcacucagugagaauaacccagccggaaacauauucauuucccccuuuaguauuagcucggccauggcuaugguguuucugggcacccgggggaauaccgcugcucagcugucuaaaacuuuucacuucaauacuguugaagaaguccauucccgcuuucagucccugaacgccgauauuaauaagagaggagcaucuuacauccucaagcuggcaaaucgacuuuauggagagaagacuuacaacuuucugccagaguuccuaguaucuacccaaaaaaccuacggagcagaccuggcauccgucgacuuccaacacgcuagugaagacgcucggaaaacuauuaaccagugggucaagggccagacagaagguaagauucccgagcugcuggcgagcgggaugguggauaauaugacgaagcuggucuuggugaaugccauuuauuuuaaaggaaacuggaaagauaaauuuaugaaggaagcaaccacaaaugcccccuuuagacucaacaagaaggauaggaagaccgugaaaaugauguaccagaagaagaaguuugccuacggauacaucgaagaccugaaaugucgcguccucgaacucccauaucaaggcgaggaacucuccauggugauucuccugccugaugauauugaagaugaauccacuggucucaaaaagaucgaggaacagcugacccuagaaaagcuccaugaauggacaaaacccgaaaauuuagauuuuauugagguuaaugucagccuuccacguuuuaaacucgaagaaagcuauaccuuaaauagcgacuuagcacgucugggcguccaagaccuuuucaauucaagcaaagcggacuugucagggaugagcggagcacgcgacaucuuuaucuccaagaucgugcauaagaguuucguagaagugaaugaagaaggcacggaagccgcggccgcgacugcaggcauagcaacauucugcauguuaaugccagaggaaaauuuuacagccgaccacccuuuucuguucuuuauucgucauaacucuuccggaagcauauuauuccucggccgcuuuaguagcccguag

SEQ ID NO: 61545 - RNA, 687 nt, Artificial Sequence
  Description of Artificial Sequence: Synthetic coding sequence
augguggacaauaugaccaaacuuguguuggucaacgccauuuauuucaaaggcaacuggaaggauaaguucaugaaagaggcuacaacaaaugcaccuuuuaggcugaacaaaaaagaccgcaagacugucaagaugauguaucaaaagaaaaaauuugccuacgguuacauugaagacuugaaaugccgcguccuagaacugcccuaccaaggcgaggaguugaguauggugauucuccugccagaugauauugaagaugagaguacuggucucaagaagauagaggagcaacucacccuugagaagcugcacgaauggaccaaacccgaaaaccuugauuuuauugaggugaacguuucacucccccgguuuaagcuagaggaguccuacacacugaacucugaccuggcaagauugggcguucaagaucuguuuaauagcaguaaagccgauuuaaguggcaugucuggagcuagggacauuuuuaucagcaagaucgugcauaaaagcuuuguggaagugaacgaggaaggcaccgaggcugcagccgccacugccggaaucgcaacauucuguaugcucaugcccgaagagaauuucacugcagaccauccauuccuguucuucauaagacacaacucaagcgguaguauucucuuccuggggcgauuuucuucuccguag

SEQ ID NO: 61546 - RNA, 1026 nt, Artificial Sequence
  Description of Artificial Sequence: Synthetic coding sequence
auggcuaugguuuuucuaggaacacggggaaacaccgccgcccaacugagcaagaccuuccacuuuaacaccgucgaagaaguccauagcagauuccagagcuuaaaugccgauauaaacaaacgcggcgccaguuauauccuuaagcuugcaaauagacuguauggggaaaaaacauacaacuucuuaccagaguuccuggucucaacucagaagaccuacggagccgaucuggcuucuguagauuuucagcacgcaucagaggaugccaggaaaacuauuaaccaguggguuaagggccagaccgaaggaaagaucccggaguugcuggccagcggcaugguugacaauaugacaaaacugguucuugugaacgccauauauuuuaagggcaacuggaaagacaaguucaugaaggaagccacaacuaaugccccauuccgacucaauaaaaaggaucggaaaacagucaaaaugauguaucagaaaaaaaaguuugccuacgguuacauugaagauuugaagugccgggugcuggagcuaccuuaccagggagaggaguugucaaugguuauucuguugcccgacgacaucgaggacgaaucuaccggacugaaaaagauugaagaacaguugacacuugaaaaacugcacgaauggacaaaacccgagaaucucgacuuuaucgaagucaacgucucucucccgcgguuuaaacuugaagagucauauaccuuaaauagugaucuggcccggcucggcguccaggauuuauuuaauucuagcaaagcugaucuuuccggcaugucaggggcccgagauauuuucauuaguaagaucguucauaaauccuucguggagguaaaugaagagggcacagaggccgcugcugccacugcugggauugcuacuuucugcaugcucaugccagaagagaacuuuaccgccgaucaucccuuuuuguuuuucaucaggcacaauagcucagguaguauucuguuucugggccgauuuaguucacccuag

SEQ ID NO: 61547 - RNA, 2397 nt, Artificial Sequence
  Description of Artificial Sequence: Synthetic coding sequence
auggguaaggccuccccagccuccggacucucacgcccuaaaacacuugucuccccgcugcgauccaaccaguggucacuacagaagggucugccggaacaauacuacucucugacgugguuccucucccccauacucggacucaucuucacuccccuaaucgggucggccuccgaucgaugcacacuuagcuggggucgaaggcggccguucauacuugcuuuguguguuggaguccuauucggggucgcacuuuuccuaaacggcucggcaauuggccuggcauugggugacguaccuaaucgccagcccauugggaucgugcuuacuguccugggggucguugugcuagacuuuucagccgaugccaccgagggcccuauccgggcuuaucuccuagacgucguggauuccgaggagcaggauauggcucucaacauucacgccuuuagcgccgguuuggggggcgcgaucggguacguccucgggggacuggacuggacccagacauuucugggcaguugguuuaggacgcagaaccaggugcuguuuuuuuucgcugccaucauuuuuacagugucuguugccuuacaucucuucaguaucgaugaagaacaguacuccccccaacaggagcgauccgcagaagagccuggagcccuggauggaggggagccacacggagugccugccuucccagacgagguucagucagagcaugagcucgcccuagacuacccagauguggauauuaugagaucaaagagcgacucagcccugcauguuccugauaccgcgcuggacuuagaaccagagcuacuguuccuccaugacaucgagccuuccauuuuccacgaugcauccuaccccgccaccccgagguccaccucacaagagcuugccaagaccaagcugccacgguuggcaacuuuccugaaagaagccgccaaagaagaugaaacucuccuggacaaccacuuaaacgaggccaaaguacccaauggcuccgggucgccuacgaaagaugcccuuggagguuacacacgugucgauacgaaaccaucagcuacaaguagcagcaugcggcgucgccgccacgccuuccgccgccaggcuucuucgacauuuaguuacuacggcaagcugggaucccacugcuauagguauaggagagccaacgcaguggugcucaucaagccuucaagauccaugucugauuuguacgauaugcaaaagagacagcgccaacacagacaccggaaccagucuggagccacuacuucuucuggcgauacagaaucugaagagggugagggugaaacuacaguuagauugcucuggcugagcaugcugaaaaugccuagggagcuaaugaggcugugccugugucaccuguugaccugguuuucugucauugcugaagcuguguuuuauacugacuuuaugggccaggugauuuuugagggggauccuaaggcccccagcaacaguacugcguggcaagcauauaacgcaggugugaagaugggaugcuggggauuggugauuuacgccgccacgggugcuaucugcuccgcucuccugcagaaauaccuggacaacuacgaccugucugugaggguaaucuaugucuuagggacacucggcuuuucaguagggacugccgucauggcuauguucccaaacgucuacguugcuauggugacuaucaguaccauggggaucguguccauguccauaagcuauuguccauacgcguuauugggucaguaccacgacauuaaacaguauauccaccauagccccggcaauuccaagcguggguuuggcaucgacugcgcuauccucucuugccagguguacaucucucagauucuuguggcaucugcccuggggggcgugguggacgccguaggcaccguaagaguuauuccgauggucgcaucagucgggucuuuuuugggauuucuuaccgccacuuuuuuaguaauuuauccaaaugugagcgaggaggccaaggaagaacagaaaggacuuaguucuccacuggccggcgaaggaagggcgggcggcaauucagaaaaaccaacuguacucaaacucacuagaaaggaggggcuacagggccccgucgaaaccgagagacugcaggugcucaccuccguccgaucucgccacauuggcuggugcaggucuuguuggaggguguucuuuuuuaugauuauccuugagaagaaguuuucuuuuccacaauguggaucacugcggcgcaugaccuacuuacuguuccuuuccgaacucgauacucugugccccggccaacccuguccuugggccgccaccgcccaucaaucgugggaggaggccgggccugguggucucggaaggcggcaauag

SEQ ID NO: 61548 - RNA, 1023 nt, Artificial Sequence
  Description of Artificial Sequence: Synthetic coding sequence
auggugacgcuucgcaagcggacacucaaaguccucaccuuucuggugcuguucaucuucuugacuucauucuuuuugaauuacagccacaccaugguugccacuaccugguuccccaagcaaauggugcuugaacucucagaaaaucugaaacgguugaucaaacauaggccuuguacauguacccauugcaucgggcagcgcaagcugagugcuugguucgacgaaagauuuaaucagaccaugcagccauugcugacugcgcagaacgcccuguuagaggaugacaccuaccggugguggcuccgccugcagagagagaagaaacccaacaaucucaaugacacgauuaaagagcuguuucggguuguaccgggcaaugucgauccgaugcuugaaaagagauccguuggaugccgucgcugugcugugguuggcaacuccgguaaccugagggaaucuuccuaugggccagaaauugacagccacgauuuuguguuacgaaugaauaaagccccuaccgcggguuuugaagccgauguuggcaccaaaacuacucaucacuugguuuaccccgagagcuucagagagcuuggugacaaugucagcaugauccuagucccauucaaaacaauugaucucgaaugggucguaucagcaaucaccaccgguacuaucagccacacuuauauccccgugcccgccaagauucgcgucaagcaagacaaaauacucaucuaccauccugcauuuauuaaguauguuuuugacaauuggcugcaaggacaugggcgguaucccagcacgggcauucuuucugugaucuuuagcaugcacgugugcgacgaagucgaccuguacggcuuuggagccgacucuaaagguaauuggcaucacuauugggagaauaaccccucagcaggugccuuuagaaaaacgggugugcacgacgcagauuuugaguccaauguuacggccacgcuugccagcaucaacaagauucguaucuucaaaggcagauag

SEQ ID NO: 61549 - RNA, 1023 nt, Artificial Sequence
  Description of Artificial Sequence: Synthetic coding sequence
auggugacacugcguaagcguacucugaaggugcucaccuuccuugugcucuuuaucuuucugacaaguuuuuucuuaaacuacucacacaccaugguggccacaaccugguuuccaaagcagauggugcucgagcugagugaaaaucucaaaaggcuaauuaaacauagacccugcacuugcacacacuguaucggccaaagaaaguuaagcgccugguucgacgagagguuuaaucagacaaugcaacccuuacugacagcacagaacgcgcugcuggaagaugauacguaucggugguggcuuaggcugcagagggaaaagaagcccaacaacuugaacgacacaauuaaggaacuguuucguguagugccagggaacguggacccaauguuggagaagagaucagugggcugcaggcgaugcgccguugugggaaacucagggaacuugagagagagcagcuacggccccgaaauugacucucacgacuuuguccugagaaugaacaaggccccaacugccggcuuugaggcugacgucgggaccaagacaacacaccaucuaguauauccagaaagcuuccgcgagcucggagacaauguuagcaugauccuagugccuuuuaaaacuaucgacuuggaguggguugugagcgccauuaccacugguacaauuucgcacacauauauuccgguccccgcuaagaucagagugaaacaagacaaaauccucauuuaucauccggccuucaucaaauauguuuuugacaauugguuacaggggcacggcagauaccccagcacaggcauccugagcgugauauuuucuaugcaugucugcgaugagguugaccuguaugguuuuggggcagauagcaaaggaaacuggcaucauuauugggaaaacaaucccagcgcuggcgcauuucguaaaacuggugugcacgacgcagauuuugagagcaauguaaccgcaacuuuggccucuauaaauaagauucggauuuucaagggacgguag

SEQ ID NO: 61550 - RNA, 150 nt, Artificial Sequence
  Description of Artificial Sequence: Synthetic coding sequence
auggucacauugcguaagaggacucuaaaaguccugacuuuccugguacucuucauuuuccuuacaucauuuuuucucaacuacucucacacuauggucgcgacaacaugguuccccaaacaaaugguacuggagcuuagcgagaacuag

SEQ ID NO: 61551 - RNA, 1023 nt, Artificial Sequence
  Description of Artificial Sequence: Synthetic coding sequence
auggucacucuccgaaaaagaacccucaaagugcuuaccuuuuuaguauuauuuaucuuucuaaccucuuuuuuucugaacuacucacacacuaugguugccaccacaugguucccaaaacaaaugguccucgagcuaagcgaaaaccucaagcgccugauaaagcacagaccauguaccugcacucacugcaucgggcaaaggaaguuauccgcaugguuugaugaacgguucaaccagaccaugcagccccuucugaccgcgcagaaugcccuccuggaggaugacaccuaucgguggugguuaagacuccagagagaaaagaaaccaaacaaucugaaugacacaauuaaagaguuauuucgggucguuccagggaaugucgacccuaugcucgaaaaacgaaguguaggcuguaggagaugugccguugucgguaauuccgggaaucugagggaaaguucuuacggucccgagauagauagccaugacuuuguucugagaaugaauaaggcccccacugccggcuucgaagcugauguuggcacaaagacuacucaccaccugguguauccggaauccuucagagagcugggggauaacgugucuaugauucuuguuccauucaaaaccaucgaucuggaauggguggugagcgcaaucaccacaggcaccaucucccauaccuacaucccuguaccugccaaaauacgugucaaacaggauaaaauauuaaucuaucaccccgcuuuuaucaaauacgucuuugacaacugguugcagggacacggccgguaucccuccaccggaauccugagugugaucuuuucgaugcacgugugcgaugaaguagaucuguauggauuuggugcggacagcaaaggcaauuggcaccauuacugggaaaauaauccgagugccggagcuuuucguaagacaggcgugcacgaugcagauuucgagucaaauguaacagcaacacuugccaguauuaacaaaauccguaucuucaaggggagauag

SEQ ID NO: 61552 - RNA, 1023 nt, Artificial Sequence
  Description of Artificial Sequence: Synthetic coding sequence
auggucacccuccgaaaaaggacccucaagguccugacauucuugguacuuuuuaucuuccuuaccucauucuuucugaauuacucucauacaaugguggcaaccacuugguuuccgaaacagaugguccucgagcuaagcgagaaucucaagcgacuaaucaagcacagaccguguacaugcacccauuguauuggccaaaggaaauugagcgcaugguucgacgagagauuuaaccaaacaaugcagccccuccuuaccgcacagaaugcucuccuggaagaugacacauacaggugguggcuaagguugcagagggaaaagaaaccuaacaaccucaaugacacuaucaaagagcuguuuaggguaguuccuggcaauguugauccaaugcucgaaaaacgguccgucggcugccgacgcugugcggugguggguaauagcggcaaccuacgggaaucuucauauggaccggagauugauagccaugacuuugugcugcggaugaacaaagcuccaacugcuggguuugaagcagauguggguacaaagacgacacaccaccucguguauccugagaguuuucgggagcucggagacaacguaagcaugauucucgugccuuucaagacaaucgaucucgaauggguuguuagugcuaucacaacaggaacaaucagccacacauauauaccgguucccgccaagauccgagugaaacaggauaagauucucaucuaccacccagccuucaucaaauacguuuucgauaauuggcugcagggucauggacgauacccgaguacaggaauacugucuguuauuuuuucgaugcacguuugcgacgaaguagauuuauacggcuuuggugccgauaguaaggggaauuggcaccacuacugggaaaauaacccguccgccggggcuuucaggaagaccggagugcacgacgcagacuucgaauccaaugucacggccacacuugccucgaucaauaagauacggaucuuuaagggacgguag

SEQ ID NO: 61553 - RNA, 219 nt, Artificial Sequence
  Description of Artificial Sequence: Synthetic coding sequence
auggugacucugcgcaaaaggacucuuaaaguacuaaccuuccuggugcuuuuuauauuucugacuaguuucuuucuaaauuacagccauacuaugguggcaacuacgugguucccuaaacagauggugcucgaacuuagcgaaaauuugaaacgccuuaucaaacaucgcccauguacauguacacacugcaucggacaaaggaaguuaucugccuag

SEQ ID NO: 61554 - RNA, 144 nt, Artificial Sequence
  Description of Artificial Sequence: Synthetic coding sequence
augguaacacucaggaaacguacccucaaaguucugaccuuucuuguguuguucauuuuccugacuucauucuuucucaauuauucccacacuaugguagcaacaaccugguuccccaagcagauggugcuggagcucucguag

SEQ ID NO: 61555 - RNA, 1221 nt, Artificial Sequence
  Description of Artificial Sequence: Synthetic coding sequence
augauccacacaaaucucaaaaagaaguucucgugcuguguguugguguucuuguuauuugccgucaucugcguguggaaggaaaagaagaagggcaguuauuaugacuccuucaaauugcagacgaaagaguuucagguauugaaaucgcucggaaagcuggcaauggggucagauagucaauccgucagcucgaguuccacccaggauccccauagaggcagacaaaccuuggguucccuacggggucucgcuaaggccaagccugaagccucuuuccaaguguggaacaaggacuccagcaguaagaaucuuauuccuagacuccaaaaaaucuggaagaauuacuuaucgaugaacaaguacaagguuagcuacaaggggccagguccuggcaucaaauuuuccgcagaggcucugagaugccaucuucgagaccacguuaacgugucgaugguggaaguuacagacuuucccuucaacaccagugagugggagggauaucucccaaaagaauccaucaggacuaaagcugggccuugggggcgcugugcuguggugagcucggcagguucccuuaagagcagccagcuugggagagaaaucgacgaucacgacgccguucuccgguuuaauggagcucccacugcaaacuuucagcaggauguaggcacuaagacuacuaucagacugaugaacucucaauuagugacaacagagaagagauuuuuaaaagacagucucuauaacgagggcauacuuaucgugugggacccaucggucuaccacucugauauucccaaaugguaucaaaacccugauuauaacuucuucaacaacuauaagaccuaucgcaagcugcacccuaaucagccauuuuacauacucaaaccacaaaugccaugggagcugugggauauacuucaagaaaucucgcccgaggagauucagcccaaucccccuaguagugguaugcuggggauuaucauuaugaugacacugugugaccaagucgauauuuacgaauuccugccaucuaaacgaaagaccgauguuuguuauuauuaucaaaaguuuuuugacagcgccugcacaaugggagccuaucacccacugcuguaugagaagaauuuggugaagcaccucaaucaagggacagaugaagauaucuaccuacuuggaaaggcuacacugccaggauuucgcacuauacauuguuag

SEQ ID NO: 61556 - RNA, 228 nt, Artificial Sequence
  Description of Artificial Sequence: Synthetic coding sequence
augauccauacaaaucuaaaaaaaaaauuuucuugcuguguacuaguguucuugcuuuucgcugugauuugcguguggaaagagaagaaaaaggguuccuauuacgacucauuuaagcuacagacaaaagaguuccagguacuaaaaucacuggggaaguuggccaugggaucagacucacagaguguaucgucuagcucaacucaggauccucaucgcggccgcuag

SEQ ID NO: 61557 - RNA, 342 nt, Artificial Sequence
  Description of Artificial Sequence: Synthetic coding sequence
augauccacacuaaucugaaaaagaaauucucuuguugcgugcuuguguucuuauuauucgcaguuauuuguguguggaaggaaaagaaaaagggaucuuacuacgacaguuuuaagcugcagacaaaggaguuucagguguuaaagucacuugguaaauuggcuaugggauccgacucacaaucaguauccagcagcagcacacaagacccacauagggggcgccagacucucggcucucugagggguuuggcuaaggcaaaaccggaagcuuccuuucaaguguggaacaaagauaguucuucuaaaaauuuaauuccuagacuucaaaaaauuugguag

SEQ ID NO: 61558 - RNA, 384 nt, Artificial Sequence
  Description of Artificial Sequence: Synthetic coding sequence
augauucauacuaaccucaaaaaaaaguucucuuguuguguccuugucuuuuuacuuuuugccgugauaugcgucuggaaagagaaaaagaaaggaucauacuacgacuccuuuaaacuccagacaaaagaauuucaagugcuuaagucucuugggaaacucgcaauggguucagauucccaauccguuuccucauccucaacccaggauccucaccggggaagacagacucuagggucccuccguggccuggcuaaggccaaacccgaggcaagcuuucaaguguggaacaaagacagcucuuccaaaaaccugauacccagacuccagaagauuuggaagaauuaucugagcaugaauaaguauaaggugucauacaaguag

SEQ ID NO: 61559 - RNA, 129 nt, Artificial Sequence
  Description of Artificial Sequence: Synthetic coding sequence
augauucacaccaaccucaaaaagaaguucucuugcugcguucucguuuuucuccuguuugccguuauuuguguguggaaagaaaaaaagaaaggaagcuacuacgacaguuucaaacugcagaccuag

SEQ ID NO: 61560 - RNA, 294 nt, Artificial Sequence
  Description of Artificial Sequence: Synthetic coding sequence
augauacauacaaacuuaaaaaaaaaguucaguuguugugugcugguuuuccucuuauucgccgugaucugcgucuggaaagagaaaaaaaaaggcagcuauuacgacagcuuuaaauugcagaccaaggaguuucagguccugaaaucccugggaaaguuggcaauggguucagauucacaaagcgucucuagcuccuccacacaagauccccaccgaggccgucagacacugggcucccugcgcggauuggccaaagcuaagccagaggcaaguuuucagguguggaacuag

SEQ ID NO: 61561 - RNA, 138 nt, Artificial Sequence
  Description of Artificial Sequence: Synthetic coding sequence
augauucacacaaaccucaaaaaaaaguucucaugcugcguccucguauuccugcuguuugccgucauuuguguuuggaaggagaaaaaaaagggcucauacuacgauucauuuaagcuccagacuaaggaauuuuag

SEQ ID NO: 61562 - RNA, 276 nt, Artificial Sequence
  Description of Artificial Sequence: Synthetic coding sequence
augauacacacuaauuuaaaaaaaaaauuuagcugcugcguacucguuuuccuacuauuugccgugauuugcguguggaaagagaaaaagaaaggaaguuauuaugacucauucaaguuacagaccaaagaauuucagguuuuaaagucacugggcaagcuggcuaugggcucugacucccaguccgugucaaguucuucaacacaagauccccaccggggcaggcagacgcuggguucucugcggggacucgccaaggccaagccagaggcuuag

SEQ ID NO: 61563 - RNA, 1221 nt, Artificial Sequence
  Description of Artificial Sequence: Synthetic coding sequence
augauucauacaaaucuuaagaaaaaguuuucaugcugcguacugguguuucucuuguuugcuguaauuugcguuuggaaagagaaaaaaaagggguccuacuacgacagcuucaaguuacagacaaaggaguuucaagugcugaagucgcuggggaagcuggcaaugggaagugauucucagagugugucuagcagcucuacacaagacccccacagggggaggcagacacugggcucccuccggggcuuggcaaaagcuaaacccgaagccagcuuucaaguuuggaauaaggacagcaguucgaagaaucugaucccuagacuacaaaagauuuggaagaauuacuuaaguaugaacaaguacaaaguguccuacaagggucccggaccugguaucaaauuuucugcagaggcucugaggugucaccuaagggaucaugucaaugucucaaugguggaggugaccgauuucccuuucaacaccuccgagugggaaggcuaucucccaaaagaguccauucgcacaaaagcaggaccauggggacggugcgcagucguguccuccgcagguucccucaaaucaucucaguuggguagagaaauagaugaccaugacgcagugcuccgcuucaacggcgcaccuaccgccaacuuucagcaagauguuggcacuaagacaaccaucagacugaugaacucacaguuggugaccaccgagaaacgauuccuuaaagauucacuauauaacgaaggcauccugauagugugggauccuucagucuaucauagcgacaucccaaaaugguaccaaaaucccgacuacaacuuuuuuaacaacuacaagacuuacaggaagcuccacccuaaccagccauucuauauuuuaaagccacagaugcccugggagcugugggauauacugcaggagaucucucccgaagagauccaacccaacccuccuucuaguggaaugcugggcauuaucauaaugaugacccugugcgaucagguugacaucuacgaauuccuccccucuaaacgaaaaacagacguuugcuacuacuaccaaaaguuuuuugacagcgcuuguacuaugggcgccuaucacccucugcucuaugaaaagaaucuggugaagcaccucaaucaagggaccgaugaagacaucuaucuucuggggaaggcuacucugccgggguucagaacaauucacuguuag

SEQ ID NO: 61564 - RNA, 297 nt, Artificial Sequence
  Description of Artificial Sequence: Synthetic coding sequence
augauacauacgaauuuaaaaaaaaaguucaguuguugugugcucguuuuuuuacuguuugcagugaucugcguuuggaaagagaagaagaagggcucguacuaugacucauuuaaacuucagaccaaagaguuucagguccugaagucacuugguaaacuggcaauggguagcgauucucagagugucucaucuagcuccacacaggauccacauagggguaggcagacgcuggggucacuaaggggacuugccaaggccaaacccgaagccuccuuccagguuuggaauaaauag

SEQ ID NO: 61565 - RNA, 528 nt, Artificial Sequence
  Description of Artificial Sequence: Synthetic coding sequence
augaacagccaacuugucaccacugaaaaacgcuuccugaaagauagccucuacaacgagggcauucuuauugugugggaccccuccguauaucacucugauauucccaaaugguaucagaaucccgauuauaauuucuuuaauaacuauaagacauaccgcaagcugcauccgaaccagcccuucuacaucuuaaagccucagaugcccugggagcucugggauauacuccaagaaauuuccccugaagagauccagccaaauccuccuucaucugggaugcuagguaucaucauaaugaugacacuaugcgaccagguagauauauaugaguuucugccuucuaagcgaaaaaccgacguuugcuacuauuaccagaaguucuucgauagcgccuguacgaugggcgccuaccauccauuguuguaugaaaaaaaccuagugaaacaccugaaucagggcacagacgaggauaucuaccugcucggaaaagccaccuuaccaggauucaggacaauucacugcuag

SEQ ID NO: 61566 - RNA, 78 nt, Artificial Sequence
  Description of Artificial Sequence: Synthetic coding sequence
augauccauacuaaucugaaaaaaaaauucucuuguuguguccucguguuucugcucuuugcugucauuugcguguag

SEQ ID NO: 61567 - RNA, 2073 nt, Artificial Sequence
  Description of Artificial Sequence: Synthetic coding sequence
augggugccguggcuagggcacaugggggacugagaguugccagggcccgcgaaagcguagcagggggacgacaccggggugcaggacggcccggagcacgagcagccggugccgccgcgggauuagugagagcagaggccggcggcagacgggcuggcagaggacgaagacccgguagaggccugccaacaggaggagggggucucgcugcugcagccguaggccgagagguugcucagggacuaugugaugccauuaggcuggauggcggucucgaccuuuugcuccgguuguuacaggccccugaauuagagacgcgggugcaggcugcucggcuccuggagcagauccuggucgcugagaaucgggauagggucgcgcgcauuggacuuggcgugauccugaacuuggcuaaggaaagagagccagucgagcuugcuaggucuggcuccgggauauuagaacacauguuuaaacauagcgaggaaacuugucaacgucucguugcugccgguggacucgacgccguuuuauauuggugucggagaaccgacccugcacuuuugcgucacugugcacuggcacucgguaauugcgcccuacaugggggccaggcgguccaacgucggaugguagagaagagagcugcagaguggcuguuuccuuuggccuucuccaaggaggaugaacuccucagccuacaugcuugucucgccguggcaguccucgcuacaaacaaggagguggagcgggaaguugaaaggucuggcacacucgcccugguggagccccucguugcaagucuggaucccgguagguucgcucgcugucugguugacgcuuccgacaccucccaggggcgggguccugacgaccuucagcgccugguuccucuucuugauuccaaccgucucgaggcccagugcauuggggcauuuuauuuaugugccgaggccgcuauuaaaucucuacagggaaaaacaaaggucuuuuccgacauaggagcaauacaaagccugaagagacucgugucauacuccacaaauggaacgaaaucagcccucgcuaaacgggcgcuucgacugcuuggcgaggagguaccacgcccuauccugcccucugucccaucuuggaaggaggccgagguccagacguggcugcagcagaucggcuucagcaaguacugugaaucuuuccgggagcaacagguugacggggaucuccugcuccgccuuacggaagaagaacuccagacugaucugggaaugaagagugguaucacucgaaaacguuucuuuagggaacuaacagaacucaagaccuucgcaaacuauucgacaugcgaucgcaguaaucuggcggacuggcuuggaucucuggauccaagguucagacaguacacauacgggcuugucucaugcgggcuggaccggucccuauuacacaggguuagugagcagcagcugcuggaagauuguggaauccaccuggggguccauagagcaaggauucuaacagcugcccgagagaugcugcauucaccucugcccuguacagguggaaaaccuuccggggacacaccagauguguuuaucagcuaucggagaaacucgggcucccagcuggccucauuacuuaaggugcaccugcaacugcacggcuucaguguguucauagacguugaaaagcucgaggcagguaaauucgaggacaagcugauccagaguguuaugggcgcuagaaacuucgugcuggucuugaguccuggggcucuggacaagugcaugcaagaucacgauugcaaagacuggguacauaaggaaaucgugaccgcacugagcugcggcaaaaauauuguccccaucauugacgguuuugaauggccggagccccaaguuuugcccgaagauaugcaggccgugcugacauuuaauggaaucaaguggagucaugaauaucaagaagcuacuaucgagaaaaucaucagguuucuccaggggagaucaaguagagacucgucagcuggguccgauacuucacuugagggggcagcaccaauggggccuacuuag

SEQ ID NO: 61568 - RNA, 3426 nt, Artificial Sequence
  Description of Artificial Sequence: Synthetic coding sequence
auggcugcagccguaggagugagaggccgcuacgaacugccucccuguucaggcccaggcuggcugcuuucccuguccgcccuauuaucuguggccgcuagaggugcauucgcgacaacacacuggguggugaccgaggacggaaagauccagcagcaggucgauaguccgaugaauuuaaagcacccccacgaucucgugaucuuaaugagacaggaggccaccgucaauuaucuuaaagaacuggagaagcagcugguagcacagaaaauucacauugaggagaacgaagacagagauacugggcucgaacaaaggcauaauaaggaagaccccgauugcauaaaagccaaggugccccugggggaucuugaucucuacgacggaaccuauaucacucucgagucuaaagacaucucucccgaggauuacauugacacugaauccccugucccacccgaucccgaacagcccgauugcacgaagauccuggagcuaccguacuccauccacgccuuccagcacuuacgcggcgugcaggagcgaguuaaucugagugcuccacugcuaccgaaggaggaucccauauuuacuuaccuauccaaaagacugggcagaagcauagaugauauaggacaccucauucacgagggucugcagaagaacacuucuaguugggugcuguauaacauggcaucuuucuacuggcggaucaagaaugagccuuaccaggugguugaaugcgccaugcgcgcacuucacuuuagcagucgacacaacaaggauauagcgcuggugaauuuagcuaacguccugcaucgcgcucauuucucugcugaugccgcaguggugguucaugcagccuuagacgacucugauuucuucacuaguuacuauacucucggcaauauuuacgcuaugcugggggaauacaaccacucugugcugugcuacgaccaugcccuucaagcaagacccggcuuugagcaagcaauuaaacgcaagcacgccguucucugucaacagaaacuugagcagaaacuggaggcucagcaccgaucucugcagaggacacucaaugaacuaaaagaguaucagaagcagcaugaccacuaucuucgucagcaggagauucuggaaaaacacaagcucauccaagaggagcagauccucaggaacauuauccacgaaacacagauggcaaaagaagcccagcugggcaaucaccagaucuguagacugguuaaccaacagcacucacuccacugccaaugggaccagccaguccgguaccaucggggcgauauuuucgaaaacguugauuacgugcaguucggugaagacuccuccacuaguagcaugaugucggugaauuuugauguucagaguaaucaaucagauaucaaugauucuguuaagucaagcccagucgcccauagcauccucuggauuuggggcagggauagugaugcuuaucgugacaagcagcacauccuuuggccaaaaagagcugauuguaccgagaguuacccucgggugccuguuggaggcgaacugcccaccuacuuucuuccucccgaaaacaagggucucaggauucacgaacucucuagcgacgauuauucuaccgaagaagaggcccagacaccagacuguuccaucacagauuuuaggaaaagccauacccucucuuaccuggugaaggaguuggagguccgaauggaucuaaaggcaaaaaugccagacgaucaugcacggaagauucugcugucccgcauuaacaauuacacgaucccagaggaggaaaucgggucuuuuuuguuucacgcuaucaauaagccaaaugccccuaucuggcugauccugaaugaagcagguuuguacuggagagcugugggcaauagcaccuucgccaucgcaugucugcagcgggcguuaaaucucgcgccucugcaauaucaagacgugccacuagucaaccuggccaaucugcugauccacuauggccugcaucuggaugccaccaagcuauugcuccaggcccucgcuauuaauaguucagagccccucacuuuucugagccucgguaaugccuauuuagcccuuaaaaacaucucaggugcacuugaagccuuuaggcaagccuugaagcucacaacuaaauguccugagugcgaaaauaguuugaaacucauacgcugcaugcaguucuacccauuccuguauaacauuaccaguucaguaugcucagggacugugguugaggaaagcaacggaucugacgaaauggaaaacucggacgaaaccaagaugagcgaggaaauccuagccuugguugaugaauuccagcaggccuggccauuggagggauuuggcggcgcccuggagaugaaggguagaaggcuagaccugcaggguauccgggugcucaagaaaggcccccaggacggcgucgcgagaucaagcugcuauggcgauuguagaucagaggaugacgaagcaacagaguggaucacuuuccaggucaaacgagugaagaagccgaagggcgaucacaagaagacccccggaaagaagguggaaaccggacagaucgaaaacggacacagauaucaggcaaaccuggaaaucacaggaccgaagguggcaucaccuggcccacaggggaagaaacgagacuaccagagacucgguuggccauccccagaugagugccucaagcugcgcuggguggaacucaccgccaucguaucgacauggcuggccguuucuucaaagaacauugacaucacagaacacauugauuuugcuaccccaauacagcaaccggccauggagccccuuuguaauggaaaccuuccuacuucuaugcacacccucgaccaucugcauggcgugucuaaucgggccucccugcauuacaccggagagucucagcucacugagguccugcagaauuugggcaaggaucaguacccgcagcagagucucgaacagauaggcacacggaucgccaaaguacuggagaaaaaucagacuucuuggguguugucuucgauggcggcccucuacuggagagugaagggacaggggaagaaggccauagacugucugcgacaagcguugcauuaugcaccccaucagaugaaagacgugccauugaucucacuggccaauauccugcauaaugccaagcuuuggaacgacgcugugauugucgccacaauggccguggagaucgcaccccacuucgccgugaaucacuuuacccucgguaauguauauguagccauggaagaguucgaaaaggcccucgucugguacgagagcacccugaagcugcaaccggaauucguaccugcaaagaaccguauacaaacaauucagugccauuugaugcuaaagaagggcagaagauccccuuag

SEQ ID NO: 61569 - RNA, 978 nt, Artificial Sequence
  Description of Artificial Sequence: Synthetic coding sequence
auggcccauuucgugcaaggcacaucacgcaugauugcagcagaaucuucuacugaacacaaagagugugcagaaccaaguaccagaaagaaucuuaugaauagcuuggagcaaaaaaucaggugucucgaaaagcagcggaaagaacugcuggaggugaaccagcagugggaccaacaauuccgaucuaugaaagagcuguacgaacguaaaguggccgagcugaagacaaaacucgaugccgcagaacguuuuuugagcacacgagagaaagacccacaucagcgccagcggaaagaugacagacagagagaagaugacagacagcgggaucucacccgagaccgucugcaaagagaagaaaaggagaaggaaagguugaaugaagagcugcaugaacucaaagaggaaaacaaacuguugaaaggaaagaauacccuggccaauaaggaaaaagaacacuaugaaugcgaaaucaagagacuuaacaaagcucugcaggacgcccugaacauaaaaugcagcuuuuccgaagauugcuugcggaagucuagaguggaauuuugccacgaagaaaugcgcacugagauggagguccugaagcaacagguccagauauacgaggaagacuuuaaaaaagagagaucagaucgcgagagacuuaaucaggagaaagaggaauugcagcagaucaacgagacaucucaaucacaacugaaccgccuuaauucccagaucaaggccugccagauggaaaaagaaaaacucgagaagcaacuuaaacaaauguacugcccccccuguaacuguggcuuaguguuccaccuacaggaucccugggugccgaccgguccaggugccguucagaagcaacgagaacacccaccagacuaucagugguacgcccucgaucaauuacccccggauguucaacauaaagcuaacggccuguccuccguaaagaagguacacccauag

SEQ ID NO: 61570 - RNA, 5361 nt, Artificial Sequence
  Description of Artificial Sequence: Synthetic coding sequence
augggccuccuacaacugcuggcuuuuuccuuccucgcgcucugucgcgcucggguccgcgcccaggagccagaguuuucguacgggugugcagaggggaguugcuaucccgcgacuggcgaccuccucaucgggcgagcucagaaacuaucugugaccucuaccugcggcuuacauaagccagagccuuacuguaucgucucacacuuacaggaagacaaaaaguguuucaucugcaauagccaggauccuuaccaugagacccugaaccccgacucccacuugauagaaaacguagucacaaccuucgcuccgaauagacucaaaaucugguggcaaucagaaaaugggguggagaacgugaccauccagcucgaccuugaagcggaguuccauuucacgcaccuuauuaugacguucaagacauucagaccugcagcuaugcugauugagaggucgucagacuuuggaaagaccuggggcguguauagguacuucgcauacgacugugaagccagcuuuccaggcauaucuaccgguccgaugaaaaaaguugaugauauuauaugcgacucuagauacagcgacaucgaacccuccacagaaggugagguuaucuuccgcgcucuggaccccgccuuuaaaauugaagacccuuacucaccgagaauccagaaccuccucaagauaacaaauuugcggauuaaauucgucaagcuccacacucuuggcgacaaucuguuggacucacgcauggagauucgggagaaauacuacuacgcuguguacgauaugguugugcgaggcaacugcuuuugcuauggucacgccuccgaaugcgcaccuguggauggcuucaaugaagaggucgaagggaugguccacggucauugcauguguaggcacaauacaaagggucugaauugugagcuauguauggacuuuuaucaugauuuacccuggaggccugcagaaggacguaacucuaacgccuguaaaaaauguaauugcaaugaacacagcauuaguugccacuucgacauggccguauaucuagcgaccggcaacgugucuggcggcguaugugaugacugucagcacaauacgaugggacguaauugcgaacaguguaagccuuucuacuaucagcaccccgagcgcgauauucgggaccccaacuucugcgagagauguacuugugauccugcggggucccagaaugagggcaucugcgacaguuacaccgacuucaguaccggguugaucgccgggcagugccggugcaaacuaaacguggagggagaacauugugaugugugcaaggagggauucuaugaccucaguuccgaagacccauucgguugcaagucaugugcauguaauccccuggggacuaucccuggaggcaacccaugcgauagugagacuggucacuguuacuguaaaagacuugugacuggccagcacugcgaucagugucuucccgaacauuggggauuaucuaacgaccuggacggaugcagacccugcgauugcgaccuggguggggcguugaacaacagcugcuucgcugaaucaggccaauguaguugccguccucauaugaucggcagacaguguaacgaaguggagccaggauauuauuucgcaacauuggaucauuaccucuaugaggcggaagaagcaaaccugggccccggcguguccaucguggaacgccaauacauucaggaccgcaucccuucguggaccggcgcuggauucguuagggugccugagggcgccuaucuugaauucuuuaucgacaauauaccuuacagcauggaguaugauauucugauccgguacgaaccacaacuccccgaccacugggaaaaggcugucaucaccguacagaggccuggucgaaucccuacuagcaguagaugcgguaacacaauccccgacgaugacaaccaggucgugucucucuccccgggaagccgauacgucgucuuaccaagacccgugugcuuugaaaaggggacgaacuacaccguccggcuggagcucccccaguauaccuccucugacucggacguagaaucaccguacacauuaauagacucacuggugcucaugccauacugcaaaagccuggacaucuuuacugucgguggauccggcgauggcguugucacaaacagcgcuugggagaccuuccagcgauaccgcugucuugaaaacagccgauccguggugaaaacaccaaugacagaugugugccggaacauuaucuuuuccauuucagcuuuacugcaccagaccgggcucgcuugugaaugugacccacagggaucccuguccagugucugcgaccccaauggcgggcagugucagugccgcccaaacguggugggucgcaccuguaauaggugugcuccuggaaccuuuggcuuuggaccaaguggguguaaaccuugcgaaugucaucuccaaggcucuguaaaugccuucugcaacccagugaccgggcaaugccauuguuuucagggcguguaugccagacagugcgaccgcuguuuaccggggcauugggguuuccccuccugucaacccugucagugcaauggccaugcagacgauugcgauccugugacaggggaaugccuuaacugucaggauuacaccaugggccauaacugcgagagaugucuggcaggguauuauggagacccuauaauugggucaggagaccacugcagaccaugcccaugcccagacggcccagacucggggcggcaauuugcaaggaguuguuaccaggauccagugacccuacagcuugccugugugugcgacccuggguacauaggaagccggugugacgacugcgcaagcggauauuuugggaacccaucugaagucgggggaucuugccagcccugucagugccauaauaauauagacacaacugauccagaagcaugugauaaggagaccggaaggugccugaagugucucuaccauacagagggugaacauugccaguuuugccgguuugguuauuauggugaugcucuacagcaagacuguaggaagugugucuguaacuaccucgguacaguucaggaacauugcaauggcagcgauugccagugugacaaggcgacugggcaaugucugugcuugccaaacgucaucggccagaacugugaucgcugugccccuaacaccuggcaauuagccucugggacuggcugugacccgugcaacuguaaugccgcacacagcuucggccccagcugcaaugaguucacagggcagugucagugcaugcccggguuugguggacguacauguagugagugucaagaacucuuuuggggggauccggacgucgaaugccgagcuugugauugcgacccacgggggauagaaacaccucagugcgaccaguccacuggucagugugugugcgucgagggcguggaggguccuaggugugacaaaugcacccggggguauagcggagucuuuccagacugcaccccaugucaccaguguuuugcccugugggacgugaucaucgccgaacugacaaacaggacgcacagguuuuuagaaaaggccaaagcccugaaaauuucaggggugaucggccccuaucgcgaaaccguagauucuguggaacggaaggugagugagauuaaagacauccuggcccaaagucccgcagcagagccacugaagaacaucggcaaccuguucgaagaggccgaaaagcugaucaaggauguuacagagaugauggcacagguggaaguuaaauuguccgauaccacuucucagucuaauagcacagcaaaggagcuugacucucugcagaccgaggcagagucauuagacaacaccguaaaggagcuggcugaacaacuggaguucaucaaaaauuccgacauucggggagcccuggacuccauuacgaaguauuuccagaugaguuuggaagcagaagaaagaguuaacgccucuacaaccgagccaaauaguacaguugagcaaagugcacucaugagggacaggguggaggacguuaugauggaacgagaaucacaauucaaggaaaaacaagaggaacaggcucggcugcuagacgaguuggccggcaagcuacagucccuagaccuaagugcugccgccgagaugacaugcgggacaccacccggagccuccuguucggaaaccgaauguggaggcccuaauugccguacggacgagggggaaaggaaguguggcgggccuggaugugggggacuaguuacaguggcccauaacgcguggcagaaagcuauggaccuagaucaggaugugcugagugccuuggcugaagucgaacaguugucuaagauggugucugaggcaaaacugcgagcagacgaagcgaaacaaucugccgaggauauucuccugaaaaccaacgcuacaaaggagaagauggacaagaguaaugaggagcugaggaaucugauuaaacaaauacgaaacuuucugacucaagauucggcugauuuagauuccauugaagccguggccaaugaagugcugaagauggagaugccauccaccccccaacagcugcagaacuugacagaagauauacgggagagaguagaaagccugagucagguggaaguaauccuccagcauuccgccgcugacaucgcccgagccgagaugcuuuuagaagaagcgaagcgggcguccaaauccgccacagaugugaaggugacagcugauauggugaaggaggcccuggaggaggcagagaaggcucagguggcagcggagaaagcaauuaaacaagcugacgaggauauccaaggcacacagaaccuccucacaagcaucgagucagagaccgcugccagugaagaaacccuguuuaacgccucucagcgcaucuccgaauuggagcggaacguggaggaacugaagaggaaggccgcucagaacuccggcgaggcagaguauaucgagaaggugguguacacuguuaagcagucugcagaagaugugaaaaaaacucuugacggcgagcuggaugaaaaguacaaaaagguggaaaaccugaucgccaagaagacggaagagagugccgacgcccgcagaaaggcugaaaugcuucagaacgaagccaaaacccuacuggcacaggcgaacuccaaacuccaacuuuugaaggaccuagagcgcaaauacgaagauaaccaaagauaccuagaggauaaggcccaggaauuagcucggcuagagggugaaguaagaucacuucuuaaggacauaagccaaaaaguugcaguguacucuacuugcuuguag

SEQ ID NO: 61571 - RNA, 4011 nt, Artificial Sequence
  Description of Artificial Sequence: Synthetic coding sequence
auggcgaccgagaucgggagcccaccaagauuuuuccacaugccccgcuuccaacaucaggcgccacggcagcuguucuacaagaggccggacuucgcccagcagcaagcuaugcaacaacucacguuugacgggaagcgcaugaggaaggccguuaauaggaaaaccauugacuacaacccauccgugauaaaguaccuggagaaucguauauggcagagggaccagcgcgauaugagggcaauccaacccgacgcaggauacuacaaugaccuggugccuccuauuggaauguuaaacaacccuaugaacgcgguaacaacaaaauuugugagaaccaguacuaacaaggugaagugccccguauuuguggugagauggacuccagaggggcgacgauugguuacgggggcuuccucgggugaauuuacacuguggaacggcuugaccuucaacuuugaaacaauucuccaggcucaugacaguccagugagagccaugacauggucacauaacgauauguggaugcugaccgccgaucacggaggcuacgucaaguauuggcagagcaacaugaauaaugugaagauguuucaggcccacaaggaagcaauucgcgaagcuuccuucucuccaacagacaacaaguuugcaacaugcucagacgauggcaccgucaggaucugggacuuucugcggugccaugaggaacgaauacugagaggccauggggccgacgugaaaugcgucgacuggcacccaaccaagggccucgucgucagcggcaguaaggacagccaacagcccauuaaguucugggacccaaagacaggccagucacuggcaacgcugcaugcgcauaaaaauacugugauggagguaaaguugaacuuaaacggaaacuggcuucucaccgcaagccgggaccaccuguguaagcuuuuugauauccgcaacuugaaggaggagcuucaaguuuuccgggggcauaagaaagaagccaccgcaguugcauggcacccagugcacgaaggccuauuugcuucugggggcuccgauggcagcuugcucuuuuggcaugugggcguggaaaaagagguggggggaauggaaauggcccacgaaggaaugauauggucgcuugcauggcauccccuagggcauauucuguguagugguaguaacgaccauaccagcaaauuuuggacacguaaucgaccuggcgauaagaugcgugaucgguacaaccucaacuugcuucccggaaugagcgaggacgggguggaauaugaugacuuagaaccuaauucacuugccgugauuccugggaugggaauucccgagcagcugaagcuggcuauggagcaggaacagauggguaaagacgaaucgaaugagauagaaaugacuauaccggggcucgauugggggauggaggaggucaugcagaaggaucagaagaaagugccacagaagaaagucccauacgcuaagcccauuccagcacaauuucaacaggcuuggaugcaaaacaagguccccauccccgcccccaacgaagugcugaacgaccggaaagaagacauaaaacuagaagagaaaaaaaagacacaagccgagaucgagcaggagauggcaacccuacaguacacuaacccacaacuacucgagcagcucaagauugagaggcuugcccagaaacaaguggaacagauccagcccccaccuaguucaggcaccccucuuuugggaccccagcccuucccugggcaaggcccgaugucccagaucccucagggauuccagcaaccccauccaucccagcagaugccaaugaauauggcucagaugggaccaccaggcccccaagggcaauucagaccccccgggccucagggccaaaugggcccacagggucccccuuuacaucaagguggaggggguccccagggauuuaugggaccgcagggcccucagggcccaccacagggacugccuaggccucaggauaugcauggcccacaagguaugcagcggcacccuggaccacauggaccacugggaccacagggcccgccagguccucagggguccagcgggccucagggacauauggggccacaggggccgccugggccucagggucacaucgggccacaaggcccccccgguccacagggacacuuagguccucaaggcccaccaggaacacaaggaaugcagggcccucccgguccuaggggcaugcagggccccccccauccgcacggcauccagggcggaccaggcucacaagguauacagggccccgucucacaagguccucucaugggguuaaacccuaggggcaugcaaggacccccgggcccccgcgagaaucaagguccugcaccucaagguaugauaaugggccaccccccccaagagaugcggggcccgcaccccccuggagggcuccucgggcauggaccucaagagaugcgugggccccaggagauacgagggaugcaaggaccuccaccgcagggcaguaugcucgggccuccacaggaguuacgggguccccccggcagucaaucacaacaggguccuccgcagggcucuuuaggucccccaccucaggggggcaugcagggcccgccagggccgcaaggacagcagaacccagcaagaggcccgcaucccagucaagggccuauuccuuuccagcagcaaaagacuccucuccugggcgacgguccgagggcaccauucaaucaagagggccagagcacaggccccccaccucuuauacccggacuagggcagcagggggcucaggggcgcauccccccccugaaucccggccagggcccuggaccaaacaagggggauucucggggcccuccuaaccaccauauggggcccaugagcgaacgaaggcaugaacagagcggagguccugagcaugggcccgaaagaggcccuuuucgaggaggacaagauugccgggggccuccggaucggcgugguccacacccggacuucccugaugacuucucacggccagacgauuuccacccggacaagcgcuucggccaucgguugcgcgaguuugagggccggggcggaccccucccucaagaagagaaguggcgccguggagggccagguccccccuuccccccagaucaucgggaguuuagcgagggggacgggagaggagcggcaagggggccuccuggagccugggagggacgccgacccggcgacgagcgcuucccccgagaccccgaagacccucgguuccgcgggcgcagggaggaaucuuuucggcgaggggcaccaccucgacacgaaggccgagcuccgccacggggacgcgauggguuuccaggaccugaagacuuugggcccgaagagaacuucgacgcauccgaggaggccgcacguggaagggaucuacgcggaagaggucgcgggacaccucggggaggucgaaaagggcucuugcccacucccgaugaauuuccacgguucgaggggggucgaaaaccugacagcugggauggcaaccgagaacccggaccuggccaugaacacuuucgugauacaccucggccagaccauccaccacacgacggccacucacccgccucucgcgagcgaaguaguucucugcaagguauggacauggcaagcuugccccccagaaaacgccccuggcaugauggaccugggacaucagagcacagagagauggaagcaccaggagggcccagcgaagaucgcgguggcaaaggacggggcggcccuggccccgcucaacgggucccaaaaucuggucguuccagcucacuggacggugagcaucaugauggcuaucaccgagaugagccguuuggaggccccccuggcagcggcacuccuaguagaggagggaggucugggaguaacuggggcagggggagcaauaugaacucaggcccuccacgccgcggggccucuagaggcgguggucggggaagauag

SEQ ID NO: 61572 - RNA, 774 nt, Artificial Sequence
  Description of Artificial Sequence: Synthetic coding sequence
auggcuaccgagauagggagccccccuagguucuuucauaugccacgguuccaacaucaggccccccgacaacuguucuauaaaagaccagauuucgcucagcagcaggcuaugcaacagcuuacauuugaugguaaaagaaugagaaaagccgugaauaggaaaacuauagacuauaauccuuccguaauuaaguacuuggagaauagaaucuggcagagagaccaaagagauaugcgggcuauccagccagacgccggauacuauaaugaucuggugccaccaaucgguaugcugaacaaucccaugaacgcagucacuaccaaauucgugcgcacuagcacaaauaaaguaaagugcccaguauuuguagugagauggaccccugagggccgacgccuugucacuggcgcuucaaguggagaauuuacguuguggaaugggcugacuuucaacuuugaaacuauauugcaggcccaugauagcccuguuagagcuaugaccuggucacacaacgacauguggaugcugacugcagaucacggcggcuaugugaaguacuggcaaaguaacaugaauaaugucaaaauguuucaggcccauaaggaggcaauuagagaggcaucuuucucccccacugacaacaaauucgcaaccugcucagacgacgggacagugaggaucugggacuuucuaaggugucaugaagaacgaauccugagagacaccuguuuccaccauugucgcuguuacuuccuaagcgugaagcgguag

SEQ ID NO: 61573 - RNA, 357 nt, Artificial Sequence
  Description of Artificial Sequence: Synthetic coding sequence
auggcaaccgagauagggaguccacccagguucuuucacaugccuagauuucagcaucaggccccuagacaauuguuuuacaagcgacccgauuuugcucagcagcaagcaaugcagcagcugaccuucgaugguaaacguaugagaaaggccgucaaccgcaaaacgaucgacuacaauccaagcgugauuaaguaccucgaaaauagaauauggcaacgagaucagagagauaugcgggccauucaaccggacgcaggauauuacaaugaccuggugccaccgaucggaaugcugaauaaucccaugaaugccguuacaaccaaauucgugcgcaccuccaccaacaaaguauag

SEQ ID NO: 61574 - RNA, 981 nt, Artificial Sequence
  Description of Artificial Sequence: Synthetic coding sequence
auggccacugagaucggaagucccccccgauucuuucacaugccccgcuuccaacaucaggcaccgcgucagcuauuuuauaagcggccagauuucgcccagcagcaggcaaugcaacagcuaacguucgaugguaaacggaugagaaaagcggugaacagaaagacuaucgacuauaaccccucagugaucaaauaccucgagaaucggauauggcagagggaccaacgagacaugagggccauucaacccgaugccggauacuauaacgaucuggugccaccuaucggaaugcugaacaauccgaugaaugcuguaacuacaaaguucgugagaacguccacuaacaaaguuaaaugcccuguauucguagugagauggaccccagagggaagacgcuuaguaacaggagccucaagcggagaauuuacgcuguggaacggacugacuuuuaauuuugaaacuauucugcaggcacacgacuccccuguccgggcaaugaccuggucccacaacgacauguggaugcugacggcggaucauggaggcuaugugaaauauuggcagucaaacaugaacaacgugaaaauguuccaagcgcacaaagaagccauucgggaagcaagguuuauucacaauauuccauuuucgguggugccaauuguuauggugaaauuguucagcaaaugcauucugggcgcagagaugcacgggcuuugccaguucuugggaaacuuccuacacccaaucaauacaauuuuuuuuuucguauuuacccacuccccuuucuguuggcaccucagcgaaguuguguugucccgauaccagccgcuccaauaugugcgggauguauugagcgcugcuuuuugcaccggauucuuauucagcuuuaugauaaacaacguguacacacuguuucuuuuuaucaucuacugcguccgccaggaguauuuuaucccuaacaaagaauucucccuuuag

SEQ ID NO: 61575 - RNA, 4293 nt, Artificial Sequence
  Description of Artificial Sequence: Synthetic coding sequence
augucccggccuaguucaguauccccuagacaacccgcgccaggagggggcggcgggggcggcccuucucccugugguccaggggggggagggagagcgaaggggcuaaaggacauccgcaucgacgaagaagugaaaaucgcaguuaauaucgcucuagagagguucagauacggggaccaacgugaaauggaauuuccaucaagccucaccucaacugaacgugcauuuauucaccggcugagccaaucucugggauuaguuucgaagaguaaaggaaagggggcaaaucgguaccuaacggucaagaaaaaagauggauccgagaccgcucacgcaaugaugaccuguaaccucacucacaacacuaaacaugcagugaggucccuaauacagcgguuuccugugacuaauaaggaacguaccgagcugcuacccaaaacugagaggggcaauguguucgccguugaagcagagaaccgggagaugucuaagaccucaggcagacugaauaauggaauuccucaaauucccgucaaaaggggggaaucagaguuugacucauucagacagucgcuuccagucuucgaaaaacaagaagagauugugaagauaaucaaggagaacaaagugguguugauugugggcgaaacugggucuggaaaaacuacacaaauaccucaguuucugcucgacgauugcuuuaaaaacggaauccccugcaggaucuucugcacccagccucgacgccuggccgcuauugcaguugccgaacgggucgccgcugaacgccgggaacguaucggccagaccaucgguuaucagauaagacuggagaguagggucuccccaaaaacauuauugacguuuuguaccaacggcguccuccucagaacacuaauggcaggcgacuccacauugagcacuguuacucacgugauuguagaugaagugcacgaacgcgaccgauuuagcgacuuucuccuuacaaaacugcgcgacuugcugcagaagcauccaacuuugaaacucauccugucauccgcugcacuggaugugaaucuuuucauacgcuauuucgguagcuguccagucaucuacauacagggucggccauuugaggugaaagagauguuccuggaggauauccuccgcacuacuggcuacaccaauaaagagauguugaaauacaagaaggaaaaacagcaggaagagaagcagcagacaacccugaccgagugguacuccgcgcaagagaauaguuuuaaacccgaaucccaaagacaaagaacaguauuaaaugugaccgaugaguacgaucuuuuggacgacggcggcgaugcuguuuuuucccagcucaccgaaaaagacguuaacugccuggaaccauggcuuaucaaggagauggacgccugucucagcgacaucuggcugcacaaggacauugacgccuucgcgcaggucuuucaucuuauccugacagagaaugugucaguggacuauaggcacucagagaccucagccaccgcccugaugguagccgcuggcagaggcuuugcuucccagguggagcaacuuauaucuaugggcgccaacgugcacucuaaggcaucuaacggauggauggcccuggacugggcgaaacauuuuggccagacugagaucguggauuugcuagaaagcuauucagccacccucgaauucgggaaucuugacgaaucgucacugguucagacuaauggaucugaccuauccgccgaagauagggagcuccuaaaggccuaccaccauuccuucgaugacgagaaagucgaucuugaccugauuaugcaucugcuguauaacauuugccacucaugcgacgcaggagcuguguugaucuucuugccaggcuacgacgaaauugugggucuuagggaccgcauccucuucgaugauaaaagguucgcagacucaacucaucgguaccaggucuucaugcugcauucaaacaugcagacuagugaccaaaagaaaguccucaaaaauccaccagccggcguucggaagauuauacucagcaccaacauugcagagacaaguaucacuguuaacgauguuguuuucgugauugauagcggaaaagugaaagaaaagucauucgaugcacucaacuucgugacaaugcucaagaugguguggauuaguaaggcaagugccauucaacggaaagggcgcgcagggcgcuguagacccgguauuuguuuccgguuguucagucgccuccgguuucagaauaugcuugaguuccagaccccagaauugcugcgcaugccucugcaggagcuuugccugcacaccaaacugcuggcaccggucaauugccccauugcagacuucuuaaugaaagccccagagccaccccccgcauuaaucgucagaaaugcagugcagaugcugaagaccauugaugcaauggacaccugggaagaucugacagaacugggguaccaccuggccgaccucccaguggagccucacuugggcaaaaugguucuuugcgccguggugcugaaaugcuuggauccuauacugaccauugccugcacuuuagcuuaccgcgaucccuucguccuacccacccaggccucucagaagagagccgccaugcuguguagaaaaagauucacagccggcgcguuuuccgaccauauggcgcugcugagagcuuuccaagcauggcagaaagcacguucggauggcugggagcgugcuuuuugugagaaaaacuucuuaucacaggcgacgauggagaucauaauuggaaugagaacgcagcugcugggccagcuacgcgcuagcggauucguucgagcuagagguggaggggauauccgggacgucaacacaaacucagaaaacugggccguggugaaagccgcucucgucgccgggauguauccaaacuuggugcaugucgaccgagagaaccucgugcugacaggucccaaggagaaaaagguuagauuccaccccgcuaguguacugucccaaccgcaguacaaaaagaucccacccgcgaauggucaagcagccgcaaucaaagcucuacccacugauuggcucauauacgaugagaugacucgcgcucaucggauagcaaacauaaggugcugcuccgccgucacccccguuacuauccuuguguuuugcggaccagcccgacuggcgaguaacgcucugcaggagccaucauccuucaggguugacgggaucccuaaugauucaucagacagugaaauggaagauaagacaacugcuaaucucgccgcacucaaacuggacgaauggcuccacuucacccuggagccagaagccgccagccuauuacuacagcuccgucagaaguggcauagucuuuuuuuaaggaggaugcgcgcuccgagcaaaccauggucacagguugacgaagcuacaauaagagcaauuauugcggugcuauccaccgaggagcagagcgcuggcuugcaacagcccuccggcaucggccagagacccaggccaaugaguagugaagaguugccccuugccaguagcuggcgguccaacaauucucgaaaauccuccgcggauacugaguucucagacgagugcaccacagcugagcgggugcucaugaaaucccccucucccgcuuuacauccgccccagaaauauaaggaucggggaauccuccaccccaagagaggcacugaagauaggucugaccaaaguucucuuaaaagcaccgauuccucuuccuaucccagucccugugcuagccccagcccuccaucauccgggaaaggcucaaaguccccuuccccucgccccaauaugccuguuagauauuucaucaugaaaucuucuaaucuccgaaacuuagagaucagccagcagaagggaaucuggaguaccacccccucgaacgagagaaaauugaaucgcgcuuuuugggaguccucaaucguguaccucguuuucuccgugcaagggucuggucacuuucagggguuuuccaggaugucaagcgaaaucgggcgcgagaagucccaggauuggggaucugcugguuugggcggcguguuuaagguugaauggauccgaaaggagucgcucccauuucaguuugcccaccaccuguugaauccguggaaugauaauaagaaagugcagauuucacgggacggccaggagcuugagccucucguuggagagcagcugcuacaauugugggaaagacucccucugggugaaaagaauacuacagacuag

SEQ ID NO: 61576 - RNA, 1173 nt, Artificial Sequence
  Description of Artificial Sequence: Synthetic coding sequence
augcccccaagcggccugcgacuucugccucuccugcucccucuucuuuggcuguugguccugacaccuggcaggcccgcagcaggucugucuaccuguaaaacaaucgauauggagcucguuaaacggaagcgaauagaagcuauucgagggcagauauuaaguaagcugagauuagcuucgccucccucccagggcgaggucccccccgguccacugcccgaggccguacuagcacuguauaacaguacacgagauagaguugcuggugaguccgcagagcccgagccagaaccugaggccgauuacuacgcaaaagaaguaacgaggguccuuaugguagaaacacacaaugaaaucuaugacaaguuuaaacagucaacucauuccauauacauguucuuuaauacaagcgaguugcgugaggccguuccggaaccuguccuuuuaucccgagccgaguugcgccuucuccggcugaaguuaaaaguugaacaacauguggaauuauaccagaaauauagcaacaauuccuggagguaucuuagcaaucgccuguuagccccuagcgauagccccgaaugguugucuuuugacguuacuggcguggugcgccaguggcugagcagggggggagaaauugaaggguuuaggcugagcgcucacuguucgugcgacucucgagacaauacgcugcaaguggacaucaauggguuuacaacaggccgacgcggcgaccuggccaccauccauggaaugaaucguccauuucuuuugcugauggccaccccucuugaacgagcccagcacuuacagucaucgaggcaucguagggcuuuagacacgaauuacuguuucucuagcacugaaaaaaauuguugcgugagacagcuauauauugauuuucgaaaggaccugggauggaaguggauacaugaaccuaaggguuaccaugcuaacuucugccuggggcccugcccguauaucuggucucucgauacucaguauucuaaagugcuugcacucuauaaccaacacaauccuggcgcuucugcugcuccaugcugcgucccacaggccuuagaaccucuuccuaucguguauuacgugggccgaaagccuaagguagagcaguuaagcaauaugaucgugcgcuccuguaaaugcagcuag

SEQ ID NO: 61577 - RNA, 9156 nt, Artificial Sequence
  Description of Artificial Sequence: Synthetic coding sequence
auggcuacaaauccucagccucagccaccccccccagcaccuccuccaccgccuccacaaccacagccccaacccccuccccccccacccggaccaggcgcuggccccggugcaggcggagcaggaggcgcaggagccggcgccggugacccccagcuggucgcaaugauugugaaucacuugaaaagccagggccuguuugaccaguuccggagagacugucuggcggauguagacacaaagcccgcuuaccagaauuugcgccagagaguagauaauuucguggcgaaccaucuggcuacccacacaugguccccccaucucaacaaaaaccaacuacgcaacaacauuagacagcaagugcucaaauccgggauguuagagucuggaaucgaucgaauaaucagccagguuguugaccccaagauuaaucacaccuuuaggccacagguugagaaagcuguccaugaguuccucgccacauugaaccacaaggaagagggauccgggaacacagcuccagacgacgagaaaccugauaccagccuaaucacccaaggagugccuacacccggcccaagugcaaacgucgcuaaugacgcuaugagcauauuagagacaauuacuagucugaaccaggaagcuagcgcagccagagccagcacugaaacguccaacgccaagaccagcgaacgagcuagcaaaaaacuccccucucaaccaaccacagacacaucaacugacaaggaacguacauccgaagacauggccgacaaagaaaagagcaccgcagauucuggaggcgaagguuuggaaacagccccgaaaagugaagaauuuucagaccuacccugccccguugaggaaauaaaaaacuauacuaaggagcauaacaaccuuauuuugcucaauaaggacgugcagcaggaaucuucugaacaaaagaauaaaagcaccgacaagggcgaaaagaaaccagauagcaaugaaaaaggggagagaaagaaggagaagaaagagaagacagagaagaaguucgaucauaguaagaagagcgaggauacccagaaggugaaagacgagaagcaggcaaaagaaaaagaagucgaaucccugaaacugccaucagaaaaaaacaguaauaaggcaaagacaguggagggaacgaaggaagauuuuagccuaaucgacagcgacguggauggccugacagacaucacugugagcagcguacacacgucugaucugucaaguuuugaggaagauacagaggaagaaguugugacaagcgauagcauggaggaaggcgaaauaacgagcgacgacgaggagaaaaacaaacaaaauaaaacaaaaacucagacaagcgauagcuccgagggcaagacaaaaucagugagacacgccuacgugcauaaacccuaucucuacagcaaauacuacuccgauucugaugaugagcuuacaguugaacaaagaagacaaaguaucgcuaaggaaaaggaagaacgacugcuccggcgucagaucaauagagagaaguuagaagaaaagcguaaacagaaggcagaaaaaacaaagagcagcaagaccaagggccaagguaggucaucaguagacuuagaggagagcagcaccaagagcuuggagccuaaagccgcuagaaucaaagaagugcucaaagaacggaagguacuagagaaaaaagucgcgcugaguaaaaagaggaagaaggacucccgcaauguugaggagaauucaaaaaaaaagcagcaguaugaggaggacaguaaggaaacauuaaagacuagugaacacugugagaaagagaaaauaagcucuagcaaagaguuaaagcacgugcaugcaaagagugagcccucuaaaccggcccgaagacuaucagaaaguuuacacgucguggaugagaauaagaacgaaagcaagcuagaaagagaacauaaacgaagaacguccacacccguuauuauggagggcguccaagaagagacagacacuagagacgugaaacggcaaguggaaaggucagagaucuguacugaggaaccccagaagcaaaaaaguaccuugaagaaugagaaacaccugaagaaagacgacagugaaacgccccauuuaaagagccuauugaagaaagaggugaaguccagcaaagaaaaaccagaacgagagaaaacuccaagcgaggacaagcugucagugaaacacaaguacaagggcgacuguaugcauaaaaccggggacgagaccgaacugcauagcagugagaagggacucaagguugaagaaaacauccagaaacaaagccaacagacgaagcucucuagugacgacaagacugaaagaaaaucuaagcauagaaaugagcgcaaacucucagugcugggaaaagauggcaaaccagugagugaguauauuauaaagacagacgagaauguacgcaaggaaaauaacaagaaggaacggcggcugagcgcggagaaaaccaaggcagaacauaagucccgcagaucuagugauucuaaaauccagaaagauucccuaggcucuaaacagcacggcaucacuuugcagcgcagaagugaauccuauuccgaagauaaaugcgacauggacucuacaaacauggauuccaaucucaagccugaagaaguaguucauaaagagaagcggcgaaccaagagcuuauuggaagagaaguuaguacuuaaaucaaagucuaaaacccaagguaaacaggucaaaguggucgagacugagcuccaggagggggcaacaaaacaggcuaccaccccaaaaccugacaaggaaaaaaacacagaagaaaacgauucagagaaacaacgaaaaucgaaaguagaggacaagccauuugaggagaccggcgucgagccuguucuagaaacugcaucgucaucggcccauuccacgcagaaggauagcucacacagggcaaagcuaccauuggccaaagagaaguauaagagugauaaggauucuaccaguaccagauuggagagaaaguuaucugacggccauaaguccagaagucugaaacacuccagcaaagauauuaaaaagaaggacgaaaacaaaagugaugauaaagauggcaaagagguggacaguucccaugaaaaagcacgaggaaacagcucccugauggaaaaaaagcugagucggagacucugugaaaauagacggggaagucucucacaggagauggccaagggagaggagaagcuggcagccaauacgcuaucuacgccuagcgggaguagccuucaaagacccaagaaaagcggcgacaugacucuaaucccugaacaggagcccauggaaaucgauagugaacccggaguugagaauguguucgaagugucuaaaacacaggacaaccgcaacaauaacucacagcaagauauugauagcgaaaacaugaaacagaagaccuccgccacagugcagaaagaugagcugaggaccugcacagcagacucuaaggcuaccgcuccagcauacaagcccggcagaggcaccggcgugaauaguaauagcgagaaacacgccgaucacaggucgacucuuaccaaaaagaugcauauccaaagugcaguguccaaaaugaacccuggggaaaaggagcccauacaucgagguacuaccgaggucaauauugauagcgagacagugcacagaauguuacucagcgccccuucagagaacgaccgagugcaaaagaaccugaaaaacacugcagcagaagagcauguggcccagggagaugccacgcucgagcacucaacaaaccuugacucuucaccauccuugagcuccguaacuguugucccauugcgagagagcuacgacccugacguuaucccacuuuuugacaaacgaacagucuuagaaggcagcaccgcuucaacgagucccgcagaccacagugcccugccgaaucagucccucacagugcgcgaauccgagguccucaaaacaucagauagcaaggaaggcggggaaggcuucacaguagacaccccggcuaaggcgucuaucacuucuaaacgacacauaccagaagcacaccaagcuacuuugcuugacggcaaacaggggaagguuauaaugccgcuugguaguaagcucacaggggugauuguugagaaugagaauauuaccaaagaaggcggacuuguugacauggcuaagaaagagaacgaucugaaugcagaaccgaaccugaaacaaacgauuaaggccaccguagaaaauggaaagaaggauggaaucgcaguugaucacgucgugggguugaauaccgaaaaauaugcagaaaccgugaaguugaaacacaaaagaagcccaggaaagguaaaagauauuaguaucgacguggaacgccggaacgagaacucugaagucgauaccagugccggcagcgggucagcaccuagcgugcugcaccaaagaaaugggcagacagaagauguagccacagggccacggagggcugaaaagaccagcgucgcgacgaguacagaggggaaggacaaggacgugacacuguccccagucaaggcagggccggccacgacaacgucuucagaaaccagacagagcgagguugcacucccauguaccucaaucgaggcggaugaggggcuuaucauuggaacacacucucguaacaauccucuccacgucggagccgaagcaucagaaugcacgguguucgccgcagcagaagagggaggagccguugucacagagggauucgcagaaagugaaacguuucucacauccacgaaggaaggggaaucgggggaaugugcaguggcugaaucagaagauagagcugccgaucugcuagcaguacacgcaguaaaaauugaggcaaaugugaauaguguggugacugaggagaaggaugacgcugucacaagcgcgggcagugaggagaagugcgaugguucguuauccagagauucggaaauuguggagggaacuauuaccuuuaucagcgaaguagagagcgauggggcggucacuucagcuggcacagagaucagagcuggcagcaucaguucugaggaaguggauggcagucagggaaauaugaugcggaugggacccaagaaagaaaccgaggggaccguuacauguacaggcgcggaggggagaagugacaauuuuguaaucuguaguguaaccggagccggaccacgcgaggagcggauggugaccggggccggaguggugcugggggauaacgacgcgccuccaggcacaagcgcuagccaggagggggacggaucuguuaaugacggcaccgagggcgaaucugcaguuacaucgacggggaucacugaagacggcgagggaccagcuuccuguaccggcagcgaggacucuuccgaaggauuugcaauuagcuccgagucagaggaaaauggggaaagcgcuauggacucaaccgucgccaaggaggggacuaaugugccuuugguagccgccggaccgugcgacgacgaagguaucgugacuucaacgggagcaaaagaagaggaugaagaaggcgaggacguggugacgagcacaggacggggcaaugaaauuggucacgcaagcaccugcaccggacugggugaagaaagcgaagggguucucaucugugagucggcagagggcgacagccagaucgguacuguuguugaacauguugaggcagaagcaggcgcggcaauuaugaacgcaaaugagaauaaugucgacaguauguccggaacugaaaaggguaguaaagacaccgauauuugcucuucugccaagggcauaguggaauccaguguaacaagugcaguauccgggaaggacgaaguuacaccagucccuggugguugugaaggaccgaugacaucugcugcuagcgaccaaagcgauucucagcucgaaaagguugaagacacuacaauuaguacaggucuggugggcggcaguuacgacguccugguguccggcgagguacccgagugcgagguagcacacacaucaccaucggagaaagaggacgaagauauuauuaccagcguggaaaaugaggagugugacggucugauggcuacuacugcauccggagacauuacgaaucagaauuccuuagccgggggcaaaaaccagggaaagguucuuauaaucuccaccagcacuacaaacgauuacacaccccaggugagugcaaucacggacgucgagggaggacugagcgaugcguuacgcacagaagaaaauauggaagguacuagggugacuacugaggaauuugaggcccccaugcccucagcagugucaggcgaugacagucaacugacugcuucucgguccgaagagaaagacgaaugugcgaugauuuccaccuccaucggugaagaguuugagcugccuaucuccucugcaacaaccaucaagugugcugagucccuccaacccguagccgccgccguugaagagagagccacaggucccguccugauuucaaccgcugacuuugaggggccaaugccgucagccccccccgaggcugaaucaccccuugcuucaaccagcaaagaggagaaagacgaaugugccuugaucaguaccucaauagccgaagaaugugaagcauccguaagcgggguuguaguggagucugagaaugagcgcgcggggaccgugauggaagaaaaagacggaucuggcauuauuaguaccuccuccguugaagacugugaaggcccaguguccucagccgugccucaagaagaaggggauccaagcgugacccccgccgaagaaaugggcgauacugcaaugaucuccacaaguaccagugagggcugcgaggcagugaugaucggcgccgugcuucaggacgaagaccgguugacuauaacccggguagaggaccuaucugaugccgcaauaauuuccacaucaacggccgaaugcaugccgauuuccgcuuccauugaccgccacgaggaaaaccaauugaccgcagacaauccagagggaaauggggacuuaagcgcaaccgaggugagcaaacacaaaguaccaaugccuucauuaauugccgaaaacaauugcagauguccagguccugugagaggcggcaaggaaccaggcccagugcuggccguuucaacagaagaaggccacaauggccccucugugcacaagccuucagccggccaaggacaccccagcgcuguuugcgccgagaaggaagaaaagcacggaaaagaaugcccugaaauuggcccguucgcuggucgaggacaaaaagaaucaacucugcaucugauaaacgccgaagaaaaaaacgugcuucugaacaguuugcaaaaggaagauaaaagcccagagaccggaacugcuggagggucuagcacugcgucauacagcgccggcagaggccuugaggggaacgccaauucccccgcccaccuacgcgguccagagcagacuucuggccagacugcuaaagauccguccgugaguauaagguaccuagcugccgugaacacaggagcuauaaaggcugaugauaugccacccguucaaggaacaguggccgagcacagcuuucugccagccgaacagcagggcagcgaagauaauuugaagacaagcacuacuaaauguaucacuggccaagaaagcaaaaucgccccaucucacacaaugauuccaccagcuaccuauuccguggcccugcuggcccccaaaugcgaacaggaucugacaauaaagaacgacuauucaggcaaauggaccgaucaagcuucagcugagaaaacuggagacgacaauuccacuagaaaaaguuucccagaagaaggggauauaauggugaccgugaguagcgaggaaaaugucugugacauuggcaacgaagagucuccccuuaauguccucggaggauugaaauuaaaggccaaucugaaaauggaagcauauguacccucugaagaggagaagaauggcgagaucuuagcccccccagagucuuugugcggcgguaagccuuccggcaucgcagaacuacagagagagccucuucuugugaaugagucauugaauguugagaacuccggauuccguacaaacgaagagauucauagcgaaucuuacaauaaaggagagauuucgaguggaaggaaagacaaugcugaggcuauaucaggccacuccguugaagcugauccaaaagagguggaagaagaggaacgccacaugccaaaaagaaaaagaaaacaacacuaccuuucgagugaagacgaaccagaugauaaucccgacguccuggacuccagaauugagacagcucagaggcagugcccugagaccgagccucacgauaccaaagaggaaaacaguagagaccuggaggaacugccuaagacaaguagcgaaacaaacucaaccacgagcagagugauggaagagaaagaugaguauaguaguagugaaaccacuggugagaagccugaacagaaugacgacgacacuaucaagagccaggaggaagaucagccuauuauuaucaaacgaaaaaggggccgacccaggaaguacccaguggagacuacacugaagaugaaggacgacucuaagacagauaccgggauaguaacgguugaacagagcccgaguagcaguaagcugaaggucaugcagacagacgagaguaauaaggagacagcaaauuugcaggaacggucaaucaguaaugacgacggcgaagagaaaauuguaacgagcgugagacggagaggccggaaacccaaacgcucgcucacaguguccgacgaugcagagucuagugagcccgaaagaaagcgacagaaaagcguaagugaccccgucgaggauaaaaaggaacaggaaagcgacgaagaggaggaagaagaggaagaggaugagcccuccggugcuacaacaaggucuacuacacguagcgaggcucagagauccaaaacacagcucucaccuuccaucaagcgaaaacgcgagguuagcccacccggagcuagaacaaggggccagcagcgagucgaggaggcgccggugaagaaggcaaagagauag

SEQ ID NO: 61578 - RNA, 624 nt, Artificial Sequence
  Description of Artificial Sequence: Synthetic coding sequence
auggacgaugacuuaaugcucgcucugcgguugcaagaggaguggaaccuacaagaggcagaacgggaucaugcucaagaaagucugagccuaguggacgcuucgugggaacucguggacccgacaccagaucuacaggcucuauuugugcaguucaacgaucaguucuuuugggggcaguuggaagcaguggaggugaaguggagugugcgcaugacauuaugcgccggaaucuguucuuaugaggggaaaggcgguaugugcucaauuagauugucagagccgcuucuuaagcuaagaccucggaaggaccucguagagguuuaccauacauuucacgaugagguagacgaauacagaagacacugguggcgcugcaauggcccuugucagcacagaccaccuuauuauggcuacguuaagagagcuacaaaucgcgaaccuagugcucacgauuauuggugggccgagcaucaaaagacaugugguggcacguauauaaaaauuaaagaaccugaaaacuauucaaaaaaaggcaagggcaaagcaaaguuagggaaggaaccuguauuggcggccgaaaauaagggcacuuucgucuauauccuucugaucuuuauguag

SEQ ID NO: 61579 - RNA, 864 nt, Artificial Sequence
  Description of Artificial Sequence: Synthetic coding sequence
augaaugcacuggccaauauuccugacguccccgugaaauaccgcaagaacgacauuccugggccugguuuuuacaacgucauccaccaaucccccgugucuaauucagucucuuuaagcaaaaaggggacauguauguuucccagcaugugcgcacggcucgauacaaucauaucuaaauaccccgccgccaacgcuuacacuauaccuuccgacuuuauuucuaagagagacuucuccaacuccuguuccuccauguuccagcugcccucauuuaugaaagcccugaaauucgagacacccgccccuaauuauuauaaugcuucuguguccuguuguaagcagcgaaacaacguauguacuagagccgguuuuaugagcaagacgcaaaggggcucauucgcuuucgccgacaagggaccgccucccggccauuacgacaucaacgaaagccucgucaagcagaguccuaauacccuaaugucauguuuuaagaguaaaacaaaccgcgggcugaaacugacuuccacggguccaggacccggcuacuacaaccccuccgauuguaccaaaguccccaaaaaaacccuguuuccaaaaaacccuauccuaaauuuuucugcucagcccucacccuuacccccgaaaccccccuucccuggacccggccaguacgagaucgucgauuaccucgggcccagaaagcauuucauuucaucugcaucauuugucaguaauacuuccagauggaccgcugcaccuccacagcccggacuccccggucccgcaacguauaaaccugaacucccuggcaaacagucguuucuguacaacgaagacaaaaaguggaucccuguauuauag

SEQ ID NO: 61580 - RNA, 939 nt, Artificial Sequence
  Description of Artificial Sequence: Synthetic coding sequence
augggccgucgacgugcugcccggggaccuggugcugagggcgggcguccacgucauuugcccacccguucacucgaggccuuugccgaggaagugggugcugcauugcaggcgagcguggaaccaggagcagccgacggcgagggaggaccaggaccagcagcguugccuuguacgcuggcuaugugggaacuaggccauugugacccacggcgcugcacgggacggaaacuggcacgacuaggccucguacgcugccugagacuuggacauagauucggugggcuugugcucucccccguuggcaagcaguaugcgucuccagcugacagacagcucguggcccagagcggaguggcaguaaucgauugcucuugggcaagauuggacgagaccccuuucggcaaaaugagaggcucccaccucagguugcuuccuuaccuuguugcugcaaaucccguuaauuacgggcgccccuauagacucagcuguguugaggcuuucgccgcuacauuuugcaucguugguuuucccgaccucgcugucauacuucuuagaaaauuuaaguggggaaagggcuuuuuggaccugaaccgccaguuauuagauaaguacgcagcgugugguuccccugaggagguuuugcaggccgagcaggaauuucuggcaaacgcuaaggaaagcccucaggaagaggagaucgacccuuuugacguugauucuggucgugaguuugggaaccccaaccgaccaguggcuucuacgcgccuccccuccgauacagacgauucggaugcuagugaggacccugguccuggugcugagagagguggcgcaaguagcucauguugugaggaagaacagacccaaggacgcggagcagaggcaagggccccggccgaaguauggaaggggauuaaaaagaggcagcgcgauuag

SEQ ID NO: 61581 - RNA, 1023 nt, Artificial Sequence
  Description of Artificial Sequence: Synthetic coding sequence
augaaguauggcaauccaaacuaugggggaaugaagggcauucugagcaacuccuggaaaagacgauaucacucuaggaggauccaaagagauguaaucaagaagcgagcuuugauuggcgaugaugugggacugacaucauacaagcaccgccauucuggauuaguuaacgugccagaagagccuauugaggaggaggaggaagaagaggaggaagaagaggaagaagaggaagaggaccaggauauggacgcugacgauagagucguaguugaauaucaugaagagcugcccgccuuaaaacagccccgcgagaggagcgccucccgaagaucuagugcaucaagcucugauucugacgagauggauuacgauuuggagcugaagaugauuucaacccccucccccaagaagagcaugaagaugacaauguacgccgacgaaguggagagucaauuaaaaaacauacgaaacaguaugcgugccgauagugugucaaguucuaacauuaagaaccguaucgguaauaaacuucccccugagaaauucgccgacgugagacauuugcuugaugagaaacgccaacacuccagaccuagaccuccggucucaucaacuaagagcgacauccgucaacgccucggcaagcggccucauucccccgaaaaggcuuucaguuccaacccaguagucagacgcgaaccuuccucagauguccacaguaggcuuggugugccccgccaagacucuaaaggucucuacgcugauacccgcgaaaaaaagucagguaaucuguggacacgucuagggucggcaccaaaaacuaaagagaaaaacacaaaaaaaguugaccacagggcucccggcgcagaagaggacgacucagagcugcagcgggcauggggugcccugaucaaggagaaagagcaauccagacaaaagaaaucacgacuagacaacuuaccaucccugcagauugaaguuucacgagaguccuccucaggcucugaagcggaaucuuag

SEQ ID NO: 61582 - RNA, 921 nt, Artificial Sequence
  Description of Artificial Sequence: Synthetic coding sequence
augggcugcgauggcggaacaaucccgaaacggcaugagcuagugaagggaccaaaaaagguggagaagguagauaaagacgcugagcuaguggcacaauggaauuacuguacccugucucaagaaauucuccgaagaccaauuguugcaugcgaguuagguagguuguauaacaaggacgcugucauugaauuccuuuuagauaaaucugccgagaaagcccuugggaaagcggccagucacauuaaaagcauaaaaaacguaaccgaacucaaacugagugacaauccagcaugggagggggauaagggaaauacaaaaggcgauaaacacgaugaucuccaaagggcaagguucauuuguccaguagucgggcucgagaugaauggacgccauagauuuuguuuuuuaaggugcugcgguugcguguuuagugagcgggcucucaaggaaauuaaagcggaagucugccauacuuguggagcagcguuucaggaggacgaugugaucaugcucaauggcacaaaagaagaugucgacguacucaagacgaggauggaagaaaggaggcugcgggcgaaauuagagaagaagaccaagaagcccaaagcugcugaaucgguaucaaaaccugacguguccgaagaagcaccuggccccucuaagguaaagacuggcaaaccagaagaagcaucacuggacagcagggagaaaaagacaaacuuggcuccuaagaguacagcuaugaacgagagcucgucaggcaaagccgguaagccccccugcggugcaacaaagcguagcauugccgauuccgaagaaucugaagccuacaaaagucuuuucacgacacacucaagugccaaacggaguaaagaagagucugcccacugggucacccacaccucauacugcuucuag

SEQ ID NO: 61583 - RNA, 627 nt, Artificial Sequence
  Description of Artificial Sequence: Synthetic coding sequence
augcaaagaccugaguggccacgaccacacccaggugagggagccgcagcugcagggagagggccagcaccacccgcucgagcuggcgagcccaguggcuuacgguuacaagaaccaucccuuuacacgauuaaagcaguguuuauacuggauaaugaugggagacgccuguuagccaaguauuacgaugacacauuccccagcaugaaagagcagauggucuucgagaagaacguguuuaacaagacuucacgaaccgaaucagaaaucgccuucuuugggggcaugacaauuguguacaagaauaguaucgaucucuuucuuuacgucgugggcucuuccuacgagaacgaguuaauguuaauguccguucugacuugccuuuucgaaucuuuaaaucauauguugagaaaaaacgucgaaaaaagauggcugcucgagaauauggacggcgcuuuucugguguuggacgaaauuguggacggcggggugauucuagaaagugauccgcaacaggugauccagaaggucaauuuucgugccgaugauggagggcugacugaacaguccguugcucagguguugcagagcgcuaaagagcaaauuaaguggagucuuuuaaaauag

SEQ ID NO: 61584 - RNA, 486 nt, Artificial Sequence
  Description of Artificial Sequence: Synthetic coding sequence
augcccaagaaugcuaucccagucagcaaguccacaggcuucucgaaucccgcaagucagaguacaucucagcggcccaaauuaaaaagggugaugaaggaaaagacaaaaccucagggaggagaaggcaaaggggcucaaaguacuccaauucagcauagcuuucugaccgauguuuccgacguacaggagauggagaggggacuucugucuuuguuaaacgacuuucacaguggcaaguuacaagcuuuuggcaacgaguguaguauagagcaaauggaacaugugcgcggcaugcaggagaaguuggcuaggcugaaccucgaacuguauggcgaacucgaagaacuuccugaagacaagagaaagacagcuuccgauucuaaucuggaccgccuauugucagaucuugaggagcuuaacucaucgauucaaaagcugcaccuggcugacgcccaggaugugcccaauacuuccgcuaguuag

SEQ ID NO: 61585 - RNA, 2748 nt, Artificial Sequence
  Description of Artificial Sequence: Synthetic coding sequence
augaggaaaaguucuucucccucuuugagcaauuguaacucggugcuggcuaacaaaauauuuggcaucccucuggacgagcugcagcaaggcggucaccccgacaacgaaguuccuuucaucgugcggcauguuguggauuacauugaggagcacggcggacuagaacagcagggacuuuuucagguuaacggaaacgcagagacaguggaauggcuccggcagcgcuaugacuccggagaagagguagaucuugugaaagaggccgacgugccaagcgcaaucucauuacuacgguuuuuuuugcaggaauugcccgaaccagugauuccugggucucugcacauacaccugaugcaacuuucacaagauuauaacaaugaggacgaauucggaaggaaacugcgcuucuugcugcagcagcucccccccgucaacuauucccuucuuaaauuccuguguagauuccucgcuaacguggcaucacaccaugaggagauuugguccgccaauagucuggcagccgucuuugggcccgauguguuucauauauacacugacgucgaagauaugaaagaacaggagauuguuucucgcaucauggccggucuucucgaaaauuacuaugaauuuuucgaaaacgaagaagaggauuucucuagcaaugaucucucauccaucaccgaacaagucaaugaacugagugaggaagaagaggaagaugaaaagcuggaacacauagaggaacugcccgaggaaggggcugaaaaauccaaugauaugccagaaguaguccaacugcggaugacggagaauauccuugaaaguaauaguguuaccgcaaccucaacgcauaucucgcccauaucaauacugcccgcuucuaccgauauccuagagaggaccauucgugccgcaguggaacaacaccuuuucgacuuacagaguagcauugaccacgaccuaaaaaaucugcagcaacagagcguuguaugcaacaacgaagccgagucuauccauugcgauggggaggggucuaacaaccaaauagacauagcugacgauauuaucaacgcgagugaaagcaaccgggauuguuccaagccaguagcaagcacgaaccuggacaaugaggcuaugcagcaggacuguguuuuugagaaugaagagaacacacagagcguuggaauucuucucgagccauguagcgacaggggcgacuccgaggacggcugcuuggaacgggaggaguauuuacuuuuugauuccgauaaauugagccacuugauccucgacagcucuucuaaaauaugcgaccuaaaugcuaauacugagucagagguuccuggcggucaaucagucggcgugcagggcgaagccgcaugugugucaaucccucaccuggauuugaagaaugugagcgauggugauaagugggaggagccauuccccgcuuuuaagaguuggcaggaagauagugagagcggcgaagcacagcugaguccucaagccggaagaaugaaccaucauccacucgaagaagauugccccccuguccugucgcacagaucucuggacuucggccaaucccaacgauuucuccacgaccccgaaaaacuggacagcucuucuaaggcuuuaagcuuuacccggauucggcguucuagcuuuucaucaaaggacgaaaagagggaggacagaaccccguaccaguuagugaaaaagcugcagaagaaaaucagacaauuugaggaacaguucgaacgugaaagaaacagcaaaccaucuuacucugacaucgccgccaauccaaaaguccugaaguggaugacugaacugacaaaguuaaggaagcagaucaaggaugcuaaacauaaaaacucggauggagaguuuguuccgcaaaccagaccacgcucaaauacacugccuaaguccuuugguagcucccuugaucacgaggacgaggagaaugaggacgagcccaaagucauccagaaagaaaaaaaaccaucuaaagaagccacauuggaacugauccugaagcgccucaaagaaaagagaaucgaacgaugccugcccgaagacaucaagaaaaugaccaaagaucacuuggucgaagaaaaggcaagucuccagaaaucacugcuuuacuaugagagccaacaugggagaccggugacuaaagaagaacggcacauugugaaaccacuguacgaccgcuacagacucguaaagcagaugcucacccgcgcaucuauaacuccgguguuggguuccccuuccacgaaaagaagagggcagauguuacagcccauuauugaaggcgagacagcucauuuuuucgaagagauuaaggaagaggaggaggauggggucaaccuuagcagcgaacucggagauaugcucaagaccgcgguucaggugcaguccagucucgaaaacuccgaauccgacguggaagagaaucaagagaaguuggcauuagaccugcgccuaucaaguucuagagccgccucuaugccugaguuacucgaacaguuauggaaagcucgagcugaaaagaagaagcuccgaaaaacacugcgggaguucgaagaggcauuuuaccagcaaaaugguagaaacgcacagaaggaagacaggguuccagucuuggaagaguaucgugaauauaaaaagauuaaggcaaaacugaggcuacucgaaguguuaaucucuaagcaagacuccuccaaguccauauag

SEQ ID NO: 61586 - RNA, 735 nt, Artificial Sequence
  Description of Artificial Sequence: Synthetic coding sequence
augaacccuguuuacucuccaguccagccaggcgccccauauggcaacccaaagaauauggcauacacaggauauccuacagccuacccagcggcagcaccggcguacaaucccucucucuauccaacaaauagcccuucuuacgccccagaguuccaguuccuccauucugccuaugcaacccucuuaaugaagcaggcauggccccaaaacucauccuccugcggaacggaggguaccuuucacuuaccaguggacaccggcacggaaaauagaacauaccaggcuucaucggcagcguuucguuacacugccgggacacccuauaaaguuccccccacacaaagcaacacagcaccuccaccguauucuccuucccccaacccuuaccagaccgccauguacccgauacggucagcuuacccccaacagaaucuguacgcucaaggggcauacuacacacagccagucuacgccgcgcaaccgcauguaauucaccacacgaccguuguccagccgaauuccauuccauccgccaucuaucccgcuccugucgccgcacccagaaccaacggaguugccaugggaaugguggcagggacgacaauggccaugucagccggaacucuccucacuacaccgcagcauaccgccaucggagcgcaucccguaucaaugccuaccuacagagcccaagggacacccgcauauucauacguaccuccgcauugguag

SEQ ID NO: 61587 - RNA, 2841 nt, Artificial Sequence
  Description of Artificial Sequence: Synthetic coding sequence
augaguguaagacuaagauucuuaucuccgggugauacuggagccgugggugucgugggccgcagcgccucuuucgcuggcuuuucuucagcgcaaagucggagaauugcaaagagcauuaaucgaaauucagugagaucccggaugccugccaaauccagcaaaauguacggcacccugaggaaaggcuccguuugcgcugauccuaagccccaacaaguuaaaaagauauucgaggcccugaaaagaggucugaaagaguauuugugugugcagcaggcagaauuggaccaucuaucaggacggcacaaagacacucguagaaauucaagacuagcauuuuacuacgaucuggauaaacaaacacguugcgucgagcggcauaucaggaaaauggaauuucauaucucaaaagucgacgagcuauacgaagauuacugcauucagugucggcugcgagacggcgcauccucgaugcagagagccuuugcucgguguccgccaucccgcgcagcaagggagucacugcaggaacugggaaggucuuuacaugagugugcugaagacauguggcugauugaaggcgcauuggaaguccauuuaggcgaguuucacauuagaaugaaaggacucguuggguaugcccgcuuguguccuggggaccauuacgaagugcuuaugcgguugggacggcagagguggaagcuuaaggggaggaucgaauccgaugacucacagacuugggacgaggaggagaaggcauuuauucccacauugcaugaaaaccuggauauuaaaguuacagaacuuagaggccugggaaguuuggccgucggcgcugucacaugcgacauagcagauuucuucacaacuagaccucaggugauagugguggauauuacagagcucggaacaauuaaacugcagcuggaggugcaauggaacccuuuugacacagagagcuuucucgugagcccaucccccacuggcaaguuuucuaugggaaguagaaaaggcaguuuauacaacuggacccccccaucuacaccgaguuucagagagcgguacuauuuaucuguccuccaacagccuacucagcaggcgcuauugcucgggggcccaagagcaacaagcauuuuaucauacuuguccgacagcgaucuccgggggccuucucuaagaucccagucucaggaauugcccgagauggauuccuucuccucugaggacccacgagauacugaaacuuccacaagcgcuuccacaucagauguaggguuucuuccccucaccuucggaccucacgcuuccauugaagaagaggccagggaagauccauuaccgcccggccuacugccugaaauggcacacuugucuggcgggccguucgcugaacaaccuggauggcguaaucuuggaggcgagaguccaagccugccucagggcucacucuuucacucugguacugcuucuucuucucagaauggucaugaggaaggugccacuggggaucgggaggacgguccuggaguagcacuugagggcccucugcaggaagugcucgaacuccuuaggcccaccgacaguacacagccccaguugcgagaauuagaauaccaaguuuuaggguucagagauagauuaaagccauguagagcuagacaagaacacacgagugcagaaucccugauggagugcauacuagaguccuuugcauuucuaaaugccgauuucgccuuagaugaacuguccuuguucgggggcucacaggggcuccguaaagaucgaccccugccacccccuagcucacugaaggcuucaagccgggaacugacugcuggcgcuccagagcuggauguucuuuugauggugcaucuccaaguuugcaaagcacuccuucaaaaacuggccagcccaaaucucucacggcuuguccaagaaugcuugcuggaagaggucgcacaacaaaagcacguguuagaaacauugucaguucuugacuuugaaaaggugggcaaggcaacaucgauugaagagaucauaccccaggcuagcaggaccaaaggaugccuuaaauuguggcgcggaugcacagggccugggaggguccugagcuguccagccaccacccuguuaaaccagcugaaaaagacguuccagcaccgcgugagagggaaguauccagggcaacuagaaaucgccugccgcagacuccucgaacaggucguaaguugcgggggccugcugcccggggccggacuuccugaagagcaaauuauuacgugguuccaauuucauucauacuuacagcgacagagcgugucagaccucgaaaagcacuuuacccagcugacaaaagaggugacacucauagaagaacugcacugugccggccaagccaaagugguucggaaguuacagggcaagcggcugggacagcuccaaccucucccacagacucugcgggccugggcccuacuccaacuugacgggacaccacgaguuugccgagcagcaucagccagacucgcaggcgcagugagaaaccggaguuuccgcgagaaagcacugcuguucuauacuaacgcccucgcugagaacgacgcgagacuacagcaggccgcaugccuggcauuaaagcacuuaaaaggcauugaaagcaucgaucaaacagccagccugugucagagcgaccuggaagcugugcgcgccgcugccagagagaccacauuaagcuucggcgaaaaggguaggcuugccuucgaaaagauggauaagcuguguucggaacaaagagaaguguuuugccaggaggcugacgucgaaaucaccauuuucuag

SEQ ID NO: 61588 - RNA, 1026 nt, Artificial Sequence
  Description of Artificial Sequence: Synthetic coding sequence
auggccgccuuauacgcaugcacaaaaugucaccagcgcuucccauuugaagcuuugucucagggacagcagcuguguaaggaauguagaaucgcucacccggugguaaaguguaccuauuguagaacugaauaucagcaggagcgccuugaguguaauggcacaaucagcgcccacuguaaucuucaccucccaggcucuagugacaguccagccucuucaagccgaguugccggcaucaccggcauuaaaacgaacacuaucuguaagaaaugugcucaaaacguucaguuguacgguacuccgaagccgugucaauacugcaacauuauagccgcauuuaucggcaauaagugucaaagaugcacuaacuccgaaaaaaaguacggcccccccuacucaugugaacagugcaaacagcaaugcgccuuugaucgcaaggaugaccgaaagaaagucgacggaaagcuccucugcuggcugugcacguuaaguuacaaaaggguacuucaaaaaacuaaagaacaaagaaaacacuugagcucaaguagucgggcaggucaccaggaaaaagaacaguauucaaggcucucuggcgguggucauuauaacagccagaaaacacuguccacaucuagcauacagaacgaaauucccaaaaagaaauccaaguucgagucaauuacaacgaacggcgauucauuuagcccagaccuugcacuugauuccccaggcaccgaucacuuugugauaauagcacaacugaaagaggagguggcuacucuuaagaagauguuacaccagaaggaucaaaugaucuuagagaaggaaaagaaaauuacugaguugaaggccgauuuucaauaucaggaaucgcaaaugagagccaagaugaaucagauggagaagacucacaaagaggucacagaacagcugcaggccaaaaaccgugagcuauugaaacaggccgccgcuuugagcaaaucuaagaagucagaaaaaucaggggcuauuacaucacccuag

SEQ ID NO: 61589 - RNA, 975 nt, Artificial Sequence
  Description of Artificial Sequence: Synthetic coding sequence
auggcaucugaggcucuacaucagguuggagauggcgaagaagcuguucugaaaaaagaaaauuucaauaugaugaacgcucucgaccagcuuccaaagcccuuuucaaaccccaaaucuaugaaccgaaccgugacaacuaagggcuuaccccuggccagcaaaggaaaucugguuaauuuccucgaagaugauacaauuaaucuccuuaagccccuucccguagaagauagcgacuguucuagugaugagacaagcaucucugcauucucuagcacgcugcucaacccgaucaaauuggcaguaacccaacccaacagcaguuuuuucgcaggaaugcucgaaggcgaauugaauaaguugucguuuagccccauggcaaagaaugcugaaaacgaagacuuggcacuaggaccuugcccaugccccucaaagucccagauggcgacaaggggccuuuuggauuuggacaauccugagcuggagacggaaaccucauccacgcauagcgagagcuccgucguggucgaccucccagacaccccuuucaucuuugaacacacaguaaauaauucaacagcagugauuucuuggaccuaugcccucgggaagcagcccguauccuuuuaucaauuacuauuacaagaaguagccaaaacucaggagaaugagcuaccugaggcaaagaauaggcccuggauauucaacaaaauccucggaacaaccgugaaacuaauggaacucaaacccaacaccuguuauugccuguccguucgggccgcaaauaccgcaggcguagguaagugguguaagcccuauaaauuugccacguuagccacagacuuuagcuccuuccccgagaauuacccuauccaaaucacagugcgacguaaagagccccgccaaaaaauugugucaaucggcccugaagaaaugcgaagacuagaggaccucgaguaucuguucccauguuag

SEQ ID NO: 61590 - RNA, 3948 nt, Artificial Sequence
  Description of Artificial Sequence: Synthetic coding sequence
augaacuuucugaguaccgcugagagucggaccgcccaagccgccgccagugggacaacacugcuaccccaguuccgagcaccuuccuggcagaccggcaugcauuccuccgccgcuacagaacuauucgcaacagguccuuugccaucaacugggacauugcccccaucccucagcgccuaccagcaccccaccacauucucuaauagaaacuuugccaccaccucuccacuagugcugcaggauucuacuuucaacaccaccucaaauggcauucuuagucaccaugauccauuacuucagaucaaaacaucacaggguacagucccuacugcucucgcauucgaaaggcuggguucuagcguucuauccaauucaauacccccccagucuucaaccuaccgauccgcacaagagagugcaccccauuuacuccagccucaauucagccuguuaccaucagcucuaggaggaucccaacagacaccacaggcauacagcucuacacuguucaccuccagcacggccagcaucgagagagcacuucuccgcgaaugcuccgucauuaaacaucaccaaaggcccucgggcacccagagcauacaggcccagcuuacaggcucucagcacucucugcacagcuaccuuagcaauucuucuguagugaauuuucaggaaacaacucgccaguccagcuuaagcugcucccccauuggagacucuacucagaaucugccagacucuagcccgacccaaaauuacauauccaugcacucaucacaaaacguccaaacgcaggaauccucuucaccucaaucgcagaaguuucugccagcaguccaaucgucgucuuucgcaucuagcacgcauugccagacuuuacagaauaauaucacuucucccgauccaaagucauaugcagagcguaaauuagauagcgauguguacccaaguucaaagcaggaagauggguuuccuaugcaagaguuacagguguuacaaccacaggccagucuggagucgaguacgcagcgccugucggacggcgaaauuaaugcgcaggagaguaccuacaaagugucaaaagccgaugaccgcuauucccaaagcgugaucagauccaauagcaggcuggaggaccaggugauuggaguggcccuucaagccucaaaaaaagaggagucaguugugggcagcguuacgcaguuaaaccagcaaauuggacaggugaauaaugccgcuacucuggaccucaagaauucuacuaaccugauacaaaccccgcagauccgauuaaacacuaaggaccugaaacagcaacacccacucauucucaagguacacgaaucuaaagugcaagagcaacacgaucagaucaucaaugccuccagucagauccagauuccuaaucaugccuuaggccauggucaucaagccagccucccaaauacccaaguucuucucgauagcgcgugugaucuccagauucuacaacagagcauccuccaggcaggccucggccaagugaaagccagucugcaagcucagaggguucagucaccacagcagaucguacauccauuucuccagauggaagggcacgugauccaguccaacggcgaccauagccagcaacagcuccauccucagaacagugagguuaugaaaauggaucuuagugaauccagcaagccauugcagcaacaccucacgaccaagggccauuuuuccgaaacuaaccagcaugacaguaaaaaccaguucgugucacuggguucuaugugcuuucccgaagcgguucugcuaucugaugaacggaacauccucagcaacguggaugauauccuagcagccacagccgccgccugcggagucacaccuaccgacuuuuccaaaagcacuagcaaugagaccaugcaagcaguugaagauggcgacucaaaaucccauuuucagcaaagccuugacgugcgacaugucaccagcgacuucaauaguaugaccgcaacuguagguaagccccagaauaucaacgauacuagccuaaacggaaaucaagugaccgugaaccugucucccguuccugcgcuccagucaaaaaugaccuuagaccagcaacauauagaaaccccaggucagaauauuccuaccaagguuacaucugcaguggugggaccaucgcacgagguacaggagcaguccaguggucccuuuaagaaacaaucagcuacaaaucucgaaucagaagaggauuccgaagcaccaguugacagcacacugaacaacaauagaaaucaagaguuugugucuucaagcagaucaaucucaggcgaaaaugcaaccucugagucagaauucacucugggcggcgacgacaguggagucuccaugaacccagcaaggucugcauuggcccuucuagcaauggcccagaguggugaugcagugucuguuaaaaucgaagaggaaaaucaggacuuaaugcacuuuaauuuacagaaaaagcgggcaaaagguaaaggacaggugaaggaggaggauaauucuaaccagaaacagcugaagagacccgcucagggaaaacgccaaaauccucgggggacugacauuuaucuaccguauacacccccaagcagugaguccugccacgacgguuaucagcaccaagaaaagaugagacaaaagaucaaggagguggaggagaagcaaccagaggucaagacugguuuuaucgccuccuuucuagauuuucugaaaagcggucccaaacagcaguuuucuacacucgccgugcgaaugccuaacagaacgaggagaccuggaacacagaugguccgaacauucugucccccaccacuaccuaagccuuccaguaccacuccgacaccucuugugagcgagaccgggggcaauagcccuagugacaagguugacaaugaguuaaagaaucuggagcaccuuagcucuuuuagcagcgaugaagacgaccccgguuauagucaggacgccuacaaaagugugagcacuccucuuaccacccuggacgccacaucugacaagaagaagaaaacagaggcauugcaaguggcuaccacuuccccuacugcaaauaccacuggaacagcgacuacuucaagcacaacugucggcgccgugaagcaagaacccuuacauucuaccuccuaugcugucaacauccuggaaaacaucucuaguucggagucaucuaaacccaucgaauuagacggccucccgucugaucaauucgcuaaaggacaggauacuguugccauugaaggcuucacagacgaagaggauacugagucaggaggagaggggcaguaccgagaaagggacgaguucguugugaagauugaagauauagagaccuuuaaagaagcucugaaaacgggcaaggagccaccugcuauuuggaaggugcagaaagcguugcugcagaaauuugucccugaaauacgagacggccagagagaauuugcggcuacaaacagcuaccuuggcuacuucggugaugcuaagucuaaguauaaaagaaucuauguuaaauucaucgaaaacgcaaacaaaaaagaauaugugcgugugugcagcaagaaaccucgcaauaagcccucccagaccauaagaacaguucaagccaaaccuucaagcaguucaaagacguccgacccgcuagcuucaaaaaccacgacaacaaaagcacccagcgucaaacccaaggugaaacagccgaaaguuaaagcagagcccccuccaaaaaaaagaaaaaaguggaaggaggaauuuuccaguucucaaucugacuccucccccgaaauacacaccagcuccagugacgaugaagaguucgagccucccgcacccuuugugaccagguuccugaauacccgcgcaaugaaagagacauuuaaaagcuacauggaauag

SEQ ID NO: 61591 - RNA, 693 nt, Artificial Sequence
  Description of Artificial Sequence: Synthetic coding sequence
augaagcugauagugggaauagggggcaugacaaaugguggcaagaccacacuuaccaauucuuugcuuagagcacucccaaauuguugcgugauucaccaagaugacuucuucaagccucaggaucagauagcuguuggggaagacggguucaagcagugggacguccuggagucccuggacauggaagcaauguuggacaccguucaagcguggcucucuucuccacaaaaguucgcacgcgcgcacgguguguccguucagccugaggccucugacacacacauacuccuccuugaggguuuuuugcuguauaguuauaaaccacuaguggaucuuuacucacgacgguauuuccucacagugcccuaugaagaaugcaaauggagacggucuacucggaauuauacugugccugacccaccagguuuauucgacggacacgucuggccgauguaucagaaguaucgccaagagauggaggcgaauggcgucgaaguggucuaucucgacggaaugaagaguagggaagaauuauuucgggaggugcucgaggacauacaaaacagccuuuuaaauagaagucaagaaagugcgccaagcccagccagaccagccagaacucagggaccaggucgggguugcggacaucgcacggccagacccgcugccucccaacaggauagcauguag

SEQ ID NO: 61592 - RNA, 1032 nt, Artificial Sequence
  Description of Artificial Sequence: Synthetic coding sequence
augagcgaugaagacgaucucgaagacucagaaccagaccaggacgacagcgagaaagaagaagacgaaaaagagacggaagaaggagaggacuacaggaaggaaggugaggaauuuccagaagaguggcuaccgaccccacuaacugaggacaugaugaaggagggauuaucccuguugugcaaaaccgguaauggccuagcucaugcauacguuaagcuagagguaaaagaacgggaucugacagauaucuaccuccucaggucuuacauucaucuaagauacguggauaucuccgagaaccaccucacagauuugucgccacugaauuaccuuacacaccuacuguggcugaaggcggacgguaauagacuaagaagcgcccagaugaacgaacucccauaccugcagaucgcuucuuuugcauauaaccagauaaccgauacugaaggaaucucucacccucgcuuggaaaccuugaaccugaaaggaaauucuauucacauggucacaggucuagauccggaaaaauugauuucucugcauaccguggagcuucgaggaaaucaacuggaaucaacucugggaaucaauuuaccaaaauuaaaaaaucuguaucucgcgcaaaauaugcucaagaaagucgaaggccuggaagaucugucaaaccugacaacacugcauuugcgagauaaucagaucgacacccugagcggcuucuccagagaaaugaaaucccugcaguaccugaaccugagaggcaacaugguggcgaaccugggugaguuagcuaaacugagagaccucccuaaguuaagagcacucgugcugcucgauaaucccugcacagacgaaacaaguuaucggcaagaggcccugguccagaugccuuaccuggaaaggcuagacaaggaauuuuacgaggaagaagagagagccgaagcagacguaauuagacagagacuuaaggaagagaaggaacaggagcccgaaccucaacgugaccuagagccggagcaaagccugaucuag

SEQ ID NO: 61593 - RNA, 618 nt, Artificial Sequence
  Description of Artificial Sequence: Synthetic coding sequence
auggugcagcuugcucccgccgcugccauggacgaaguuacuuuccggucagauaccgugcuguccgauguucacuuguauacucccaaucauagacaccucaugguaagguugaacagcgucggccaaccaguguuuuuaucucaguuuaaguugcuguggucacaagauuccuggaccgauucaggagcaaagggagguagccacagggacguucacaccaaggaaccacccuccgccgagacaggauccaccgggagcccuccuggcucuggacauggaaacgaaggcuucucuuuacaagcaggcacugacacaacuggacaagaaguggccgaagcccaacuggaugaggauggggauuuagacgucgugcggagacccagggcagcgucagacucaaauccugccgguccuuuacgcgauaaagugcacccaaugaucuuagcccaagaagaagaugacguguuaggcgaagaggcccaaggauccccucacgauauaauccggauagggguggccggccgaccagcccccggacggcugcacccggugccaaccggcccgcucccgagaauguacucagcaggagcccggggccgacauggagcucgcuag

SEQ ID NO: 61594 - RNA, 762 nt, Artificial Sequence
  Description of Artificial Sequence: Synthetic coding sequence
augccacuccuacccaguacaguugggcuugcuggguugcuuuucugggcuggacaagcagugaacgcccugauaaugccuaaugccaccccggcuccugcccaaccugagucaaccgcgaugcgguuacugucuggccucgaagugcccagauacagaaggaagagacauaucagcguccgggacaugaacgcccuguuagauuaucacaaucacauacgcgccucuguguacccuccagccgccaauauggaauacaugguuugggacaagagacuggcacgagcugcugaggccugggcaacccagugcauuugggcccaugggcccucccagcucaugagguacguaggacagaaccuuagcauccacucaggccaguaccgaagugucguagaucuaaugaaaaguugguccgaggaaaaguggcauuaucucuucccugccccuagagacugcaauccccacugcccauggagaugcgauggucccacuugcagucauuauacacagauggugugggcuuccucuaaccggcuuggaugcgcuauccacacaugcucuuccaucucuguuuggggcaacacauggcaccgggccgcuuacuuagucugcaacuacgcuauuaagggcaacuggauaggugaaucucccuacaagauggguaaacccugcuccucaugucccccuucuuaucagggcucaugcaacaguaauaugugcuuuaaaggacugaaauccaauaaguuuacaugguuuuag

SEQ ID NO: 61595 - RNA, 6708 nt, Artificial Sequence
  Description of Artificial Sequence: Synthetic coding sequence
augccccucuucuucucugcucuccuuguucuccucuugguggcauuaagcgccuuguuccuaggccgguggcuaguuguccgguuagcgacuaaauggugucagcgaaagcuccaggccgaauugaagauuggcagcuuccgguucuuuuggauccagaaugugucacuaaaguuucagcaacaucagcagaccguggaaaucgacaaccuuuggaucuccucaaaguuacuaucucaugaccucccccacuacguggcacuaugcuuuggcgaggugaggauccgaaccgaccuccagaaagugagcgacuuaucugcaccuuucagccagagcgccggcguggaccaaaaggaacuaagcuuuagcccaucuuuacugaagauauucugucagcuauucucaauacacguugaugccaucaauauuaugguucuuaaaguggacacuuccgaaagcuuguggcauauucagaucucccggucucgauucuuauuggauucugauggcaagagacugauuugcgaagucucauuauguaagauaaauagcaaaguccuuaaaucuggccaguuggaggacaccugccucguugaguugucauuggcccuggaucugugccugaaaguagguauuucuucaaggcacuugacagcaaucacaguagauguguggacucugcacgccgaguugcaugaaggcuuauuccagucacagcucuuaugccaggguccaucauuggcuaguaaaccugugccaugcuccgagguuaccgagaaucucguggaaccaacccucccuggauuauuucuacugcagcagcuccccgaucagguaaaagucaaaauggagaauacaagcguuguauugaguaugaacagccaaaagagacaccugacauggacauugaaacugcuucaauuucucuaucacagagacgaagaccaguugccguuaagauccuuuacugccaacucugauauggcacaaaugagcacagaacugcugcuggaggacggccuccugcuuucucagucaaggcaacgcaucguguguuuaaacucucugaaggccucaguccaggucaccacaauugauuuaucagcuucauuaguucugaauacauguaucauccacuacaggcaucaggaauucagccacuggcuucaccucuuggcauuggagacccagggaucuagcucacccguccuuaagcagcggaagaagcguacauucccccagauacucgccccaaucaucuucuccaccucaauuucgaacgucaauaucucuauccaacugggcgacacgcccccauucgcucugggguucaacucaaucagucuggauuaccaacaccugaggccacagucaauccaucaaagaggaguucuuacggucgaccaccuuugcuggcggguuggauccgauucacauauccagcgggccccucaccccccuaauaugcauguuuggggagaagcucugguccuugacucauucacccuucaaggaagcuauaaucagccacucggacucuccuccacacagagugauacccuguuuuuagacugcacaauuaggggauugcaaguggaagccagugacaccugcgcacagugccuaagcagaauccucagcuugaugggcccgcaaucugguaagagcgccgugucccgacauaguuccuuuggggagagcgugucauuacuguggaaaguggacuugaagguagaggauaugaaccucuucacucucuccgcuuugguuggcgccagugaggucagauuggacacacuuacuauccuggggagcgcugaaacauccaccguuggcauccaaggccuuguucucgcccuggucaaauccguaaccgagaagaugcaaccuugcuguaaagcaccugauaucccuacaccugugcugucccugaguaugcucucaaucacguaucacucuucuauaagaucguuggaaguacaguguggcgccggucuaacuuuacucuggaguccccccgaucauauguaccuguaucaacacgugcuggcuacuuugcagugccgagaucugcuucgcgcgaccgucuuucccgaaacaguccccucucuugcacuugaaacgagcggcaccaccuccgaacucgagggaagagcaccugaaccccugccgccaaaacgauuacuaaaccucacauuggaggucucaaccgcaaaacugacugccuuuguggcagaggacaaauucauuacacucgcugcagaaagcguuucucucuccaggcacggcggcucuuuacaggccuauuguccugaacuggcagcgggcuucgauggaaauucaaucuucaauuucaaggaaguggagguccagcuuuugccagagcuugaggaaaugauccugcaucgcaaucccuuccccgccuugcagaccuugagaaauagaguuuggcugcuguccuuuggauccgugagcguugaauuuccuuaucaguacgacuucaguagaacucuugacgaggcuguggggguccagaaguggcugaagggcuuacaucagggcacuagagcuugggccucaccaucuccuguaccucuucccccagaccuuuuguugaagguggaacacuuuucuuggguauuucuugaugacgucuuugaggucaaauugcacgauaacuacgagcugaugaaggacgagucuaaagaaucagcgaaacgucuccaguuacucgaugcuaaaguugccgcccuccggaagcaacauggagaacugcuucccgcacgcaagaucgaggaacucuacgcaucauuagagcgcaaaaauauugaaaucuauauucagcguucgagaagacuuuacggaaacaccccuaugagacgagccuuguugacauggagucuugcaggacuggagcugguugcuuuggcugacgcuuccuuccacggccccgagcauguuguggagcaaguccaagaguuagaucccgggagucccuuccccccugagggcuuggauuuagucauccaauggugccgcaugcuuaaaugcaauguaaaauccuuucucgugcggauuagggacuauccccgcuacuuguucgaaauaagagacuggaggcugaugggcagacugguggggaccgagcagagcggacaaccuugcucacgccgaagacaaauucuacaccuuggccugccguggggcaacguggccguggaacguaacaugccaccacuuaaauuuuaucacgacuuccacuccgaaauuuuccaguauaccguuguguggggccccugcugggauccagcauggacccugauuggacagugcguggaccuucuuacaaagcccuccgcugaccccucgccucccuuaccauggugggacaaaucgaggcugcucuuucauggcgacuggcacauggacauugaacaggcaaaccuccaccaacuggcuaccgaagaccccuauaauacaaccgagaacaugcacugggaguggagccaccuaucuuuccacuggaaaccuggacaguucguuuucaagggcgacuuagacaucaacgucaggacugcaucuaaguaugaugauugcugcuuucuacaccugccugacuuaugcaugacuuuagauuugcaauggcugugccacgguaacccccaugaccaucacucagugacacuacgugcacccgaauucuuacccgaggugccacuggggcaguuacaugacagcuacagagcuuuccguuccgaaaaccuuaaccuuaguaucaaaauggaccugacucgucacucuggcaccauuucccagccacggauuuugcuguacagcagcacauuacgguggaugcagaauuuuugggcaacauggacauccgucacaagaccaauaugucguggcaaacucuucaauaauuuaaaaccaaguaagaaaaaacucggccaacauuacaagcaguuaucauacacagcauuguucccacagcuccaagugcacuacugggccagcuucgcccagcagcgcggaauccaaaucgaguguucccaaggucacguuuucaccagagguacucagcgccugauuccacaggcaggcaccgugaugcguaggcugauaagcgacugguccgucacucaaaugguaucggauuuaagccaggugaccguacaucucauggccaguccgaccgaggagaaugccgaccacugccuggauccauugguuacuaagacccaccuuuugucauuaucaucacucacauaucagcgacacucaaauaggacugcagaggaggagcugagcgccagagauggcgaccccacauuccacacucaccaguugcaccugguggaucuccgaaucucuuggacgacgaccaaccgggacaucgcauucggacuguacgacggcuauaaaaaagcagcggugcucaaacgcaaucuaaguacggaagcccuuaaaggacugaagaucgacccccaaaugccugccaaaaaacccaaaagaggcgucccaaccucagcuucugccccuccccggguuaauacccccucuuuuuccggacaaccugauaagggcaguaguggaggcgcuuacaugcuacagaagcugaucgaagaaacagaccgguucgucguguucacagaagaagagaguggcaugucagaccagcugugcggaaucgccgccugccaaacugacgauauuuauaacaggaacugucuaauugaacucgucaacugccagaugguuuuaaggggagcggaaacagaagggugcguuauagucucugcggcaaaagcgcaguuacuacagugucaacaucauccugcuugguacggagauacccugaagcagaagacaagcuggaccugcuuacuggauggaaugcaauauuucgcuacuaccgaaagcuccccaacugaacaggacggacggcagcuuuggcuggagguaaagaacaucgaggagcaccgacaacggucguuagauuccgugcaggaacugauggagagcggccaggcggucgguggcauggucacuaccacaacugauuggaaccaacccgcagaggcacagcaggcccaacagguucagagaauuauuucaagauguaacugccgaauguacuauauuagcuauucacacgacauugaccccgagcuggccacucagauuaaacccccugaaguacuggagaaccaagaaaaggaggaccugcuaaaaaagcaagaaggggcuguggacacuuucacucugauccaccaugagcucgagauuagcacuaauccagcacaauaugcaaugauccuugacauaguaaacaaccugcuacugcauguagaaccaaagcgaaaagaacauucugagaagaaacaacgugugcgguuccagcuagaaaucucaagcaaccccgaagagcagcgaucuaguauacugcaccuucaggaggcugucagacaacacguggcucagauuagacaacuugaaaaacagauguacucuauaaugaaaucccugcaggaugauaguaaaaaugagaaucuccuagaccugaaucagaaacuccaauuacagcucaaccaagagaaagccaaucugcagcuggagucagaggaguugaauauccugauccgauguuucaaggacuuccaacuacagcgugccaacaagauggagcucagaaaacaacaagaggacguguccgugguaaggaggaccgaguucuauuucgcccaggccagauggaggcugacagaagaagacggucagcucggcaucgcagaguuggagcugcagcgauuccuguauucaaaagucaauaagagugaugauacagcggagcaucuccuggaacuggguugguucacaaugaacaaucuauugccuaacgcaguguauaaagugguauugaggccccaaagcaguugucaaagcgggcgucaguuggcucuuagguuauuuaguaaagugcgcccuccagucgguggaauuucaguaaaggaacauuuugaagugaacguugugccccuaacuauccagcucacccaccaguucuuccaccgaaugaugggauucuuuuuuccaggacggagcguggaggacgaugaggugggggacgaagaagacaaaucuaaacuggucaccacaggcauaccaguugugaagccacgccagcugaucgccacugacgaugcuguuccuuuggguccuggcaaggguguugcacagggguuaacacgcuccucugguguacgucgcuccuuccgaaagucucccgaacauccagucgaugauauugacaaaaugaaagagagagcagccaugaauaauuccuuuaucuacauaaaaauaccucagguacccuuguguguuagcuauaaaggggaaaagaacaguguggacuggggagaucucaaccuuguucuaccaugccucgaauaccauaacaacacguggacguggcuggauuuugcaauggccguaaaacgugauucccguaaggcauuggucgcacagguaauuaaagagaaacuucgcuugaagucagcuaccgggagugaagugagaggcaaguuagaaaccaaguccgaccugaacaugcagcaacaggaagaggaagaaaaagcuagguuauugaucggauugagcgucggagauaagaauccaggaaagaaaucaauuuucggccguagaaaauag

SEQ ID NO: 61596 - RNA, 6618 nt, Artificial Sequence
  Description of Artificial Sequence: Synthetic coding sequence
augccucuauucuuuuccgcccuacuugugcugcuacuggucgcucugucggcacuauuucuggggagauggcuggugguuaggcuggcgacuaaauggugucagagaaaguuacaagcggaacucaagaucggaagcuucagguucuuuuggauucagaacgugucuuugaaguuucaacagcaucagcagacaguggagauagauaaucuguggauaucuagcaaguugcucucacaugaccugccacacuauguugcccuguguuucggggagguucgcauucgcacugaucuucagaagguaagcgaucucuccgcuccuuucucccaguccgcuggcguggaucagaaagagcuuuccuuuuccccaucguuacucaagaucuucugucagcuguucucaauacacguggacgccaucaacaucaugguccucaaaguugauaccagcgaaucucuguggcacauucagaucagucgaucacgcuuucuucuagacucugacggaaagcgucucaucugugagguuucgcuauguaaaauuaauucaaaaguccucaagucuggucaacuugaagauacaugccucguggaacuaagcuuggcucuggauuuauguuugaaagugggcauuucuucgagacauuugaccgcaauaacaguugacguauggacucugcaugccgagcugcacgaaggccuauuucaaagccagcuguugugccagggccccagucuggccuccaagccuguucccugcuccgagguuaccgagaaucuggucgaacccacccugccuggacucuuccugcuacagcaacuaccugaccaagugaaagugaagauggagaacaccagcguuguccuuucuaugaacucacagaagcggcaucugacuuggacucucaaacugcugcaguuccucuaucaucgcgacgaagaucaacuuccucugaggucuuuuacagcuaauucagacauggcccagaugucaaccgagcuacuguuggaggacgggcuucugcugucccagucaaggcagagaauuguuugccugaauagccugaaggcaaguguccaaguuaccacgaucgacuuaucugccagccucguacugaacaccugcauuauccauuaucgacaccaagaauuuagccauuggcugcaccuccuagcccucgaaacacaaggcuccuccagucccguguuaaaacagcgcaagaagagaaccuuuccacagauccuggccccuaucauuuucuccacaucaauuucgaauguuaacauuucuauucagcucggagacacccccccuuuugccuuaggcuucaacaguaucucgcucgacuaucaacacuugcgcccacaaagcauucaucagagaggcguucuaacgguagaccaccuguguuggagggucggaagcgauucccauauucagagggccccacacccaccaaacaugcauguuuggggcgaggcuuuaguucucgacucuuuuacccuucagggaucuuauaaucaaccccucggucucuccucuacacagagcgauacauuguuucucgauuguacaauucggggccugcaaguggaagccagugacacaugcgcucagugucucucacggauccucagccucaugggaccucagagcgggaagagcgccguuucacgccauucgucauucggugaguccgucucacucuuguggaaaguggaucuuaaagucgaggauaugaaccuauuuacauugucggcacugguuggugcgucggagguacggcuugauacuuuaaccauuuugggcucugccgagacuucuacagucgguauccagggacucguuuuagcucucguuaagucuguuacugaaaagaugcagccauguugcaaggccccugauauucccacccccguacuaucucuguccaugcucucaauaacauaccacucauccaucagaaguuuggaaguccaguguggcgccggguuaacacuucuguggagcccaccagaccacauguaccuguaucagcacguccuggccacacugcaaugccgagauuuacuccgagcuaccguguuccccgagaccgugccaucucucgcucuugagaccaguggcacuacaucugaauuagagggucgcgcacccgagccucucccacccaaacggcugcucaacuugacucuggagguguccacagcaaagcucacagcauuugucgccgaggauaaguucauuacccucgccgccgaauccguuucuuuaagucgccauggcgggucucuucaagcuuauuguccggaacuugcagcuggauuugaugggaacagcaucuuuaacuucaaggaaguggaagugcaacuauuacccgaaguggaauuuccuuaccaauacgacuuuucuaggaccuuagaugaggccguaggagugcagaaauggcucaaaggauugcaccaaggaacccgcgccugggccuccccuuccccugucccuuugcccccugaccugcugcugaaaguugagcacuucagcuggguuuuccuggacgacguguuugaaguuaaacuccaugauaacuacgaauugaugaaagacgaaagcaaagagagugcaaaacggcuucaacuccuggacgccaaggucgcggcacugagaaaacagcauggugaauuacucccggcacgcaaaaucgaagagcuguacgccucucuggaacguaaaaauaucgaaauuuacauacaacgcucucggcgccuuuacgguaacacccccaugcggcgugcauugcuuacguggucuuuggccggcuuagagcuuguugcccucgcagaugccuccuuccauggacccgagcacgucguugagcaggugcaggaauuggaccccggcucacccuuuccuccagaaggacuggaccuugucauccaauggugucgcauguuaaaauguaauguuaagagcuuucuagugagaaucagagacuacccaagauaccuguucgaaaucagagacuggagauugaugggcagacucgucggcacagagcagucaggacagccuuguagcagacgacgacagauucuacaccucggucugcccugggggaauguagccguugaaaggaauaugccgcccuugaaauuuuaccacgauuuucauagcgagaucuuccaauacacugucguauggggccccugcugggauccagcauggacacuaauugggcagugugucgaccugcuuaccaaaccuagcgccgacccuagcccccccuugcccuggugggacaaaucucgccugcuuuuucacggggauuggcauauggauaucgagcaggcuaaucugcaucagcuggccaccgaggaucccuauaacacuaccgaaaacaugcacugggaauggagucacuuaucauuucauuggaaaccaggacaguuugucuuuaagggcgaucuagacauuaauguucggacagcaaguaaguacgacgacuguugcuuuuugcaucuccccgaucuguguaugacccuugauuuacaguggcuaugucacggaaauccccacgaucaccauaguguaacccuccgcgcuccggaguuuuuaccugaggucccccugggacagcugcaugauucuuaccgagccuuccgauccgaaaaucugaaucuuucaauuaaaauggauuugacgagacacagcggaacaauuucccagccacggauucuucuguauagcuccacgcugcgcuggaugcagaauuuuugggcaaccuggacaucgguuacaagacccauuuguagaggcaagcuuuuuaacaaccuuaagccauccaagaaaaaacuaggccagcacuauaaacaauuaagcuacacagcccuguucccacagcugcagguacauuauugggcauccuucgcacaacagcgcggcauccagaucgagugcucucagggccaugucuuuacucgcggaacucagaggcugauaccacaggcuggaaccgugaugcgucgacuuauuuccgacuggaguguuacacaaauggugucugaucugucccaagugacggugcaucugauggcuaguccaaccgaagaaaaugccgaucacugcuuagauccucucgucacuaaaacacacuuacuaagccugagcucguuaaccuaucagcgucauucaaaccggacugcagaggaagaacucagcgcccgagauggcgaccccacguuccacacccaucagcugcaccugguggauuuacggauuucuuggaccaccacaaaucgggauaucgcauuuggacuuuaugacggauauaagaaggcagcagucuuaaaacggaaccugaguaccgaagcucuaaaggggcugaagaucgacccucagaugccagccaagaaacccaaaagaggcguacccaccuccgcuucugcuccaccucgaguuaacacaccuucauuuuccggccagccagacaaaggcucuucuggaggagcauauauguugcagaaguuaauagaagaaacugacagauucgucguuuuuacugaagaagagagugggaugagcgaccagcugugcgguauagcugcuugccaaacagaugauaucuacaauagaaauugccucauugaacuagucaacugucagaugguucugaggggcgccgagacagaaggcugugucauuguaucagcagccaaggcccagcuauugcagugccaacaccauccagcgugguacggggacacacuaaagcagaaaacgagcuggacguguuugcucgacgggaugcaguacuuugccacgaccgaauccagccccacugaacaggauggccgucagcuguggcuagaagugaagaauauugaagagcaccgccaaagaagccucgacucagugcaggaacuuauggaauccggccaagccguaggaggaaugguuacuacgaccaccgacuggaaucaacccgcugaagcgcagcaggcucaacagguucaacgaauaauuucuagaugcaacuguagaauguauuacauuucauacucucaugacauugauccugagcuggccacccaaaucaaaccacccgagguccuggagaaucaggagaaagaagauuugcucaaaaagcaagaaggagccgucgacacauucacccuuauccaccacgaguuagagauuaguacuaacccugcacaguacgcuaugauccuggacaucguaaacaacuugcuucuacauguggagccaaaacgcaaagagcauucagagaaaaagcaacguguucgcuuccaacucgaaaucagcaguaaccccgaagagcagaggucuagcauccuccacuugcaggaagccgugagacagcauguugcgcagaucagacaguuagagaaacagauguacagcaucaugaaaucauuacaagacgauagcaagaacgaaaacuuacuggaccuaaaucagaaacugcaguuacaguuaaaucaggagaaagcaaacuugcagcuggaaagcgaagaacucaacauccucauccggugcuuuaaggauuuccagcuacaaagagccaauaagauggaacugagaaaacaacaggaagauguguccgucgugagaagaacugaauuuuacuuugcacaggcccgguggcgccugaccgaagaggaugggcagcucggcauagccgaacucgaguuacagagauuucuuuacucuaaagugaacaagucugaugacaccgccgaacaccuccucgaauuaggcugguucaccaugaauaaucugcucccuaacgcugucuacaaagugguccucaggccccaguccagcugccaaucuggucgccaacucgcauuaagacuguucucaaaagugagacccccuguggguggcauuagcgucaaagagcacuucgaggucaacguugucccacugacuauacaacugacgcaccaauucuuccaucguaugaugggcuucuuuuuucccggccggucaguugaagaugaugaaguuggagaugaggaagauaagaguaaguugguuaccaccggcaucccuguggucaaaccacgucaacugaucgcaacagacgaugcagugccccuuggcccugggaaaggaguagcccagggucugacaaggucgagcggugucaggagguccuuccgcaaaucccccgagcacccgguugaugacauugacaaaaugaaggaaagagcagccaugaacaauagcuuuauauacaucaaaaucccgcagguuccauugugcguguccuacaaaggagagaaaaacagcgucgauuggggggaucuuaaccucgugcugccuugcuuggaguaccauaacaauacauggacuugguuggacuucgccauggccgugaaacgugauaguagaaaggcucuuguugcgcagguaaucaaggaaaaacugcgccucaaaucugcaacagggagugaagugagagguaaauuggaaacuaaaucagaucugaacaugcagcagcaggaagaggaagaaaaagccagauuacucauuggccugagcgucggugauaagaacccugguaaaaagucaauauuuggacgucgaaaauag

SEQ ID NO: 61597 - RNA, 6708 nt, Artificial Sequence
  Description of Artificial Sequence: Synthetic coding sequence
augccccucuucuuuagcgcccugcucguacugcucuugguugcccucagcgcccuguuccucggcagauggcugguggugagacuggccacaaaguggugucagcgaaagcuccaggccgaguugaagauaggcucuuuuagguuuuucuggauccaaaauguaucucucaaguuucaacagcaucaacaaacaguugaaauagacaaccucuggauuuccucuaaacuccuuucacaugaucuaccucacuacguugccuugugcuuuggagaaguacgaauaaggacagaucugcagaagguaucugaucugucugcgcccuucucccagucagccgguguggaccagaaagaauugagcuuuagccccucccuacuuaagaucuuuugccagcuguuuucaauucauguggacgcaaucaauauaaugguccugaaaguagacacgucugagucucuauggcauauccagaucagcaggagcagauuucuucucgacucugacgguaagcgccugaucugugaggugagucuguguaaaaucaauuccaaagugcugaaguccgggcagcucgaagauacaugucuggucgaacuuucuuuagcccucgauuugugucucaagguaggaauauccagucgccaccugacugcuauaacggucgauguauggacccugcaugcagagcuacaugaaggucuguuccaaagccaguuacugugccaaggccccucccucgcuucuaagccuguccccuguucagaggugacagaaaauuuggucgagcccacccugcccgggcuuuuccuacuacagcagcugccugaucaggugaagguaaagauggaaaauacuagcguaguccugucuaugaacucccaaaaaaggcacuugacauggacuuuaaaguuacuccaguucuuauaucacagagacgaagaucaacugccccuccggagcuucacagccaacuccgauauggcccagaugagcacagaauuacuuuuggaagacggacuccugcucucucaaagucgacagagaaucgugugucucaacucccugaaggcaucaguucaggugacaacgaucgaucugagugcaucucugguacucaauacgugcauaauccacuaccgucaccaagaguuuucacacugguuacaccuacuggcacuagaaacacagggcaguagcagucccguguuaaagcaacgaaagaaacgcacuuucccccaaaucuuggcgccuaucauauuuucaacgucaaucaguaauguuaauaucucaauacaguugggagauacgccuccuuucgcacuuggauucaauucaauuagccucgacuaccagcaccugaggccucagucaauccaccaacggggaguccuuaccguagaucaccucuguuggcgcguuggaucugacucucauauacagcgcgcgccccacccuccgaacaugcacguauggggagaagcccuuguacuugauaguuuuaccuuacagggcucuuacaaccaaccccucggucuuuccuccacucaaucugauacacucuuccuggacugcaccauacgcgggcuacaggucgaagccucugacacuugcgcgcaaugccucagccguauucucagccucaugggcccccagucugguaaaagcgcugugagccggcauucauccuucggagaauccguaucccuccuguggaaagucgaucugaagguggaggacaugaauuuguuuacauuguccgccuuagugggggcuucugaagugaggcucgacacucuuacaauucucgggucagcugagacauccacugugggcauacaaggucugguacucgcauuggugaaaagcgugacggaaaaaaugcagccuuguuguaaggcgcccgacauccccacuccugugcuuucccuguccaugcugagcauuacguaccauaguucaauucguagcuuggaaguucaguguggagccggucugacccuacucuggucuccuccugaucacauguaccuuuaccagcauguucuugcaacacuucagugucgggaucuccuaagagccacuguauucccagaaacagucccaucccuagcgcuagagaccaguggaacaacaucugagcuggaggguagagcccccgaaccccuuccuccuaagcgccugcugaauuuaacauuagaaguuucaaccgccaagcuuaccgcguuugucgcagaggacaaauucauuacacuagccgccgaguccgugagccugucaagacaugggggaucacugcaagcauauuguccagagcuggcagccggguuugauggaaauucuaucuucaauuucaaggaggucgaaguucagcuccugccugagcucgaggaaaugauccugcacagaaacccguucccagcccuccagacccuuagaaaccgagucugguugcuauccuuuggcucagugagugucgaguuuccauaccaguaugauuucagcagaacccuugacgaggccguaggcgugcaaaagugguugaaaggacuucaccaggguacucgcgcuugggcauccccuagccccguaccucugccuccagaucuguugcugaaaguagagcacuuuaguuggguuuuccucgacgacguguuugaggugaaauugcaugacaauuacgaauugaugaaggaugaauccaaagagucggcaaagagacugcagcugcucgacgcuaaaguugcugcucugcgcaaacaacacggcgaguuacuacccgcaagaaagauugaggaacucuacgccaguuuggagcgcaagaacauugagauuuauauucagcgaucacgccgucuguacggaaauacaccuaugagacgggcacugcugaccuggucacucgccggacuggaacuaguagcacuggcugacgcgagcuuccacgguccagaacacgucguugaacagguucaagagcucgauccuggaucccccuuuccuccugaagggcuggauuuggucauucaguggugcaggaugcugaaaugcaaugugaagucuuuuuuggugcgaauaagggacuauccaagauauuuguuugagauuagggacuggagacugaugggcaggcugguugggacugaacaaucaggccagccuugcagccggaggagacagauauuacaucuuggccuuccguggggcaacguggcgguggagagaaacaugccaccacuaaaauuuuaccacgacuuucauuccgaaaucuuccaauacaccgucguauggggaccuuguugggacccugcuuggacacuaaucggccaguguguugacuuguuaacgaaaccgagcgcugaucccucccccccuuugccuuggugggacaaaucacggcuguuguuccacggcgauuggcauauggauauagaacaggcaaaucuccaucaguuggcaacugaagauccuuacaacacuacagaaaauaugcauugggaguggucucaucuuuccuuccauuggaaacccggccaauuuguguucaagggcgacuuagauauaaacguuaggaccgcuucaaaguacgaugauuguuguuuccuccaccuccccgaccuguguaugaccuuagaucuccagugguugugucacggcaacccucacgaccaucacuccguuacccuacgugcgcccgaguuuuugcccgaagugccuuuggggcaacuucacgauucauaccgugcuuuucgcuccgagaaccugaaucucucuauuaaaauggaccugacuagacacaguggaacuauuucacagccgcgcauucugcucuacuccagcacccucagguggaugcaaaacuuuugggcaaccuggacaagcgucacacgaccaauauguagaggcaagcuauucaacaacuugaagccauccaaaaaaaagcuaggccagcacuauaaacaauuaucuuacaccgcccuguuuccucagcuccaggugcauuauugggccuccuucgcacaacagaggggcauccaaaucgaaugcucucagggucacguuuucacucgcggaacucagcgccugauuccucaagcaggcacagucaugcgaagacucaucagugauugguccguuacccagaugguaucagacuuaagucaggucacuguacacuugauggcuuccccuacugaggaaaacgcugaccauugcuuggauccuuuagugaccaagacucaccuccucuccuuaaguucacucacauaccagagacauuccaaucguacggccgaggaagaacuuagcgcacgcgauggagacccuacuuuucauacccaccaacugcaccucguugaccugcgcauuucuuggacaacuacaaaccgugacauagccuucggccuuuaugauggcuacaaaaaagccgccgucuugaagcggaaccucucuacagaagcucucaagggccucaaaauagacccacagaugcccgcaaagaagcccaagagagggguucccacgucagccuccgcaccaccuagggucaacacgccuuccuucucugggcagcccgacaagggaucaagugguggugcauauauguugcagaaguuaauugaagagaccgaucgguucgugguuuucaccgaggaggagagcgggaugucagaccaacuaugcgguauagccgcuugucagaccgaugauauuuauaaccgcaacugucugauugaacucgugaacugucagaugguuuuaagaggcgcagaaacagaaggcugcguuaucgucuccgcugcuaaagcccagcuccugcagugccaacaccaccccgcaugguacggggacacauugaaacagaagacaucuuggacaugucugcuggacggaaugcaauauuuugccacaacugaauccaguccaacugaacaagauggccggcaacugugguuggagguuaaaaacauagaggaacauagacaaagaaguuuagacucggugcaagagcuuauggagaguggucaggcugucggaggaauggugacuacaacgacugauuggaaucagccugcugaagcccaacaagcacaacaaguucagcggaucaucucuagaugcaauugucguauguacuacauuuccuacucucaugauauugacccagagcuggcuacucaaaucaaacccccagaggugcucgaaaaccaggagaaagaggaucugcugaaaaaacaggaaggcgccgucgauacauucacuuuaauacaccacgaacuggagauuuccacaaacccagcccaguacgcuaugauccuugacauuguuaauaaccuucuacuccacgucgaaccgaaacguaaggagcacuccgagaagaaacaacgcguccgauuucaguuggagauaucaucaaacccugaagaacagcgcuccucuauccuccaucugcaagaagcagugaggcaacauguggcccagaucaggcagcuggagaaacaaauguacagcaucaugaaaagccugcaagacgacucuaaaaaugaaaaucugcuugaccuuaaccaaaaguuacagcugcagcucaaucaggaaaaagcuaaccuucagcuugagagcgaggaacucaauauucugauacgcugcuuuaaagauuuucaauugcagcgugcgaacaaaauggaacugagaaaacagcaggaggacgugucaguuguuaggcgaacugaguuuuauuuugcacaggcuagguggcgacugaccgaggaagaugggcaacuagggauagcugagcucgagcugcaaagguuucucuacuccaaagugaauaaaucugacgauaccgccgagcauuuacuugaauuggguugguucacgaugaauaaucuucucccuaaugcaguguauaaggccaucuugcguccccaauccucuugccaaagcggccgacaguuggcacugcgauuguuuucuaaggucagacccccggucgguggcauuaguguuaaagagcauuuugaggugaacgugguaccguugacuauccagcugacacaucaauucuuccaucguaugaugggauuuuuuuuuccaggccguagcguagaagaugaugaggucggagaugaggaagauaagucaaaacucguaacaacugggauccccgucgucaaaccaaggcagcugauugcaaccgaugacgccgugccccucggucccgggaaaggaguugcccaagggcugacccgcucaucuggcgugaggaggucuuuucgaaagucacccgagcacccaguggacgauaucgacaaaaugaaggagagggcugcuaugaacaacucauuuaucuauauaaagauuccacagguccccuugugugugaguuauaaaggagagaagaacagcguugauuggggagaucugaauuugguccugcccugucuagaauaccacaauaauaccuggacuuggcucgauuuugcaauggccguuaagagagauagcaggaaggcgcugguugcucaaguuauuaaagagaagcuuagacuaaaaucggccaccggcuccgagguccgcggcaagcuggagacaaaaucagaccuaaacaugcagcagcaggaggaggaagaaaaagccaggcuacucauaggccucagcgucggcgacaaaaacccgggaaagaagucaauauuuggacggagaaaguag

SEQ ID NO: 61598 - RNA, 6279 nt, Artificial Sequence
  Description of Artificial Sequence: Synthetic coding sequence
augguucucaaggucgacacaagcgagucucuguggcauauucagauuuccagaucaagauuccugcuggauucagauggcaagcgacucauuugcgagguuagcuugugcaaaauaaauaguaagguccugaagucgggucagcucgaggacacgugccuuguggaacugagcuuagcucuggaccugugucuuaaagucggcauuucuucaagacaccugacggcaauaacuguggacguguggacauuacaugcugaacuccacgaagggcuguuccagucucaauuacuuugccaaggcccuagucucgcaagcaagccugucccuuguagcgaagucaccgagaaucugguugaacccacgcugcccggguuauuccuccuccaacagcuaccagaucaggugaagguaaaaauggagaauacgucuguaguguugagcaugaauagccagaaacgacaccucaccuggacguugaagcuacugcaauuccucuaccaucgagaugaagaccagcuaccccuccggagcuuuaccgccaacuccgauauggcgcaaaugaguaccgaacuccuguuagaagacggauuacuccuuagccaguccaggcagagaauaguaugucucaacucacugaaagccucgguacaagugacaacuaucgaccuuuccgcgucgcuagucuuaaacacaugcauuauucacuaccggcaccaagaauuuucccacuggcugcaucuguuggcacuugagacccaaggcaguucuucacccguacucaaacagagaaaaaagcggacauuuccccaaauccuagcaccuaucaucuucucaacgucuauuuccaacgucaauauuuccauacaguuaggcgacacacccccguucgcccugggcuucaauagcauuucucuggacuaucagcauuugcggccacaguccauucaccaacgaggaguccuuacgguagaccaccuguguuggagaguaggcagcgauucucacauacagagagccccucacccaccgaacaugcauguauggggcgaggcacuaguccuggauucuuuuacccugcaaggcaguuacaaccagccgcuagggcuuaguagcacucagagcgacacccuuuuucuggacuguacaauucggggccuccagguagaagccucugauaccugcgcccaaugucuuucacggauucucucccugauggguccccaguccggaaagagcgccguuagucgucauucuucuuucggcgaaagugucuccuugcuguggaaaguugaucugaaagucgaagacaugaaccuuuuuaccuuaagcgcucuagugggggcaagugaagugaggcucgacacccugaccauauuaggguccgccgagaccagcacugugggaauucaaggacuugugcucgcccuuguuaaaagugugaccgagaaaaugcagcccuguuguaaggcucccgacauuccgaccccugugcugagccuuuccaugcuuuccaucaccuaccauagcucuauaagaucccuugaaguucagugcggagcaggccugacauuacuauggaguccgcccgaccacauguaucucuaucagcauguccuagccacacuucagugcagggaccuauugagagccaccguguuuccagaaacagugccuucccuugcauuagaaacaagcgggacaacuagcgagcuggaaggucgcgcacccgagccccugcccccuaaacggcugcugaaucuaacacuggaagucuccacagccaagcugaccgccuuuguggcagaggauaaauucauaacccuagccgcagagucagucagccucucucgccauggagguucccuacaagcauauuguccugaacuagcagccggguuugauggcaauuccaucuuuaauuucaaggaggucgaagugcagcugcuacccgaguuagaggagaugauccuucauagaaacccguuuccugcuuugcagacccuuaggaacagaguguggcuucucaguuuugggucugugucuguggaauuucccuaccaguacgauuucagcaggacucucgaugaagcagucgggguacagaaguggcugaaaggacugcaccaagggacaagagcaugggcuagcccgagucccguuccacuuccaccggacuugcuccugaaggucgaacacuucucuugggucuuucuggaugacguauucgaagucaagcuacacgacaacuaugagcuuaugaaggacgaaagcaaagaaucagccaagcgucuucagcugcucgaugcgaagguagccgcacugcguaaacaacacggcgagcuccuccccgcucggaaaaucgaagagcucuaugccucacuggaacggaaaaacauugaaauauauauucagagauccagacggcuguauggcaacaccccaaugagacgagcgcuucucacuuggagcuuagcaggguuagaacuagucgcccuugcagacgccucuuuucacggaccggagcacgucguggaacaggugcaggagcuugacccuggaagcccuuuuccgccugaaggucuagaucuggucauacaaugguguagaaugcuuaaaugcaacguaaagucauuucuggugcgcaucagagacuacccccgcuacuuguucgaaauucgcgacuggcgcuugaugggccgucucgugggcaccgaacaaagcggacagccuugcaguagacggaggcagauuuugcaccuuggcuuaccuugggguaacguggcgguugaaagaaacaugccccccuugaaauuuuaucacgacuuucauucugagauauuucaauacacaguaguguggggccccugcugggauccagcauggaccuugauaggacaaugcguagacuuguugacuaagccuucagcagauccuucaccuccucuccccuggugggauaaaaguagacuucuguuccauggcgauuggcacauggauauugagcaggcaaaccuccaccaacuggccaccgaggauccauauaauacuacugaaaauaugcauugggaauggagccaucugucauuccauuggaagccuggacaguuuguuuucaaaggcgauuuagacauaaaugugcgcacugccucuaaguaugaugacugcuguuucuuacaucuaccagaccuuugcaugacccuugaucuacaguggcugugucacgguaacccccacgaucaccacucaguaacacuacgggccccggaguuccuucccgaggucccacugggacagcuucacgauagcuacagagcauuucguuccgaaaaucugaaccucagcaucaagauggaucuaaccaggcauuccggcacaaucucccaaccaagaaucuuacuuuacucgucaacuuuacguuggaugcagaacuuuugggccacuuggaccagcgugacaaggccgauaugucggggaaagcuauucaauaaccucaaaccuagcaagaaaaaacucgggcagcacuauaagcaguuaaguuacacugcccuauucccucaguugcaagugcauuauugggcuuccuuugcccaacagcguggcauacaaauagaaugcucucagggccacguguuuacaagaggaacacagaggcugauuccgcaggccggcacuguuaugagaagacugauuucugacuggaguguuacacagaugguaagcgaucugucccaggugacuguccaucuuauggccuccccaacagaggagaaugcugaucacugucuggauccccugguuaccaagacacaccucuuaucucuuucaagucugacauaccaaaggcacucaaaccgcacagcugaagaagagcuuucugccagagacggugaccccacauuccacacccaccagcuccaccuuguggaccuccggauuucauggacuacuacgaauagggauaucgccuucggucuguaugacggguauaagaaagcagccguacuuaaacgcaaccucuccacagaggcucucaagggccuaaagauagacccccagaugccagcaaaaaagcccaaacgaggcgucccgacaucugccuccgccccuccaagagugaauaccccaagcuuuaguggacagccugauaagggaaguucgggcggcgcauauauguugcagaaacucaucgaagaaaccgaccgauuuguuguuuuuacagaagaagagagugguaugucagaucaacuauguggcaucgccgcaugccagaccgacgauaucuacaauagaaauuguuuaauugaacucguuaauugucagaugguguuaagaggugccgaaacagaaggcugugucaucgugucagccgccaaagcacaguugcuccaaugccagcaccacccagcgugguauggugauacucuaaaacagaagacauccuggacuugucugcuggacggaaugcaauacuucgcaacaacagagucuucgccgacugaacaggacgggagacagcuguggcuggagguaaagaacauugaggagcauagacagcgcucuuuggauuccguccaggaauuaauggagagcggacaggccguaggaggcauggugacaacaacuacugacuggaaccaaccugcugaggcucagcaagcccagcaaguccaaagaaucauuucucggugcaauugcagaauguauuacauauccuauucucacgacaucgacccugagcucgcaacccagaucaagccccccgagguauuggaaaaccaggaaaaagaggacuuacuuaagaagcaggaaggcgcaguagauaccuucacacuuauccaucacgaauuggaaaucagcacgaaucccgcucaauaugcuaugauccucgauauugugaauaaccuuuuacuucauguggagcccaagagaaaagaacauucggaaaaaaagcagcgcgugagguuccagcucgaaauaucgucuaauccugaagaacagcggucaucuauuuugcaucuccaggaggccguucgccagcaugucgcgcaaauucgucagcucgaaaagcagauguauaguauuaugaagucacuucaggaugacaguaaaaacgaaaaccucuuagaucugaaccagaaauugcagcuucaacugaaccaagagaaggccaaccuccagcuggaaucugaagagcuaaacauuuugaucagguguuuuaaagacuuccaacuucaaagagcgaacaaaauggagcugaggaaacagcaagaggauguguccguggugagacggaccgaguucuauuuugcucaagccagauggcgacuaaccgaggaagauggacaacugggcauugcggagcuagagcuacaaagauucuuguauagcaaaguuaauaaaucugacgauacugcagaacaucugcuugagcugggcugguucaccaugaacaaccuucuuccuaacgccguuuauaagguggugcugcggccucaauccaguugucagucuggucgccagcucgcccugcgacucuuuuccaaagugaggcccccagugggcgguaucucagugaaggaacacuuugaagugaauguggugccccuuacuauucaacuuacccaccaauuuuuucacagaaugaugggcuuuuucuuccccgggagaaguguggaggacgacgaagugggagaugaggaggacaaguccaagcuagugaccaccggaauaccaguagugaaaccuagacaauuaauugcgacugacgacgcuguaccccugggaccaggcaagggaguggcacagggcuugacccgcaguucaggagugcggcgcucuuuuaggaaaucacccgagcacccugucgaugauaucgauaaaaugaaggaaagggcugcaaugaauaacagcuuuauuuauauuaaaauuccucagguaccucucuguguguccuacaaaggcgagaagaacagcguggauuggggagaucuaaaccucguucuuccuugucuggaguaccacaacaacaccuggaccuggcuggauuucgccauggcugugaagagggauagcaggaaagcauuaguggcucaagucaucaaggaaaagcucaggcuuaaaagcgccaccgggucugagguaagaggaaagcuggagaccaaaagcgaccugaacaugcagcagcaagaggaagaggaaaaggcacguuuauuaaucggacuguccgugggcgacaagaacccugguaaaaaaucuauauuuggucgacgaaaauag

SEQ ID NO: 61599 - RNA, 3864 nt, Artificial Sequence
  Description of Artificial Sequence: Synthetic coding sequence
augguggcccggucuaccgauagcuuggacgguccaggugaaggaagcgugcagccucuccccaccgcaggcggucccuccgugaaaggcaaaccaggcaagcgacugucagccccaagaggcccuuucccuagacuggccgauugcgcccacuuccacuacgagaauguggacuucggacacauccaauuacuucucagcccugaucgagaaggaccgucucucucuggcgaaaacgaguuaguauucggggugcagguaaccugucagggcagaucuuggcccgugcuccgaucauaugaugacuuccgauccuuggacgcacaucuccaccgcuguaucuuugaccggagguucuccugccuccccgaacucccaccucccccugaaggcgcuagggccgcgcaaauguugguaccccugcuccuacaguaccuggaaacccuuucuggacuaguggacucuaaccugaacugugggccaguguugacuuggauggagcucgacaaccacggucgccgcuuacugcucucugaggaagcaucucuaaauauucccgcuguggccgcugcucacgucauuaaaagauacaccgcccaggcccccgaugaauugagcuuugagguaggggacauugugucaguaaucgauaugccacccacggaagaccguuccugguggcgcggcaaacgcggauuccaagucggguuuuucccuagugaguguguggaacucuuuacagaacgaccugggcccggacugaaagcugacgccgacggccccccaugcggcauucccgccccccaaggaauaucuucacucacuagugcagugccccgccccagagggaaacucgccgggcuuuuaagaacuuuuaugaggagucgcccuucucgccagcgucuaaggcagagggggauccuccgacagcguguauucggcugcgaccuuggugagcacuuaucuaauucaggacaggacgucccacagguccuucgguguugcagcgaauucauugaagcucauggggucguagauggcaucuacagacuuucaggcgucagcucaaacauccagcgccuccgccacgaauuugauucagaacgaaucccagagcugucugguccagcuuuccuccaagauauccacagugugucuucccucuguaaacuuuacuuucgcgagcuuccuaacccacugcuuacuuaucaauuguauggcaaguuuuccgaagcuaugagcguuccuggagaggaggagaggcuugucaggguccaugauguuauucagcagcugcccccuccccacuauagaaccuuagaguaccugcuaagacaccuggcucgcauggcccgacacuccgcgaauacuucaaugcacgcucguaaccucgccauaguaugggcaccaaaccuucuccguagcauggaauuagaguccguuggaauggguggugcugccgccuuucgggaaguccgagugcaguccguggugguggaguuuuugcuuacccauguugacgucuuguuuagugacacauucacgagcgccggacuggaccccgcaggcagaugucugcugccccgcccuaaaucucucgcagguagcugcccaaguacucggcuucugacucuggaggaagcacaggcgcgaacccaaggcagacuaggaaccccuacagagcccacuaccccgaaagcaccagccucccccgccgagagacgcaaaggugaacguggggagaaacaacguaaacccgggggaagcucuuggaagacauuuuucgcucuuggacgcgggccauccgucccacgcaaaaagccucugcccuggcuuggcggaacucgggccccuccgcaacccuccggaucuagaccggauacagugacucucagguccgcgaaaucagaagaaucauuaucuagccaggccucaggugcuggccuccagcgcuuacacagacugcgccguccccacuccuccucugaugccuucccaguggggccagccccagccggcaguugcgaaucucuguccucuucgucuucgucugaauccagcagcuccgagucuuccaguuccucaucugagaguuccgccgcaggacugggagcucuaucaggcagucccucacauaggaccuccgcuuggcuggacgauggugacgagcucgacuuuucuccaccaagaugccuugaaggccucagaggauuagacuucgauccuuuaacuuucagguguucaagcccuacccccggcgauccugcacccccugccucuccagccccaccagcaccugcuagugccuuuccaccucgugugaccccucaagcuaucaguccuagggggcccacaucuccagcuucucccgcagcacucgacaucucugaaccucuagccgugucagucccucccgccguguuggaauugcugggcgccggaggagccccugcaagugccaccccaaccccugcccuaaguccaggucgcucguuacguccacaccugauaccauuacuacugagaggcgccgaagcucccuugaccgacgcuugucaacaggagaugugcucgaagcuacgcggagcacaaggcccccugggaccagauauggaguccccuuugcccccuccacccuuaucacuccugagaccaggaggagcccccccaccaccacccaaaaacccagccagacugauggcgcucgccuuggccgaacgcgcccagcaagucgcggaacagcagagucagcaagaaugcggugguaccccccccgccagccaguccccuuuucaucgcucuuuaucccuggaaguaggcggagaaccacucggcacaucaggguccgggccuccccccaacagccuggcucacccuggggccugggugccuggaccucccccauaccuuccgcgccagcaauccgacgggagucucuugagaagccaacgucccaugggaacuagucgaagagggcugcggggcccagcucaagucucagcccaacuucgcgcaggaggagguggccgugacgcucccgaagccgccgcucagucucccugcuccgucccaucccagguccccaccccaggguucuucagucccgcccccagagagugucugcccccguuccucggcgucccaaaaccagguuuguauccucucggcccaccuucauuucaaccuaguagcccugcucccgucuggcgcagcagucuaggcccgcccgccccccucgaucggggcgagaaucuuuauuacgaaauaggcgcgucagaagguucacccuauagcggccccacaagaagcuggucuccuuuuagaucaaugcccccugaccgcuugaacgccuccuauggcaugcuugggcagagucccccucuccaccgcuccccugauuuucuguuauccuacccacccgcgcccuccugcuucccucccgaucaccuggguuacagcgccccucagcacccugcgcgccgaccuaccccuccggaaccccucuacguuaaccucgcccucggaccuagaggccccucuccugcgucaaguucaaguagcagcccucccgcccacccgcgcucacguagcgaccccgguccuccugucccccgacucccacagaagcagagagcccccugggguccuagaaccccucaucgugugccuggcccuugggguccucccgagccacuguuauuauauagagcggccccaccugcauacggacggggcggagagcugcaccgaggcucacuguacagaaauggcggacagcggggggagggcgccggucccccacccccuuacccuacaccuucuuggucauugcauucugaaggacagacuagaucauauugcuag

SEQ ID NO: 61600 - RNA, 432 nt, Artificial Sequence
  Description of Artificial Sequence: Synthetic coding sequence
auggaaacuuucccccucuugcugcuaagcuugggucucgugcucgccgaagccuccgaaaguacuaugaaaauuauuaaggaagaguucacugacgaagaaaugcaguacgauauggcuaaaaguggccaggaaaagcagaccaucgagauuuuaaugaauccaauacuucuagugaaaaacacgagucuuucaaugaguaaggaugacaugagcagcacucuuuuaacauucaggagccugcauuacaaugauccaaaaggcaacucuucuggaaaugauaaggaauguugcaacgauaugacuguguggcgaaaaguuucugaagcuaacggauccuguaaguggaguaauaauuuuauucgcucuagcacugaaguuaugagaagaguccaccgugcacccucuugcaaguuugugcaaaaccccuag

SEQ ID NO: 61601 - RNA, 939 nt, Artificial Sequence
  Description of Artificial Sequence: Synthetic coding sequence
auggaaccaggcaguguagaaaaccuauccauuguuuacaggaguagagauuuccuggucguuaacaaacauugggacgugcggauagauucaaaagcuuggagagaaaccuuaacucuacaaaaacagcugagauacagauuccccgaauuggccgauccagauacuugcuacggcuuuagauuuugccaucaacuggauuucaguaccucaggagcgcucugcgucgcgcuuaacaaggcugccgccgguucugcauaucgcuguuucaaggagagacgugugacuaaggcuuaccuggcccuccuucggggccauauucaggaaagccgcguuacaauuucgcaugcaaucggcaggaacucaacagaagguagagcucacacaaugugcaucgagggaucccagggcugcgagaaucccaaacccuccuugaccgacuugguaguccuggaacaugggcucuaugcaggagacccaguguccaaaguauugcucaaaccccucacuggacgcacccaccaacugaggguccacuguagcgcacuuggacacccugugguaggcgacuuaacuuacggagaaguuuccggaagggaagauagacccuuccgaaugaugcuccacgccuuuuacuugcggauuccuacagauaccgaauguguggagguuugcacaccugacccuuuccugcccucccuggacgccuguuggucuccccacacguuacugcagucccuagaucaguuaguucaggcccuacgcgcuaccccugacccggacccagaggauagggggccaagaccaggaagcccuucugcccuccugccaggcccugggagaccuccaccuccccccacuaagccuccugagaccgaagcacaacgaggcccuugccugcaguggcugagcgaauggacuuuagaaccggacucauag

SEQ ID NO: 61602 - RNA, 1140 nt, Artificial Sequence
  Description of Artificial Sequence: Synthetic coding sequence
auggagcagcugucuuccgcaaacacgcguuuugcccuggaccuuuuccuagcacuuagcgagaauaaucccgccggcaauauuuuuaucucuccauuuucaaucucauccgcaauggccaugguguuucuugggacacgcggaaacacagccgcacaacuuucuaagacuuuucauuuuaauacuguggaagaagugcacucacguuuccaaucucuaaaugccgauaucaauaaacggggggcaagcuacauucugaaauuggcgaauagacuguacggagagaaaacuuauaacuuuuuacccgaguuucucgugucaacacaaaagaccuauggagcugaucuugccucugucgauuuucaacacgccagugaggaugcccgcaaaacuaucaaccaaugggugaaaggacaaacugaaggaaaaauacccgagcugcuggccuccggaaugguggauaauaugaccaaacucguacuggucaaugccauuuauuuuaagggaaacuggaaggacaaguuuaugaaagaagcaacgaccaaugcacccuuccgguuaaauaagaaagacaggaagaccguaaaaaugauguaccagaagaagaaguuugccuacggauacaucgaagaccugaaaugucgcguccucgaacucccauaucaaggcgaggaacucuccauggugauucuccugccugaugauauugaagaugaauccacuggucucaaaaagaucgaggaacagcugacccuagaaaagcuccaugaauggacaaaacccgaaaauuuagauuuuauugagguuaaugucagccuuccacguuuuaaacucgaagaaagcuauaccuuaaauagcgacuuagcacgucugggcguccaagaccuuuucaauucaagcaaagcagaucugagcgggaugucgggggcccgggacauauucauuuccaaaaucgugcacaagucguucguggaagucaaugaggaaggcacagaagcugccgcugcaaccgccggaauagcuacuuuuuguaugcucaugccagaggaaaacuucacagcggaccaccccuuccuguuuuuuaucaggcacaauaguucaggauccauacuuuuuuuaggcagauucucauccccauag

SEQ ID NO: 61603 - RNA, 687 nt, Artificial Sequence
  Description of Artificial Sequence: Synthetic coding sequence
augguugacaauaugacgaagcucguccuugugaacgcgauuuacuuuaagggaaauuggaaggacaaguucaugaaggaagcuacuacuaaugcccccuuucgccugaacaaaaaagaucggaaaacugugaaaaugauguaucagaagaagaaauucgccuacgguuauauugaagaccucaaaugucgcgugcuggagcucccauaucaaggugaggaacuuucaauggucauacugcuucccgaugauauagaagacgaauccacuggacuuaagaagauagaggaacaacugacucucgaaaaacugcacgaauggacuaagcccgaaaaucuggacuuuauagaagucaauguuucacucccacgcuucaagcuugaggagucauacacccugaauagugaccuggcaagacuggggguccaggaucuguucaauucaagcaaggccgaccuguccgggaugucuggagcaagagauauuuuuaucaguaaaauugugcacaagucauuuguugagguaaacgaagagggaacggaggcagcugccgcaacagccggaauugccaccuucuguaugcugaugccagaagagaauuucaccgcugaccacccauuccucuucuuuauucgccacaacuccucuggaagcauucuguuccuaggccguuucucaucaccguag

SEQ ID NO: 61604 - RNA, 1026 nt, Artificial Sequence
  Description of Artificial Sequence: Synthetic coding sequence
auggcuauggucuuuuuaggcacacgggguaauacagcugcgcagcuuucaaaaacguuccauuucaauacagucgaagaagugcacucccgguuucagucacuuaaugccgauaucaacaagaggggugcaucauacauucucaaacuggcaaaccgccuguauggcgagaaaacuuacaacuuuuugcccgaauuccucgugaguacgcagaagacuuauggugcugaucucgccuccguggacuuccagcaugcauccgaagacgccagaaaaacaauuaaucagugggucaaaggacaaacagaaggcaagauuccagaacuccuggccagcggcauggucgauaacaugaccaaacugguccuggugaacgcuauuuauuucaaagggaauuggaaggacaaguuuaugaaagaagcaacaaccaacgccccuuuucggcucaacaaaaaagaccguaaaacugugaaaaugauguaucagaagaaaaaauuugccuacgguuauaucgaagaccuaaaauguagaguguuggagcucccuuaucagggcgaggaacugaguauggucauccuauugcccgaugacauugaggacgaaucuaccggacugaaaaagauugaagaacaguugacacuugaaaaacugcacgaauggacaaaacccgagaaucucgacuuuaucgaagucaacgucucucucccgcgguuuaaacuugaagagucauauaccuuaaauagugaucuggcccggcucggcguccaggauuuauuuaauucuagcaaagcugaucuuuccggcaugucaggggcccgagauauuuucauuaguaagaucguucauaaauccuucguggagguaaaugaagagggcacagaggccgcugcugccacugcugguauugcuaccuuuugcaugcugaugcccgaagaaaauuucacugccgaccaccccuuucucuucuucauuagacauaauaguuccggaagcauccuguucuuaggaagauucucauccccuuag

SEQ ID NO: 61605 - RNA, 2397 nt, Artificial Sequence
  Description of Artificial Sequence: Synthetic coding sequence
auggguaaggccuccccagccuccggacucucacgcccuaaaacacuugucuccccgcugcgauccaaccaguggucacuacagaagggucugccggaacaauacuacucucugacgugguuccucucccccauacucggacucaucuucacuccccuaaucgggucggccuccgaucgaugcacacuuagcuggggucgaaggcggccguucauacuugcuuuguguguuggaguccuauucggggucgcacuuuuccuaaacggcucggcaauuggccuggcauugggugacguaccuaaccgacagccuauagggauagugcucacaguguuaggaguuguggucuuggauuuuucugccgacgcuacagagggaccuauuagggcuuacuuguuggacguuguggacucugaagaacaggacauggcauugaauauccaugcauuuuccgccggucuuggcggugcuauaggauacgucuuggguggccucgauuggacucagacauuccugggaagcugguuuagaacucagaaccaggugcuguuuuucuuugcugcaaucaucuuuaccgugucugucgcacugcaucuguucucaaucgaugaagaacaauauucaccccaacaagagcgaagcgcugaggagcccggcgcucucgacgguggagagccccauggcgugcccgcguucccugacgaaguccagagugaacaugagcuagcccuggacuaucccgauguugauauuaugcgaucaaaaagugacucggcacuacacgugccugacacagcccuagaccuggagcccgaacuucucuuccuccaugacauagaacccucuauuuuccaugacgcaagcuaccccgcaacaccccgauccacuagccaggagcucgccaagaccaaacugcccagguuggcuacuuuccucaaagaggcugcaaaggaagaugagacguuacucgacaaccaucuuaaugaagcaaaaguuccaaacggcagcgguucccccacgaaggaugcccucggcggguacacucgaguagacacaaagccgucugccacaagcucauccaugcgaagacgcagacacgcuuuucgacgccaggccagcagcacauucagcuacuacggaaaauugggaagucacugcuacagguauagacgagcuaaugcaguggugcucauuaagccgucccgcagcaugagcgaccuguacgauaugcagaaaagacagagacagcaccgacacagaaaccaguccggggccacaacuucgaguggagauaccgagagcgaggagggagaaggggagacuacagugagacuccugugguuaaguaugcugaaaaugccaagagagcugaugcgcuugugccucugccaucucuuaaccugguucagcguuauugccgaagcaguguucuacaccgacuuuaugggacaggugaucuuugagggggaccccaaagcuccaaguaauuccacggccuggcaagcuuacaaugccggcgugaaaauggguuguuggggauuagugauuuacgccgcuacgggcgcuauauguagcgcgcuuuuacaaaaguaucucgauaacuacgaccuuuccgugcguguaauuuaugugcuagguacacucggcuuuucagugggcacagccguuauggccauguuuccaaacguuuacguugcaauggugaccauaagcacgauggguauuguaucuaugucuauuucauacugcccuuaugcucuguuaggacaauaccaugauaucaagcaguacauucaccauagcccaggaaauaguaagcguggauuugguaucgacugugcuauccucaguugucaaguguacauaucccaaauccuaguggcaagugcucuugguggcguggucgacgcuguggggacgguacgcgucauuccuauggucgcuuccguuggaucguuuuuaggcuuccucaccgccacuuuccuggucaucuacccgaauguuucugaggaggcuaaggaggaacagaaaggcuugucuagcccucuugccggugaagguagagcuggugguaacucugaaaagcccacagugcuaaaauuaaccagaaaggaaggccuacagggaccaguugagaccgaacgacugcaaguucuaacaagugugagaucccgccauaucggguggugucgaaguuguuggcgcguguuuuuuuuuaugauuauccucgaaaaaaaauuuaguuuuccucaguguggaucuuugagaaggaugacuuacuuacuuuuucugucggagcucgacacauuguguccgggccagccuugcccuugggccgcaacugcucaccaaagcugggaagaagccggccccgguggccugggccgacggcaguag

SEQ ID NO: 61606 - RNA, 1023 nt, Artificial Sequence
  Description of Artificial Sequence: Synthetic coding sequence
auggugacacuccgcaaacgcacgcuaaagguuuuaaccuuccuuguucuauucauauuccugacuucauuuuuucuuaacuauagccacaccauggucgccacuacuugguucccgaagcagauggugcuugagcucucugagaaccugaagcgccugaucaagcauaggcccuguacgugcacccacuguaucggccaacgcaagcucucugccugguucgaugagagguucaaucagacaaugcagccacuucuaaccgcucaaaaugcccuucuggaagaugauaccuaccgcugguggcugcggcugcaacgugagaaaaagccgaacaacuuaaaugauacgaucaaggagcuguuuagggugguacccgggaacgucgauccuaugcuugagaagagaucugucgguugucgcagaugcgccguaguaggaaauucaggaaaccucagggagagcucguauggaccagaaaucgauucucacgauuuuguccuuagaaugaauaaagcucccaccgcuggguuugaggccgacgucggaacuaaaacaacacaccaucuugucuacccggaaucauucagggaauuaggggauaaugugucuaugaucuuagugccauuuaagacaauugacuuagaguggguugucuccgcuaucacuacuggaacuauaucucauacuuauauacccgucccggcgaaaauucgggucaaacaagauaagauacucauauaucaccccgccuucauuaaauaugucuucgauaauugguuacagggucacgggcgcuacccuuccacaggaauacugagcgugauuuucucuaugcauguuugcgaugaaguggaccuguacggauuuggagcagacucuaaaggaaauuggcaucacuacugggagaacaacccuagcgcuggagcuuuccggaaaacaggcgugcaugacgcugacuuugaaucaaauguuaccgcaacguuagcaagcaucaacaaaauuagaauauucaaagggagguag

SEQ ID NO: 61607 - RNA, 1023 nt, Artificial Sequence
  Description of Artificial Sequence: Synthetic coding sequence
augguaacgcugcgcaaaaggacucugaaaguccugacuuuccugguucuuuuuauauuccucaccagcuucuuucuaaauuacucucacacaaugguggcgacaacuugguuuccaaagcagauggugcucgagcugucagagaaccuaaaaagauuaaucaagcacagaccuugcacuugcacgcauugcaucggacagagaaaguuaucagcaugguucgacgagcgauuuaaucagacgaugcagccccuguugaccgcccagaacgcucugcuggaggaugauaccuacagaugguggcucagacugcagagggaaaaaaaacccaauaaucugaaugacacuauuaaggagcucuuccgcgucgucccaggcaauguagauccuauguuagaaaaaagaucugugggaugucggcggugugcgguaguugguaacucggggaaucugagagaauccuccuacggcccagagauugauucucacgauuucguacugagaaugaauaaggcaccaacagcgggcuuugaagccgauguggggacuaaaacaacacaccaccucguuuauccugaaucuuuccgagaauugggugauaauguguccaugauauuggugccguuuaaaaccaucgaccuugaaugggucgugucugcaaucacuaccggaaccauuagccauaccuauauucccguccccgccaaaaucagagucaaacaggacaaaauucucauauaucaucccgccuucauuaaauaugucuucgauaacuggcuucaagggcauggucgauacccauccaccggcauuuuaucuguuauuuucagcaugcaugugugugacgaaguugaucucuacggauuuggagccgauucaaaagggaauuggcaucacuacugggaaaauaauccaucagccggagccuuuaggaaaaccgggguccaugacgccgauuucgagucuaacguaacagcaacacuggccagcaucaauaaaauacgaaucuuuaaagggagguag

SEQ ID NO: 61608 - RNA, 150 nt, Artificial Sequence; identical to SEQ ID NO: 61550
  Description of Artificial Sequence: Synthetic coding sequence

SEQ ID NO: 61609 - RNA, 1023 nt, Artificial Sequence
  Description of Artificial Sequence: Synthetic coding sequence
augguaacccuuaggaaacgaacacugaaagugcugaccuuccugguucuguuuauuuuucucacuagcuuuuuccuaaauuacagucauacuauggucgcaaccacuugguucccgaagcaaaugguccucgagcuguccgaaaacuugaagagauugaucaaacacaggcccugcaccugcacgcauugcaucggccagcgcaagcugagcgcuugguuugacgagagauucaaccagacuaugcagccccuccugacagcccagaacgcacuucuugaagacgauaccuaucguuggugguuacgacugcaaagggagaaaaagccuaacaacuugaaugacacaauuaaggagcuguuuagagugguuccaggcaauguggauccaaugcucgagaaaagauccgugggcugccgccggugugcaguggucgggaacagcgggaaccugagagaaucaucuuacggcccggaaauagacagucaugauuucgugcugagaaugaacaaggcgccaacagcuggcuuugaagcugacgugggcaccaagacaacucaccaccuuguguauccugagucauuccgagagcucggggacaacguauccaugauccuggugcccuucaaaaccauugaccucgaauggguagucuccgcuauuacuaccgguacaaucucccacacguauauccccgucccagcaaagauaagaguuaagcaagacaaaauccugauauaccauccugccuuuaucaaguacguguuugacaacuggcugcaagggcacgguagauacccaagcaccgggauuuugagugugauuuuuaguaugcacgugugcgacgaaguggaucucuauggauuuggagcugauucuaaaggcaauuggcaccacuacugggaaaacaaccccagcgccggagcauuuagaaaaacaggagugcacgacgcagacuuugagucgaacguuaccgccacccuagccagcauuaacaaaauacggaucuucaagggcagauag

SEQ ID NO: 61610 - RNA, 1023 nt, Artificial Sequence
  Description of Artificial Sequence: Synthetic coding sequence
augguaacccuucguaaaagaacccucaaggugcugacuuuccuuguguuguucauauuccucacaucuuuuuuuuuaaauuacucucacaccaugguagccaccacaugguuccccaaacaaaugguccucgaacucuccgagaaccucaagagguugauuaaacaucgcccaugcacguguacucacugcauuggacagcggaaauuaucugccugguucgaugagcgcuucaaucagacaaugcaaccccuccugacagcccagaaugcccuacuggaagacgauaccuaucguuggugguuacggcugcagagagagaagaaacccaauaaccuaaacgauacgaucaaggagcuuuuuaggguggugccugguaauguagacccuaugcuggagaagagaucaguggguugccgcaggugcgcgguggucggaaauuccggcaaccuucgggaaucuaguuaugggccugaaauugacucucacgauuucgucuugagaaugaacaaagcacccacagcaggauuugaagccgacgugggaacaaagacuacccaucaccucgucuauccggaguccuuuagagagcugggcgacaacguuucuaugauuuuaguuccauucaagacuaucgacuuggagugggucgugucugcuauuacaacagggacaauaucucauacuuauauuccugugcccgcaaagauuagagucaaacaagacaaaauccugauauaccaucccgcuuuuauuaaauacguuuucgacaacuggcugcaaggucacgguagauaucccuccacuggcauucuuuccgugauauucuccaugcacgucugcgaugaaguggaccuauauggguucggcgccgauucuaagggaaacuggcaccauuauugggaaaacaauccuucugcaggagcuuuuagaaaaaccggaguccaugaugccgauuucgaaaguaacguaacggccacccucgcuuccaucaauaaaauacgcauuuucaaaggucgguag

SEQ ID NO: 61611 - RNA, 219 nt, Artificial Sequence; identical to SEQ ID NO: 61553
  Description of Artificial Sequence: Synthetic coding sequence

SEQ ID NO: 61612 - RNA, 144 nt, Artificial Sequence; identical to SEQ ID NO: 61554
  Description of Artificial Sequence: Synthetic coding sequence

SEQ ID NO: 61613 - RNA, 1221 nt, Artificial Sequence
  Description of Artificial Sequence: Synthetic coding sequence
augauacacacaaaucugaaaaagaaauuuucuugcugcgugcugguguucuuacucuucgccgugaucugcguuuggaaagagaaaaagaaaggcuccuauuacgacaguuuuaaguugcagaccaaagaauuccagguccucaagucccucgggaaacuggcuaugggaucagacagucagucgguaagcucaaguucaacucaggauccucaucggggcaggcagacgcugggcucacuccgaggucuugcaaaggcaaagccagaggcaagcuuucagguguggaauaaggauaguaguucuaagaaccucauuccucgucuacaaaaaauuuggaagaacuaccugaguaugaauaaguauaaaguuuccuauaaaggacccgggccaggcauuaaguucuccgccgaggcgcuacggugucaccugcgagaucaugugaacguaagcaugguggaagugaccgauuuuccauuuaacaccucagagugggagggauaccuaccaaaagagucuauccggacaaaagcaggaccauggggucgaugugcuguuguguccucggccggcagccugaagagcucucaguuaggcagagaaauugacgaccaugacgcuguucuuagauuuaauggagcacccaccgccaauuuucaacaagacguagguacuaagacaacuauuagacucaugaauagccagcucguuacuacagaaaagagguucuugaaagacucacuuuauaaugagggaauucugaucgugugggauccuaguguauaucacagugacauuccgaagugguaucagaaccccgacuacaacuucuucaacaacuauaaaacauaucgcaaguugcacccaaaucagccauuuuauauacucaaaccucaaaugcccugggagcucugggauauacugcaagagauuaguccugaggagauccagcccaauccaccuucuuccggcaugcuuggaauaaucauuaugaugacccugugcgaccaaguugauaucuacgaauuuuugccuagcaaacggaaaacugauguaugcuacuacuaucagaaauucuucgacagcgcguguacgaugggcgccuaccacccucugcuauaugagaaaaauuuagugaagcauuugaaccagggaaccgaugaagauaucuaucucuuggggaaggccacuuugcccgguuucaggacgauucauugcuag

SEQ ID NO: 61614 - RNA, 228 nt, Artificial Sequence; identical to SEQ ID NO: 61556
  Description of Artificial Sequence: Synthetic coding sequence

SEQ ID NO: 61615 - RNA, 342 nt, Artificial Sequence
  Description of Artificial Sequence: Synthetic coding sequence
augauacacacaaaccucaaaaagaaguuuucuugcugcgucuuaguuuuucugcucuuugccgucaucugcguguggaaagaaaaaaagaaggguagcuauuacgauaguuuuaaacuacagaccaaagaauuccagguuuuaaagagucuugguaagcuugcaaugggcucggacagccagucagugagcucuuccuccacccaggauccucaucgcggaagacagacucuggguucuuuacguggccuggccaaagcaaagcccgaggccucuuuccagguuuggaacaaggacagcucuucuaaaaauuuaauuccuagacuucaaaaaauuugguag

SEQ ID NO: 61616 - RNA, 384 nt, Artificial Sequence
  Description of Artificial Sequence: Synthetic coding sequence
augauucauacuaaccucaaaaaaaaguucucuuguuguguccuugucuuuuuacuuuuugccgugauaugcgucuggaaagagaaaaagaaaggaucauacuacgacuccuuuaaacuccagacaaaagaauuucaagugcuuaagucucuugggaaacucgcaauggguucagauucccaauccguuuccucauccucaacccaggauccucaccggggaagacagacucuagggucccuccguggccuggcuaaggccaaacccgaggcaagcuuucaaguguggaacaaagacagcuccuccaaaaaucucaucccucgccugcagaaaauauggaagaauuaucucagcaugaacaaguacaaaguaucuuauaaguag

SEQ ID NO: 61617 - RNA, 129 nt, Artificial Sequence; identical to SEQ ID NO: 61559
  Description of Artificial Sequence: Synthetic coding sequence

SEQ ID NO: 61618 - RNA, 294 nt, Artificial Sequence; identical to SEQ ID NO: 61560
  Description of Artificial Sequence: Synthetic coding sequence

SEQ ID NO: 61619 - RNA, 138 nt, Artificial Sequence; identical to SEQ ID NO: 61561
  Description of Artificial Sequence: Synthetic coding sequence

SEQ ID NO: 61620 - RNA, 276 nt, Artificial Sequence; identical to SEQ ID NO: 61562
  Description of Artificial Sequence: Synthetic coding sequence

SEQ ID NO: 61621 - RNA, 1221 nt, Artificial Sequence
  Description of Artificial Sequence: Synthetic coding sequence
augauacacacuaauuuaaagaagaaguuuagcugcugcguccugguguucuuacuguucgcagucauuugcguguggaaggaaaagaagaaaggguccuauuacgauucauucaagcuccaaaccaaggaguuucagguucucaaaagucucgguaaguuggccauggguagcgauagucagagcguuucaucuucuucaacucaagauccacaccgagguagacaaacacuggggucucugcgugggcucgcuaaggccaaaccggaagccagcuuucagguguggaacaaagacuccagcagcaaaaacuuaauuccacgacuccagaaaaucuggaagaacuaccucucuaugaauaaguacaaagucuccuauaaaggcccaggccccgguaucaaauucagcgccgaagcacugcguugccaucugcgcgaccaugucaacgucaguaugguugaggugacagacuuccccuuuaacacuucggagugggaaggcuauuugccuaaagaaagcauccguacuaaagcaggaccuuggggcaggugugccgugguaucauccgccgggaguuuaaagucuucucaacucggccgugaaauagacgaccaugaugccguccugcgguuuaauggcgcccccacagccaauuuucaacaggacgugggaacgaagacaacaauccgccucaugaauucacagcuggucaccacagaaaaacgcuuucuuaaagacucacuguauaacgagggaauuuugauugugugggaccccaguguuuaucacagcgacauuccaaaaugguaccaaaacccagauuauaacuuuuuuaacaacuacaaaaccuaccgaaaacugcaucccaaucagcccuuuuacaucuuaaaaccccaaaugccaugggaauugugggacauacugcaggagauuagucccgaagagauccaaccuaacccaccguccagcggcaugcuaggaauaauaauuaugaugaccuugugcgaucaaguagacaucuaugaguucuugccuuccaagcgaaagacagauguuuguuacuacuaucaaaaauuuuuugacagcgccuguaccaugggagcauaccacccacuucuguacgagaagaaucugguuaaacaucugaaucagggcaccgacgaggacauauacuuacugggaaaagccacgcucccuggcuuuaggaccauucauugcuag

SEQ ID NO: 61622 - RNA, 297 nt, Artificial Sequence; identical to SEQ ID NO: 61564
  Description of Artificial Sequence: Synthetic coding sequence

SEQ ID NO: 61623 - RNA, 528 nt, Artificial Sequence
  Description of Artificial Sequence: Synthetic coding sequence
augaacagccaacuugucaccacugaaaaacgcuuccugaaagauagccucuacaacgagggcauucuuauugugugggaccccuccguauaucacucugauauucccaaaugguaucagaaucccgauuauaauuucuuuaauaacuauaagacauaccgcaagcugcauccgaaccagcccuucuacaucuuaaagccucagaugcccugggagcucugggauauacuccaagaaauuuccccugaagagauccagccaaauccuccuucaucugggaugcuagguaucaucauaaugaugacucuuugugaucaaguagacauuuacgaauuccugccaucaaagcgcaaaacagacguaugcuacuauuaccagaaauucuucgacagugcuuguaccaugggcgccuaccacccacuccucuacgaaaagaauuuagugaaacaucugaaccagggaacggacgaagauauuuaucuauuaggaaaggcgacucugccaggguuccggaccauacacugcuag

SEQ ID NO: 61624 - RNA, 78 nt, Artificial Sequence; identical to SEQ ID NO: 61566
  Description of Artificial Sequence: Synthetic coding sequence

SEQ ID NO: 61625 - RNA, 2073 nt, Artificial Sequence
  Description of Artificial Sequence: Synthetic coding sequence
augggugccguggcuagggcacaugggggacugagaguugccagggcccgcgaaagcguagcagggggacgacaccggggugcaggacggcccggagcacgagcagccggugccgccgcgggauuagugagagcagaggccggcggcagacgggcuggcagaggacgaagacccgguagaggccugccaacaggaggagggggucucgcugcugcagccguaggccgagagguugcucagggacuaugugaugccauuaggcuggauggcggucucgaccuuuugcuccgguuguuacaggccccugagcuggaaacccgggugcaggccgcacgccugcuagaacagauacuuguugccgaaaauagggacagaguagcacgcauaggacuuggagucauucucaaucuggcaaaagaaagagaaccggucgagcuggcgagaagcggaucgggcauuuuagagcacauguucaaacacagcgaggagacgugucagcgcuuaguggcggcuggcggccuugaugccgugcuguauuggugccgacggacagauccagcacugcuucgacacugcgcacuggcucuuggaaauugugcccuucauggcggccaggccgugcagcgccggaugguagaaaaaagagcagcagaauggcuguuuccucucgccuuuuccaaggaagacgaauuacugucccuucacgcuugucuggccguggcuguccuagcaacgaacaaagagguagagagagaaguggagagaaguggaacauuagcccuaguugagccuuugguggcauccuuagacccuggcagauucgcaaggugccuugucgacgccuccgacacaucgcagggucgggggccagacgaucugcagcgccuuguaccucuguuggacucaaaucgacucgaggcccaguguaucggcgccuucuacuuaugcgcugaagcugccauuaaaucuuugcaggguaaaacuaagguuuucagcgauauuggggcaauccagagucucaaacgccucgucaguuauuccacaaacggcaccaaaucagcccuagccaaacgggcccuaagacugcuuggggaagagguuccacggcccauacuacccuccguccccagcuggaaagaggcagaaguacagacguggcugcaacagauuggauuuuccaaguacugugaaucauuuagggaacaacagguggacggggaccugcuguugagguugacugaggaggagcuucagacugaucuggggaugaagagcggcaucaccagaaaacguuuuuucagagaacuuaccgaacucaagacuuuugcaaauuauaguaccugcgaucgcucaaaucuugcugacugguuagggagccuagauccucgauuuagacaguauaccuauggacuggucagcugcggucucgauagaucccugcuccaucgaguaucggagcagcaacugcuggaagauugugguauacaucuaggaguccacagagcccggauacugacugcugccagagaaaugcugcauucccccuuacccuguacugguggcaagccgagcggugauacuccggacguuuuuaucucguaccggcgcaauucugggagccaauuggccucucugcugaaagugcauuuacaauugcauggcuuuucuguauuuaucgauguggagaaacucgaagcaggcaaguuugaagauaagcugauacagagcgucaugggugcaagaaacuuuguacugguccucuccccuggggcucuugauaaauguaugcaagaucacgauugcaaagacugggugcacaaagagauagucaccgcccucagcuguggaaagaauauagucccgaucauugauggcuucgaguggccagaaccucagguacugccagaagacaugcaggcugugcuuacauucaacggcauuaaauggagucaugaguaucaagaagcuacaauugagaagaucauccgauuccuccagggacguucuagcagagauaguagugcuggguccgacaccucucuggagggcgccgcucccaugggcccaacauag

SEQ ID NO: 61626 - RNA, 3426 nt, Artificial Sequence
  Description of Artificial Sequence: Synthetic coding sequence
auggcugcagccguaggagugagaggccgcuacgaacugccucccuguucaggcccaggcuggcugcuuucccuguccgcccuauuaucuguggccgcuagaggugcauucgcgacaacacacuggguggugaccgaggacggaaagauccagcagcaggucgauaguccgaugaauuuaaagcacccccacgaucucgugaucuuaaugagacaggaggccaccgucaauuaucuuaaagaacuggagaagcagcugguagcacagaaaauucacauugaggagaacgaagacagagauacaggacuagagcaacgucacaacaaggaagauccagacuguauaaaggcuaaaguuccccugggcgauuuagaucuguacgauggcaccuauauuacgcuugagaguaaggauauuucuccggaagauuacauugauaccgagagccccguuccuccagacccugagcagccagauuguacuaagauucucgaauuacccuacucgauccaugcguuccagcaccucaggggcguccaagaacgugucaauuugucugcaccucuucucccuaaggaagauccuaucuucacuuacuugucaaagcgcuugggucgcucuaucgacgacaucggucaucucauucaugagggacugcagaaaaauaccucuuccuggguucuguacaauauggcaucuuucuauuggcggaucaagaacgagccauaccagguaguggaaugugcaaugagagcucuucacuucucuuccagacacaauaaagauaucgcucucguaaacuuagcaaacguucugcauagagcucauuuuucggccgacgcagccguuguggugcacgcggcguuggaugauuccgauuucuucacauccuacuacacauuagguaacaucuaugcuaugcucggugaauacaaccacagcguguugugcuaugaccacgcgcuccaggcuagaccuggcuuugaacaggcaauuaaacgcaaacacgccguccucugccagcagaaacuagagcaaaaguuagaggcgcagcaucgaucacugcagcggacacucaaugagcugaaagaauaucagaagcaacaugaccauuauuugcggcagcaagagauuuuggagaagcacaaguugauacaggaggagcagauucuacgcaauauaauccacgaaacucagauggcuaaagaagcccagcuuggcaaucaccagauuuguaggcuugucaaccagcagcacagccuccauugucagugggaucagccaguuagauaucauagaggagauauuuuugagaauguagauuauguccaguuuggagaggauaguucuacuagcagcaugaugaguguuaacuucgauguccaauccaaccaguccgauauuaacgauagcgugaaaucaagucccguugcccacaguauucucuggauuugggggagagauagugacgcuuaucgagauaaacagcacauccucuggccaaagcgagccgacuguaccgagagcuaccccaggguucccgugggaggagaacugccuacuuauuuucuucccccugagaacaaagguuuacgcauccaugaacucuccucugacgauuacagcacugaagaagaagcgcagacucccgacugcucgauaacugacuuucgaaaaucacauaccuuaucauaccucgucaaggaacuggagguuagaauggaccugaaagcuaaaaugcccgacgaccacgcccguaagaucuugcucagccgaauuaauaacuacacaauaccggaggaagaaaucggcaguuuucuguuucaugcaaucaauaaaccuaaugcuccuauuuggcuaauucucaacgaagccggccuuuacuggagagcuguggggaacucaaccuucgcaauagcauguuuacaaagggcucugaauuuagccccccugcaauaucaggacgugccucugguuaaucuagcuaaucuucucauucacuauggcuugcaccucgaugcuacaaaacuccuucuacaagcacuggccauuaacuccuccgaaccucugaccuuccucagccuaggcaaugccuaccuagcccugaagaauauuagcggcgcuuuagaagcauuuaggcaggcccucaaacugaccacuaagugucccgaaugugagaauagucuuaaacugaucagaugcaugcaauuuuaccccuuucucuacaacauaacuucaucaguguguuccggcaccgugguagaagagucuaauggaagcgacgagauggaaaacuccgaugaaacaaaaaugucagaagagauccuagcgcucguggaugaauuucagcaggcauggccccuugaaggauucgguggggcccuggagaugaaaggcagaagacuagauuugcagggaauuaggguacucaagaaaggcccccaggacggaguagcucgaaguuccuguuauggagacugcagaagcgaagaugacgaagcuacugaauggauaacguuucaggucaagagagugaagaagccaaaaggugaccacaagaaaacuccaggcaaaaagguagagaccggccagaucgaaaacgggcauagauaucaagcuaaucuggaaauuaccggcccaaaggucgccaguccggguccccagggaaaaaaaagggauuaccagagacucggcuggccgaguccugaugaaugccucaaacugcgcuggguggagcucacagcuaucguuucuacauggcucgccgucuccucuaaaaauaucgauaucacagaacacauugacuuugcuacuccgauucagcaaccagccauggaaccgcucuguaacgggaaucugcccacaucaaugcauacccuggaucaucugcauggagugucaaaucgugcgaguuuacacuacacaggagagagucagcugacugaagucuugcaaaaucuaggaaaggaucaguacccccaacagucgcuggagcaaaucggcaccagaauugcgaaaguucuugagaaaaaccagacauccuggguccuaagcaguauggccgcucuguauuggagagucaaaggccaggguaaaaaagccaucgauugucugcgacaggcauuacacuaugccccacaucagaugaaagauguucccuuaaucagccuugcuaacauucugcacaaugccaaauuguggaacgaugcugucauaguggccacgauggcuguugaaauagccccgcacuuugccguuaaucauuuuacucugggaaauguguauguagcuauggaagaguucgagaaagcuuugguuugguacgaaucuacgcucaagcugcaaccugaauucguuccagcuaaaaaucgcauccaaacaauccagugccaucugauguuaaagaaagguagaagaucaccauag

SEQ ID NO: 61627 - RNA, 978 nt, Artificial Sequence
  Description of Artificial Sequence: Synthetic coding sequence
auggcccauuuuguucagggaacuucacgaaugaucgcugcagaaagcaguacagagcauaaggaaugugcugagcccuccaccaggaaaaaccucaugaauucucucgagcagaaaauucggugucuggagaagcaacggaaagaguugcuggaaguaaaccaacaaugggaccagcaguuccguagcaugaaagagcuuuacgaacgaaaaguugcugaauugaagaccaaacucgacgcugcugaaagauuccucucuacccgggagaaagacccccaccaaagacagcgcaaggacgauagacaacgagaggacgacaggcaacgggacuugaccagggaucgcuuacagagagaagagaaagaaaaggaaagguugaacgaagaacugcaugagcugaaggaggaaaacaaguuauuaaaagguaagaacacucucgcaaauaaagaaaaggaacauuacgagugcgaaauuaagagauugaauaaggcauugcaggacgcucugaauaucaaaugcaguuucucagaggacugucuaagaaagagucgaguggaguucugccacgaggaaaugagaaccgagauggaaguccuuaagcaacagguccagauauacgaggaagacuuuaaaaaagagagaucagaucgcgagagacuuaaucaggagaaagaggaauugcagcagaucaacgagacaucucaaucacaacugaaccgccuuaauucccagaucaaggccugccagauggaaaaagaaaaacucgagaagcaacuuaaacaaauguacugcccccccuguaacuguggcuuaguguuccaccuacaggaucccugggugccgaccgguccaggugccguucagaagcaacgagaacacccaccagacuaucagugguacgcccucgaucaauuacccccggauguucaacauaaagcuaacggccuguccuccguaaagaagguacacccauag

SEQ ID NO: 61628 - RNA, 5361 nt, Artificial Sequence
  Description of Artificial Sequence: Synthetic coding sequence
augggccugcugcagcuacucgccuucucauuccucgcccuaugcagagccagagugcgagcacaggaaccugaauucagcuacgguugugccgaaggcucuugcuaucccgcuacaggcgaccuguugauuggccgcgcccaaaaacuuuccgugacaucuacaugcggcuuacacaagccagagcccuacugcauuguaagucaucuacaagaagauaagaaaugcuucaucuguaauucccaggauccauaccacgagacccuaaacccagacagccaccuaaucgagaacgucguuaccaccuucgcaccaaacagacugaagaucugguggcaguccgagaaugggguugagaacguaacuauacaacuugauuuggaggcugaauuucacuuuacacauuuaaucaugacauucaaaacauucagacccgccgcuaugcugaucgagcgcagcucagauuuugggaaaacuuggggcguauacagguacuucgccuaugacugcgaagcuaguuuccccgguaucucaacuggccccaugaaaaagguagacgauauaauuugugacuccagguauagugauauugaacccuccacggagggagaagugauauuccgcgcacuggauccugcauucaaaaucgaagauccguacagcccuagaauacagaaucugcucaaaauaacaaaccuucgaaucaaguucguaaaauugcacacucugggugacaaucuuuuagauucuagaauggagaucagagagaaguauuacuacgccguguacgacaugguuguccgcgggaacuguuucuguuacggucaugcgucugagugugcuccgguggauggguucaacgaggagguagagggaaugguacacggccauuguaugugucgccacaacacuaaaggccucaacugugagcucuguauggacuuuuaccacgauuugccuuggcggcccgcagaaggacggaauagcaaugccugcaaaaaaugcaauugcaaugagcauaguaucucuugucacuucgauauggcuguguaucucgcuacggggaauguauccggaggagucugcgaugacugucagcauaauacaaugggacguaauugugagcaaugcaagccuuuuuacuaucagcauccagagcgggauauuagagauccaaauuucugugaaagauguacaugcgauccggccgggagccagaacgagggaaucugugauucauacaccgacuucagcaccgguuugauugcuggccaaugccgcuguaaacugaauguggagggcgaacauugcgacguuuguaaagagggguucuacgaucuguccucagaagauccuuuugggugcaaaucaugugcuugcaacccacugggaaccauuccuggcgguaauccgugcgacucagagacuggccauuguuauugcaaacgucuugucaccggacagcacugcgaccaaugucugccggagcacugggggcugucuaacgaccuugacggauguagaccgugcgacugugacuugggaggagcccuuaacaacucuugcuuugccgagagcggccaguguucuugucgaccucacaugauuggccgacagugcaacgagguugaaccugguuacuauuucgcaacauuagaucauuaccuguacgaagccgaagaggccaacuuagggcccggagugucaauuguagaacgccaguacauccaggaccguauacccaguuggacaggcgcgggcuucgugcguguuccugagggagcauaccuggaauucuucauugauaauauuccauacucuauggaguacgauauucuuauacgauacgagccccagcuucccgaccacugggagaaagcugugauuacaguacaacggccaggacgaauucccaccuccucacgcugcggcaauaccaucccggacgaugauaaucaaguggucagccuuagccccggaucccgcuauguggugcuaccccgccccgugugcuuugagaagggaacaaacuacaccgucagauuggaacucccccaguacacaucuucugacagcgacguggaaucccccuacacacugaucgacucccugguccuaaugccuuacuguaaaagccuagauauauuuacugugggagguucgggggacggcguaguaacaaauucugcuugggaaaccuuccagcguuaucggugccucgaaaacagcagaagugugguuaagacgcccaugacagaugugugcaggaacauuaucuucucuauuuccgcuuugcuucaccagacagggcuagccugcgagugcgauccacagggcucucugaguaguguaugcgauccuaacgguggucaaugccaaugccggcccaacguagugggcagaaccuguaauagaugugccccuggaaccuucggcuuugggcccuccggcuguaagcccugugagugucaccugcaaggcucugugaacgcauucugcaauccaguuacuggacaaugucacuguuuucaaggaguauacgcgagacagugcgaucgauguuugccagggcauuggggcuucccaucaugccagcccugccaguguaauggccaugcggacgacugcgaccccgucacuggggaauguuugaacugccaggauuauacuaugggacauaacugugaacgcugccuggcgggcuauuacggcgacccuauaaucggaucuggugaccauugucgcccuugccccuguccagacggcccugauuccggcagacaguuugcucguucguguuaccaggacccggucacacuccagcuggcauguguaugcgauccaggguauaucgguucuagaugugaugauugugcuagcggauacuucgggaacccaucugaaguuggagguuccugccagcccugccagugccacaauaacaucgacacgaccgacccagaagcuugugauaaggagaccgggagaugucucaagugccuguaucacacagaaggagaacacugccaauuuugucgcuucggcuacuauggggaugcauugcagcaggauugcaggaaaugugugugcaacuaccugggcaccguccaagaacauuguaauggaucugauugccagugcgauaaagcuacaggucaauguuugugucugccaaaugugaucggccaaaauugugauaggugcgcucccaauacauggcaacuggcuucuggcaccgggugcgaccccugcaacugcaacgcagcacacagcuuuggaccauccugcaacgaauucacagggcaaugucaguguaugccuggauuugggggaaggaccuguucagaaugucaagaacuauuuuggggagauccagauguugagugcagggcuugcgauugcgauccuagaggaauugaaacuccacaaugugaccagaguacuggccaaugugugugcgucgagggcguggaggggccuaggugugacaagugcacccggggcuauagcggaguuuucccagauuguacaccaugucaucaguguuuugcacugugggacgugauaauugcugaacuaacuaaucggacacauagauuccucgagaaagcaaaggcccucaaaauaagcggugucauaggaccauauagagaaacagucgacaguguggagcgaaaagugagcgaaauaaaagauaucuuggcucaguccccagcugcggagccccucaagaacauagggaaccuguucgaagaagcggaaaaacugauaaaggauguaaccgaaaugauggcucagguggaaguuaaacucuccgauacaacaucccagucuaacucaacagcuaaagagcuugauucauugcagacggaagccgaguccuuggauaauacugucaaggaauuagcugaacagcuggaauucauaaaaaacucagacauacggggugcucucgauucaauuacuaaauauuuucaaaugucacuggaagcagaggagaggguuaacgcuaguaccacagagccuaacuccacaguggagcagagcgcacuuaugagagaccgcguugaagacguuaugauggaacgagagucucaauuuaaggaaaagcaggaggagcaggcaagauugcuggacgagcuugccggaaaacuucaaucccuggaucugucagccgcagccgaaaugacuugcggaacgccccccggagccuccugcagugagacagaaugcggaggaccuaauuguaggacugaugaaggagagcguaaauguggaggacccggaugugggggacuuguuaccguggcccauaacgcauggcagaaggccauggauuuggaucaagaugugcugagcgcucucgcagagguggaacagcugagcaagaugguuuccgaagcaaaacugagagcagaugaagcaaagcagucggcggaggauauacuccucaaaaccaaugcgaccaaagaaaaaauggacaaaucaaaugaggaguuacgaaaucuaauuaaacagaucagaaacuuucugacccaggacucugccgauuuggauuccaucgaagcuguugcuaaugaaguucugaaaauggagaugccguccaccccccagcaguugcaaaacuugaccgaggauauucgagaacguguagagagucugagucagguugaagugauuuugcagcacucagcagcugauaucgcucgugccgaaaugcuccucgaggaagcgaaaagggccaguaagagcgcuaccgacgucaaggugaccgccgauauggucaaggaggcucuggaagaagccgagaaagcccaaguggccgccgaaaaagccauuaaacaggcagacgaggacauccaaggcacccagaaccugcucacaagcauugaauccgagacugcugccuccgaagagacucuguuuaacgcaucacagcgcauuagugaguuggaacguaacguugaggaacuuaaaagaaaggccgcucagaacagcggagaagccgaauauauugagaaagucguguauacuguuaagcaaucugccgaggaugugaagaaaacauuggacggagaauuagacgagaaguauaagaaggucgaaaaucucaucgcuaaaaaaacagaagaaucggcugacgcgcggaggaaagcagagaugcugcagaacgaagccaagacccugcucgcucaggcuaauaguaagcugcaacucuugaaggaucuagagaggaaauacgaagacaaccaacguuaucuugaagauaaagcacaggaacuugcaaggcuagaaggagaagugcggagccugcugaaagauaucucacagaaagucgccguguauucuacauguuuguag

SEQ ID NO: 61629 - RNA, 4011 nt, Artificial Sequence
  Description of Artificial Sequence: Synthetic coding sequence
auggcaacugaaaucggcucuccuccgagauucuuccauaugccccgguuucagcaucaggcaccucgacaauuauucuauaagagaccugacuucgcccagcagcaggccaugcagcagcuuaccuuugauggcaagaggaugagaaaggcagugaaccguaagaccaucgauuacaaccccucugucauuaaauaucucgaaaaucggauuuggcaaagagaucaaagagacaugcgugcuauacagcccgaugcaggguauuauaacgaucuuguuccucccauuggaaugcuuaacaauccaaugaaugcuguuaccacuaaauuugugcggacgucuacgaauaaagugaagugcccuguauucguuguucgauggacucccgagggacggcguuuggugacgggggccuccagcggagaauuuacccuauggaacggccugaccuuuaauuuugagaccauuuuacaagcacacgauuccccuguucgagcuaugacguggucccauaaugauauguggaugcucaccgcugaccacgguggauauguaaaauacuggcaaucuaacaugaacaacgugaagauguuucaagcacauaaggaagcgauuagggaagccucuuuuucacccacagacaacaaauuugcuaccugcagugacgacggcacuguaagaauuugggacuuccugagaugucacgaagaaagaauucugcgcgggcauggagccgacgugaaguguguagauuggcauccuacgaaagggcuuguaguguccgguucaaaagauucacagcaaccaauaaaauuuugggauccgaagaccggccaaagcuuagcuacguugcaugcacacaagaauacagugauggagguaaagcugaaccuuaacggaaauugguuguugacagcaucgcgagaccauuuaugcaagcuguuugacauucggaacuugaaggaagaacuccaagucuuucgaggacauaagaaagaggccacagccguagccuggcacccuguucacgagggcuuguucgcuaguggaggcagugauggaucccugcuguuuuggcaugucggcguugaaaaggaggugggagguauggagauggcacaugaagguaugaucuggucucuggcauggcacccucucggacacauccuuugcucuggcucaaacgaccacacuucaaaguucuggacaaggaauagacccggugacaagaugcgcgacagauacaaccucaacuuacugccggggaugucagaagauggcgucgaguaugaugaccuggaaccaaacagucucgcaguaauuccaggaauggggauucccgaacagcuuaaacucgcaauggaacaagaacagauggggaaggaugaaaguaacgaaaucgaaaugacuauucccgggcuggauugggguauggaagagguaaugcagaaggaucagaagaagguuccgcagaaaaagguaccauaugccaaaccuaucccggcucaauuccaacaagccuggaugcagaacaagguuccgaucccugcucccaaugagguccuuaaugaccggaaagaagacauuaaacucgaggagaagaaaaaaacccaggcugagaucgaacaggaaauggcgacccuccaguacacaaacccccaguuauuagagcagcucaaaauugaaaggcuggcccagaaacagguggaacaaauucaacccccccccaguuccgguaccccuuugcucggcccccagccguuccccgggcaaggccccaugucccaaaucccacagggauuccagcaaccccaccccucucagcagaugccuaugaauauggcucagauggguccgccuggcccgcagggucaauuuagaccuccaggaccgcaggggcaaauggggccacagggacccccucugcaucagggcggaggcgggccacaagguuuuaugggaccucaagguccucagggaccuccucaagggcugccccguccccaagacaugcaugguccccagggcaugcagcgacauccaggcccccacggaccuuugggaccacaggggccccccggaccucaggggucuucagggccucagggacauauggggccacaggggccgccugggccucagggucacaucgggccacaaggcccccccgguccacagggacacuuagguccucaaggcccaccaggaacacaaggaaugcagggcccucccgguccuaggggcaugcagggccccccccauccgcacggcauccagggcggaccaggcucacaagguauacagggccccgucucacaagguccucucaugggguuaaacccuaggggcaugcaaggacccccgggcccccgcgagaaucaagguccugcaccucaagguaugauaauggggcauccaccacaggagaugagaggcccgcaccccccgggcggucugcuuggccacggcccccaggaaaugagaggaccacaggaaauaagaggcaugcaaggcccuccgccccagggcucuaugcuuggaccgccucaggagcugagaggacccccuggaucccagucccagcagggaccuccgcagggcucacuugguccaccaccucagggcggcaugcaaggcccaccugggccacagggacagcagaacccugccagaggcccccacccaucccaaggcccaauucccuuccaacaacagaaaacaccauuguuaggugaugggccacgagcccccuucaaucaggaaggccaguccacuggcccacccccuuuaaucccaggacuuggacagcaaggggcacagggacgcaucccuccacugaacccuggacaggguccagggcccaauaaaggugauucccggggcccgccaaaccaccauaugggaccaaugucagagagacggcacgagcaauccgguggcccagagcaugggcccgaacggggaccauuucgaggaggacaggauugccgcggaccaccagaccgccgcggaccucauccagacuucccugacgauuuuagcaggccggacgauuuccacccugauaaacgauuuggucacaggcugagagaguucgaaggccgagguggcccccugccucaagaagagaaauggcggagaggugggccaggaccccccuuucccccggaucauagggaguuuuccgaaggugauggacgaggcgcugcacgagguccaccaggggcuugggaaggcaggagaccuggagacgaacgcuucccacgcgacccggaggaucccagauuucgcggaagacgagaagaguccuuuagacggggggccccaccgagacacgaaggacgggcuccgccacgagguagagacggcuuuccuggcccugaagacuucggacccgaagaaaacuuugacgcaucugaggaggcugcgcgcggccgugaucuccgcggucgagggagaggaacgcccagaggcggcaggaagggauuguuaccuacccccgacgaauucccucgcuucgagggugggcguaaaccugacagcugggaugguaaucgugaaccuggcccaggccaugagcauuuccgugauacgccaaggccugaucauccaccacaugacggucauuccccagcuucuagagaaagaucaucguccuugcaggggauggacauggcaucacugcccccacggaaaagacccuggcaugacgggcccgggacuucugagcaccgagaaauggaagccccgggcgggccuagcgaggacaggggcggaaaaggaagaggcgguccagggccugcucagcgggugccuaaauccggcagaucuucuagucucgacggggaacaccacgauggcuaucauagagaugaaccauuuggcgggccacccgguagcggaacaccaucacgaggggguaggucuggcucuaacuggggccgaggaagcaauaugaauucagguccaccuaggagaggcgcgagucggggcggaggcagaggcagguag

SEQ ID NO: 61630 - RNA, 774 nt, Artificial Sequence
  Description of Artificial Sequence: Synthetic coding sequence
auggcuaccgagauugggucuccccccagguucuuccacaugcccagguuccagcaccaggccccucgucaacucuuuuacaaacguccggauuuugcucagcaacaggcgaugcagcaacucaccuuugacggaaaacgcaugcguaaggcagucaauaggaagacaaucgauuauaaccccucagugauaaaguaucuggagaacagaauauggcaacgcgaccagagagacaugcgggcaauucaaccugacgcuggauauuauaaugauuuaguacccccaauuggcaugcugaauaaucccaugaacgcagucacuaccaaauucgugcgcacuagcacaaauaaaguaaagugcccaguauuuguagugagauggaccccugagggccgacgccuugucacuggcgcuucaaguggagaauuuacguuguggaaugggcugacuuucaacuuugaaacuauauugcaggcccaugauagcccuguuagagcuaugaccuggucacacaacgacauguggaugcugacugcagaucacggcggcuaugugaaguacuggcaaaguaacaugaauaaugucaaaauguuucaggcccauaaagaagccauucgagaagcaucuuuuuccccaacugauaacaaauucgcuacuuguucugaugauggaacugugcguauaugggauuuccuccgcugucacgaagagcgcauuuuacgugauacauguuuucaccauuguagaugcuacuuucugagcgugaaaagguag

SEQ ID NO: 61631 - RNA, 357 nt, Artificial Sequence
  Description of Artificial Sequence: Synthetic coding sequence
auggcaacagaaauuggauccccaccacgauuuuuccacaugcccagauuucagcaucaagcaccgaggcagcuauucuacaagaggccagauuucgcucagcaacaagcgaugcaacagcuuacuuuugacgggaagcgcaugcgcaaagccguuaaccgcaaaaccaucgacuacaaccccagcgugauuaaauacuuagaaaacaggaucuggcaacgagaucagagggauaugcgugcaauccagcccgacgcaggauauuauaacgaucugguccccccgaucgggaugcucaacaaucccaugaaugcugucaccaccaaauucgucagaacaagcaccaauaaaguuuag

SEQ ID NO: 61632 - RNA, 981 nt, Artificial Sequence
  Description of Artificial Sequence: Synthetic coding sequence
auggcgacggaaauaggcucccccccgcgcuuuuuccacaugccuagauuucagcaucaggcuccucgacagcuguucuauaaaagaccugacuuugcucaacagcaggccaugcagcagcuuacauuugaugggaaaagaaugcgcaaagccgugaacagaaagaccaucgacuauaaccccucaguaauuaaguacuuagaaaaucgaauuuggcagagagaccaaagagacaugcgcgccauucagccagacgccgguuauuacaacgaccuggucccccccauugguaugcuuaacaauccuaugaacgcugugacuacaaaauucguucgcacauccacaaauaaagucaaguguccagucuuuguugugcgguggacaccugaaggaagacgacuggugacuggggcaucuagcggugaauuuacuuuguggaacggccucaccuucaacuucgaaacaauccugcaggcucacgauucccccguccgcgcuaugacuuggagccacaacgauauguggaugcuuacugccgaucaugguggguacgucaaguacuggcaauccaacaugaauaacguuaaaauguuucaagcucacaaggaagccauucgcgaggcucgauucauucauaauauuccauuuuccguugucccgauugucauggugaaacuguucuccaaaugcauccuaggagccgagaugcacgggcugugucaguuucugggaaauuuccuccauccuauaaauaccaucuucuuuuucguguucacucauuccccuuucugcuggcaucugagcgaaguaguucuuucuagauaccaaccacugcaauacgucagagacguuuugucagccgccuuuuguaccgguuuucuguuuucauuuaugauuaacaacguuuauacacuguuccuguucauaauuuauugcguccggcaagaauacuucauaccuaauaaagaauuuucccucuag

SEQ ID NO: 61633 - RNA, 4293 nt, Artificial Sequence
  Description of Artificial Sequence: Synthetic coding sequence
augucuaggccgaguagugugucgccaagacagccagcgcccgggggugguggcggaggcgggcccagcccgugcggcccuggaggaggcggucgugccaaaggacuaaaagacauccgaauugacgaagaggugaaaaucgcuguuaacaucgcacucgagagauuucgcuauggagaucagcgcgaaauggaguucccuuccucacucacaagcacagaaagagcuuuuauccauagguugucccagagucugggccucguuucuaagagcaaaggaaagggagcuaaccgauaucucacagugaagaagaaagacggaagcgaaacagcacacgccaugaugaccugcaaccugacccacaauacaaagcaugcagugcgaucgcugauucagagauucccaguaacaaacaaagaaaggacggaguuauuaccuaagacagaacgaggcaauguguuugcgguugaggccgaaaacagagagaugucgaaaaccucagggaggcugaauaauggcauaccucagaucccaguuaaacgcggagagucagaauucgauucuuuuaggcagucucucccgguguuugaaaaacaggaggagaucguaaagauuauuaaggaaaacaaagugguacugaucguuggagaaaccgggaguggaaaaacaacucagaucccccaauuccugcuggaugauugcuuuaagaacgguauuccauguagaauauucuguacacagccaagaaggcucgccgcaauagccguggcagagcgcgucgcugcugagcggagagagagaauaggccagacaauaggauaucagauaagacuagaaaguagggugaguccaaagacacugcugacauuuugcaccaauggcguguugcugagaacacucauggcgggagauaguacacuuagcacggucacucaugucaucgucgaugaagugcacgaacgcgauagauucuccgauuuucucuuaacaaagcugagggaucugcugcaaaaacacccuacuuugaaauugauucuguccagcgccgcacucgacgugaaucuguuuaucagguauuuugggagcugcccugugauauacauacaaggcagaccuuucgaaguuaaagaaauguuccucgaagacauacuacggacuacgggcuacaccaauaaagagaugcucaaauacaagaaggagaagcagcaagaagagaagcagcagacuacuuugaccgaaugguauagcgcccaagagaauucuuuuaagccugagagccagcggcaacgcacaguucugaaugugaccgaugaguaugaucugcuagaugauggaggcgaugccguguucagucaacucacugaaaaggaugugaauuguuuggaaccaugguugaucaaggaaauggaugccuguuuguccgacauuugguuacauaaggauauugacgcuuuugcacaggucuuccaccugauccugaccgaaaaugugagcguagacuacagacauagcgaaacgucugccaccgcccugaugguggcugccgguaggggguuugcuucacaggucgagcaguugaucucgaugggcgccaauguacauaguaaagcaagcaaugguuggauggcauuagauugggccaagcacuucggacagacggaaauugucgaccuuuuagaaucauacagugccacccuggaauuugggaaccucgaugaaucuucgcuagugcagacaaacgguucugaccuaagcgcugaggauagggagcuguugaaagccuaucaucauagcuucgaugacgaaaagguggaccucgacuuaauaaugcaucuucuguacaacauuugccauuccugugaugcgggagcuguacuuaucuuucuuccaggcuaugacgaaauuguuggcuuacgcgaccgcauucuguucgaugacaaaagauucgccgauucgacccaccgcuaucagguauuuaugcugcacucuaacaugcagaccucagaucagaagaaggugcucaaaaacccacccgccggaguccgaaaaaucauucugagcaccaauaucgccgaaacuucaaucacagugaacgaugugguguucguaauugacuccggaaaagugaaagagaaaaguuuugaugcuuugaauuuugucacaaugcugaagaugguguggaucaguaaagccucagcuauccagcguaagggucgggcuggacggugcagacccggcauuuguuuccgccuguuuucgcgucuuagguuucagaacaugcuugaguuucagacacccgagcuauugcguaugcccuuacaagaauugugccugcacacuaaguuguuagccccagucaacugucccauugcugacuuccugaugaaggccccagagccuccacccgcacugauuguccgcaaugcugugcagauguugaaaacaauugacgcuauggacaccugggaagauuuaaccgagcuuggcuaucaccuggccgaccucccugucgagccccaccugggcaagauggucuuaugcgccgucguguuaaagugccuugaccccauucugaccaucgccugcacucuugccuauagagaccccuucgugcuccccacacaagcuagucagaaacgggcagcaaugcucugcagaaaacgauuuaccgcaggugcuuucucugaccacauggcacucuugcgggcguuccaagcauggcaaaaggcuagaagugacggaugggaacgggcauuuugugagaaaaacuuccugucgcaagccacaauggagaucauuaucggaaugaggacacagcuccugggccagcugcgggccagcggguucgugagggcccggggagggggagacauuagagacgucaacacaaacagugagaauugggccguggugaaagcagcccugguggcaggaauguacccuaaucuagugcaugucgauagagaaaacuuagugcuuaccggaccgaaggaaaagaagguaagauuucaucccgccucugucuugucgcaaccucaauacaagaagauucccccggcaaacggacaggccgcugcaauaaaagcccugccgaccgauuggcuuaucuaugacgaaaugacaagagcccaucgaaucgccaacauuaggugcugcucugccgucacaccagucacuauccucguuuucugcggccccgccagauuagcuuccaacgcucuccaggaaccuuccaguuuuagggucgacgguauuccaaacgauucuucagauuccgaaauggaggacaaaacaaccgcgaaccuggcagcccucaaacucgaugaauggcugcacuuuacucucgagccugaagcagccucccuguuacugcaacugcgucaaaaguggcacucacucuuccugcgacggaugagggcuccuagcaagccuuggucgcaaguggaugaagcuacuauccgggcuauuauagccguucucucuacagaagagcaguccgccggauugcagcagcccucagguaucggccaaaggccccgcccuaugucgagcgaggagcuuccacucgcaucuucauggcgcuccaacaacaguagaaagagcucugccgauacugaauuuagugaugaauguacaacugccgaacgcguauugaugaaaucacccucgcccgccuugcacccaccucagaaauauaaagaccguggaauucugcacccuaaacgggggacagaagaucgaucugaucaaucuagccugaaaagcacagacucuucuaguuacccuucuccuugcgcuuccccuagcccucccuccuccgggaagggaucaaagagcccuucaccccgaccaaauaugccugugcgcuacuucauuaugaaguccucuaaucuacguaaucuggaaauaucucaacagaagggaaucugguccaccacaccaaguaaugagcguaagcugaaccgagcauuuugggaauccagcaucgucuauuugguauucucugugcagggauccggccacuuccagggauuuucccgaaugagcucagagaucggaagggaaaagucgcaggauuggggaagcgcagguuugggcggcgucuuuaagguugaauggauuagaaaagaaucacugccauuucaguucgcacaccacuugcugaaucccuggaaugauaacaaaaaagugcagaucucaagggaugggcaagagcucgagccucuggucggggaacaacugcugcagcugugggaacgcuuaccuuugggagaaaagaauacgacagacuag

SEQ ID NO: 61634 - protein, 4 aa, Homo sapiens
  MOD_RES (2)..(3): Any amino acid
RXXR

SEQ ID NO: 61635 - protein, 4 aa, Homo sapiens
  MOD_RES (2)..(2): Any amino acid
  MOD_RES (3)..(3): Lys or Arg
RXXR

SEQ ID NO: 61636 - protein, 6 aa, Homo sapiens
  MOD_RES (1)..(1): Lys or Arg
  MOD_RES (2)..(5): Any amino acid
  MOD_RES (6)..(6): Lys or Arg
XXXXXX

SEQ ID NO: 61637 - protein, 8 aa, Homo sapiens
  MOD_RES (1)..(1): Lys or Arg
  MOD_RES (2)..(7): Any amino acid
  MOD_RES (8)..(8): Lys or Arg
XXXXXXXX

SEQ ID NO: 61638 - protein, 6 aa, Homo sapiens
LVPRGS

SEQ ID NO: 61639 - protein, 4 aa, Homo sapiens
LVPR

SEQ ID NO: 61640 - protein, 4 aa, Homo sapiens
  MOD_RES (1)..(1): Ala, Phe, Gly, Ile, Leu, Thr, Val or Met
  MOD_RES (2)..(2): Ala, Phe, Gly, Ile, Leu, Thr, Val or Trp
XXPR

SEQ ID NO: 61641 - protein, 4 aa, Homo sapiens
IEGR

SEQ ID NO: 61642 - protein, 4 aa, Homo sapiens
IDGR

SEQ ID NO: 61643 - protein, 4 aa, Homo sapiens
AEGR

SEQ ID NO: 61644 - protein, 4 aa, Homo sapiens
  MOD_RES (1)..(1): Ala, Phe, Gly, Ile, Leu, Thr, Val or Met
  MOD_RES (2)..(2): Asp or Glu
XXGR

SEQ ID NO: 61645 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 61646 - DNA, 800 bp, Artificial Sequence
  Description of Artificial Sequence: Synthetic transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 61647 - DNA, 800 bp, Artificial Sequence
  Description of Artificial Sequence: Synthetic transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 61648 - RNA, 758 nt, Artificial Sequence
  Description of Artificial Sequence: Synthetic transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 61649 - RNA, 854 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 61650 - DNA, 896 bp, Artificial Sequence
  Description of Artificial Sequence: Synthetic transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 61651 - RNA, 725 nt, Artificial Sequence
  Description of Artificial Sequence: Synthetic transcript sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 61652 - RNA, 1536 nt, Artificial Sequence
  Description of Artificial Sequence: Synthetic transcript sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 61653 - DNA, 767 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgctcgagcatgcatctaga

SEQ ID NO: 61654 - DNA, 750 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgc

SEQ ID NO: 61655 - DNA, 1578 bp, Artificial Sequence
  Description of Artificial Sequence: Synthetic transcript sequence
taatacgactcactatagggaaataagagagaaaagaagagtaagaagaaatataagagccaccaatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgatcagccagcgctgccttctgcggggcttgccttctggccatgcccttcttctctcccttgcacctgtacctcttggtctttgaataaagcctgagtaggaaggcggccgctcgagcatgcatctaga

SEQ ID NO: 61656 - RNA, 851 nt, Artificial Sequence
  Description of Artificial Sequence: Synthetic transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 61657 - DNA, 1838 bp, Artificial Sequence
  Description of Artificial Sequence: Synthetic transcript sequence
taatacgactcactatagggaaataagagagaaaagaagagtaagaagaaatataagagccaccatggaagatgcgaagaacatcaagaagggacctgccccgttttaccctttggaggacggtacagcaggagaacagctccacaaggcgatgaaacgctacgccctggtccccggaacgattgcgtttaccgatgcacatattgaggtagacatcacatacgcagaatacttcgaaatgtcggtgaggctggcggaagcgatgaagagatatggtcttaacactaatcaccgcatcgtggtgtgttcggagaactcattgcagtttttcatgccggtccttggagcacttttcatcggggtcgcagtcgcgccagcgaacgacatctacaatgagcgggaactcttgaatagcatgggaatctcccagccgacggtcgtgtttgtctccaaaaaggggctgcagaaaatcctcaacgtgcagaagaagctccccattattcaaaagatcatcattatggatagcaagacagattaccaagggttccagtcgatgtatacctttgtgacatcgcatttgccgccagggtttaacgagtatgacttcgtccccgagtcatttgacagagataaaaccatcgcgctgattatgaattcctcgggtagcaccggtttgccaaagggggtggcgttgccccaccgcactgcttgtgtgcggttctcgcacgctagggatcctatctttggtaatcagatcattcccgacacagcaatcctgtccgtggtaccttttcatcacggttttggcatgttcacgactctcggctatttgatttgcggtttcagggtcgtacttatgtatcggttcgaggaagaactgtttttgagatccttgcaagattacaagatccagtcggccctccttgtgccaacgcttttctcattctttgcgaaatcgacacttattgataagtatgacctttccaatctgcatgagattgcctcagggggagcgccgcttagcaaggaagtcggggaggcagtggccaagcgcttccaccttcccggaattcggcagggatacgggctcacggagacaacatccgcgatccttatcacgcccgagggtgacgataagccgggagccgtcggaaaagtggtccccttctttgaagccaaggtcgtagacctcgacacgggaaaaaccctcggagtgaaccagaggggcgagctctgcgtgagagggccgatgatcatgtcaggttacgtgaataaccctgaagcgacgaatgcgctgatcgacaaggatgggtggttgcattcgggagacattgcctattgggatgaggatgagcacttctttatcgtagatcgacttaagagcttgatcaaatacaaaggctatcaggtagcgcctgccgagctcgagtcaatcctgctccagcaccccaacattttcgacgccggagtggccgggttgcccgatgacgacgcgggtgagctgccagcggccgtggtagtcctcgaacatgggaaaacaatgaccgaaaaggagatcgtggactacgtagcatcacaagtgacgactgcgaagaaactgaggggaggggtagtctttgtggacgaggtcccgaaaggcttgactgggaagcttgacgctcgcaaaatccgggaaatcctgattaaggcaaagaaaggcgggaaaatcgctgtctgataagctgccttctgcggggcttgccttctggccatgcccttcttctctcccttgcacctgtacctcttggtctttgaataaagcctgagtaggaaggcggccgctcgagcatgcatctaga

SEQ ID NO: 61658 - RNA, 1796 nt, Artificial Sequence
  Description of Artificial Sequence: Synthetic transcript sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 61659 - DNA, 905 bp, Artificial Sequence
  Description of Artificial Sequence: Synthetic transcript sequence
taatacgactcactatagggaaataagagagaaaagaagagtaagaagaaatataagagccaccatggtgtccaagggtgaggaattgtttaccggggtggtgcctattctcgtcgaacttgacggggatgtgaatggacacaagttttcggtatccggagaaggagagggtgacgccacatacggaaagcttacactcaaattcatctgtacgacggggaaactgcccgtaccctggcctacgctcgtaaccacgctgacttatggagtgcagtgctttagcagataccccgaccatatgaagcagcacgacttcttcaagtcggcgatgcccgaggggtacgtgcaagagaggaccattttcttcaaagacgatggcaattacaaaacacgcgcagaagtcaagtttgagggcgatactctggtcaatcggatcgaattgaagggaatcgatttcaaagaagatggaaacatccttggccataagctcgagtacaactataactcgcataatgtctatatcatggctgacaagcagaaaaacggtatcaaagtcaactttaagatccgacacaatattgaggacggttcggtgcagcttgcggaccactatcaacagaatacgccgattggggatggtccggtccttttgccggataaccattatctctcaacccagtcagccctgagcaaagatccaaacgagaagagggaccacatggtcttgctcgaattcgtgacagcggcagggatcactctgggaatggacgagttgtacaagtgataagctgccttctgcggggcttgccttctggccatgcccttcttctctcccttgcacctgtacctcttggtctttgaataaagcctgagtaggaaggcggccgctcgagcatgcatctaga

SEQ ID NO: 61660 - RNA, 863 nt, Artificial Sequence
  Description of Artificial Sequence: Synthetic transcript sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 61661 - RNA, 716 nt, Artificial Sequence
  Description of Artificial Sequence: Synthetic transcript sequence
gggaaauaagagagaaaagaagaguaagaagaaauauaagagccaccaugaacuuucucuugucaugggugcacuggagccuugcgcugcugcuguaucuucaucacgcuaaguggagccaggccgcacccauggcggaggguggcggacagaaucaccacgaaguagucaaauucauggacguguaccagaggucguauugccauccgauugaaacucuuguggauaucuuucaagaauaccccgaugaaaucgaguacauuuucaaaccgucgugugucccucucaugaggugcgggggaugcugcaaugaugaaggguuggaguguguccccacggaggagucgaauaucacaaugcaaaucaugcgcaucaaaccacaucagggucagcauauuggagagauguccuuucuccagcacaacaaaugugaguguagaccgaagaaggaccgagcccgacaggaaaacccaugcggaccgugcuccgagcggcgcaaacacuuguucguacaagacccccagacaugcaagugcucauguaagaauaccgauucgcgguguaaggcgagacagcuggaauugaacgagcgcacguguaggugcgacaagccuagacggugagcugccuucugcggggcuugccuucuggccaugcccuucuucucucccuugcaccuguaccucuuggucuuugaauaaagccugaguaggaag

SEQ ID NO: 61662 - RNA, 1316 nt, Artificial Sequence
  Description of Artificial Sequence: Synthetic transcript sequence
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 61663 - RNA, 806 nt, Artificial Sequence
  Description of Artificial Sequence: Synthetic transcript sequence
gggaaauaagagagaaaagaagaguaagaagaaauauaagagccaccauggguguaaggcacccgcccugcucccacagacuccuggcggugugugccuugguaucgcuugcgaccgccgcacugcuugucaauccggggguagucgugcgcaucagccagaagggacuggauuacgccucgcagcaggguaccgcggcacuucagaaagagcuuaagcggaucaagauuccagacuauucagauagcuuuaagaucaagcauuugggaaaaggucacuauucguuuuacucgauggacauuagagaauuccagcucccuucgucccaaauuuccauggucccgaauguggggcugaaauucagcauuucgaacgcgaacaucaagaucucagggaaauggaaggcacagaagcgauuucucaaaaugucaggaaacuuugaucucuccaucgaggggaugucaaucucggcggacuugaaacucggcuccaauccuacaucgggaaagcccacuauuacggccucgucguguucgagccauaucaacucggugcacguccauaucucaaaguccaaaguaggauggcuuauccagcucuuccacaaaaagauugagucggcuuugcgcaacaagaugaauagccaagugugcgagaaagucacaaauuccgugucaucagaauugcagcccuacuuccaaacgcuguaaugagcugccuucugcggggcuugccuucuggccaugcccuucuucucucccuugcaccuguaccucuuggucuuugaauaaagccugaguaggaag

SEQ ID NO: 61664 - RNA, 1573 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaggaagcggagcuacuaacuucagccugcugaagcaggcuggagacguggaggagaacccuggaccuaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaauggucuuugaauaaagccugaguaggaag

SEQ ID NO: 61665 - RNA, 1568 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggugauaauaggcugccuucugcggggcuugccuucuggccaugcccuucuucucucccuugcaccuguaccucuuggucuuugaauaaagccugaguaggaag

SEQ ID NO: 61666 - RNA, 863 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugauaauaggcugccuucugcggggcuugccuucuggccaugcccuucuucucucccuugcaccuguaccucuuggucuuugaauaaagccugaguaggaag
